United States Patent 9,567,581 (SELECTIVE REACTIVATION OF GENES ON THE INACTIVE X CHROMOSOME) - sequence listing, part 28

SEQ ID NO: 3501 - DNA, 113114 bp, human
ctgcatggccgcctcctcccctcccaggccgccagggatttgccgggaagagcgggggcagggggagactcccgggggtgcgcaggaccgcggggggccgagtcctcgggctcgagaagattgtgtccacccgctgtccgaggcccaggctgtcccctcaggtcgtcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaaagcaggcagtgtagggactcatgctgttgcctaggttacctccaagggcacctgctgagcattgccctgtggttgaaggcaggctgttggccttcaggatcagtgagtggcaaagtctgagtgaaacttgatgagaagcagtagaggctaggctgaagctaggccctggcatttatatggtgtgaggaggcctagagctgtgatcttaggagtgtataataaaacttggaaaaaccactattttaccaggaagaggctcactgctggggaacagacttcaaagtaggtgatcataggggactcagggggagggctggctgggactttccggtcaagacctcacagtgcagctagagggtgggggtggtggtgggggtgcagttggctatgcagaggtgtggctagtgcatactctgacacagaccaggttcactgaggggctgaggtcactggtttaaattatagtgagtataggtcaggaagaaacagaaaggaatttggtatgtccctagggtctcagaatactttggcttgggtccttgctgtggtgtatcttgaactcactgacattattttttatactagaggttcttagggacaccacagtttttattttggaaaagtcaggaacaccctatcacatggagctcctagaaaatctcatcctcagtactacctttgctgagctcttcaactttcccaagcaaccattcagatcctgagattctgaatgtctttgcctgcagacactttctgctgtttactcaaaatttcccagccgtctgtgccacagcactggtgtctcaaagggatagaagaagctaatagaagtttgtgtcatttttatcagccagtatttgtccaatagccattctgggagaaacagaatgtacacccccacgctcaaggaatttggtgcatcgtccatttttattaatatctgacatgacttccatctctaagagtctatgaatttggtgtttggaggcacctcgtaacccaatttctctttgactaggcctaatatcttcacagacctaaagctgtgttgagtggcttaatgggtggaaggtcctgcagatgattgggattgttgtgaggaagccccacagaaaggtagtttcttatactttatttttagagatgggatcttgctctgttgaccaggttggagtgcagtggcgcagtcatatttcacgacaccttcaaactcctgggcacaagcaatcgtcccacctcagcttctcaagtagctagaactacaggcatgcgccaccacacctggctaatttttatttatttatttatttatttaaaaacagactcttgctatgttgcccaggctggtctcaaactcctggcctccagcagtcctactgcctcagcctcccaagtagctgggaagaaaggtagttttgatgtttgaggaacagctccacatcagagtgcctctgggcatgggaaaaagccacagaagttagaagggatatgggattcaggccttactagagcatgcaatgtgcagtttttgtggaccctttgatgtatacagttttgtggtgtcaccagctgtatatcttatcccctctcttcaccagttttggaggaaagccaactttccctgggtcctaggcttgggtggattggcaggcaaaaggtccctgagagggaggcaagtgatcaaactctggtttagtgaaaaaaggaaaaagatcaggagggaaatgagcctgtatttcttgccaagatcatgggaaatttgtgagttccccaacccagaccaaacagcagacaggacaggaggcaaccaggcaattctgtggaaagtaaaggcccaagcatagcttcttggggtggtagggaagccttttggaggaaagaggggaaagagaagcaagacgccattgattgtaggccccagctcaatattgggaccctaagtgagttggacctgcaatagggttagggttgggagttcagaggacaaggcagaacaagccagagttgctaacattggctctatgcttaagtctttttaaaagtactccagagtaaaacttgactgccggtccaccattgagccaaaaaatatggaaggcatttttgttttactgggcagtttataagcatggtccttgtaagctcccaaggggggtcaaggctgaggctctcatcaccagagaaagggacaatggtcaggaaggttcactactaggcacaagatagttcaggctgatggtccactctgatggaaacagaattttctaggcatggggaagaatgatacactctgcctttgggtgaaccaagagtcccaaggttgggtggggccaggtagagtaggctgtctttctccttctcaccttaggggttttcattgcttggttcagtgtctcactggactgtaacactaaattgctgactttgggagcaaagtgtattttgagcaaatctgccaatctcttgacttcagctgaaggctcttgactactgtccagcagagctagatcaggttggcttagcgcctgctgtggtgcttcaagccacacagcccttggccaggcatctctcacgtcattcccctgccccctttccaaccaaatgggatcttgaactatgaccatgactgatactgaaagggatgagaataagagattgggtcatttggaggccaaccaggaggatgcttgtttgagttggggtagctggttgaggctggatgcctggatcactgtacagtggcctcaaatgctcattctaagtctaaaaaagcaagacccagggccaaatctggactccccaaagctggcagtctcagtgataccagctaggcagtaactgtgacttagacaacttgtgcccctaacttattctgtgactttggacaggcacttcacctctctgtatgtcagtttatctatctataaaatgagagggtttgactaaataaactttctagccctaccattctatccttctaaaattatgtgatatcttattctttactattcatatgtcatacattttgactcatttaagtaaataaaagttcgttaagctgcctgaatgacagtgaggatggattgggagaagattgggaaagcaaggaaaagccctatatacatcatttccccacgtcatttgtatttaaagactatggggctgcccatgggtatagatgtgtttaaaaattacccaatcctttttacctagtatgtaagggcaaccctgcatgtggagctgcttcttccagagtgtcctgattggtatagagctgggtctccaagagaactccctggatttggcaggcaagcagggtgggtctgtatgctgctgttttccagcgtttgaacctgttcctcaaaagtattaaattataaacatttcctcaagcctcagtttggacccctcttctgaaactgaatttcccacagcacagtcttatttctcagaaatgcatagtcagtgtgaccttggtttgctgttacttccagctagcagaggaaacggattcctaaatgaggttcccttcagaggtcttcaaacagggcgttttgatagctggctcagggccactgcctggatcctgctgtggtggggttggggagggttgctactgtgatcctggagaaggcccattagatgcccacaatccctggtcaactgcagcgtcagggcttagctgagagtgtgcctacggaagtagcaggcacagagctctctttccttttccttggaagtcattggccgtattgcctccagcccatgaagagtaaacaagcagctggactgtcaacatttgtagaagtatataaaggatgccatatcaaccttttgagcagaccagtttcccaggaagatgcactgcttttcccaccagcctcattttatggttttgttgcattttgaaaagatgaaaactactcttttcagattgtgtgaatgacggagtgggatttcctgtcttgaaaggtgttgtctcacttgagattgaatgaatgaaccctagagaaaaggctttgttctacacatatacacatgtgcgcaagcgcatgcgcacgcgtgcacgcgcgcgcacacacacacacacacacacacacacacacccataccctacaccctaagccatagattatgaatattccatctgaaataagtcatttcccatctgttcatggaattaggtgtaccagaggcttctgtaaagattatgctgtactagtgcaaaggaaccagactaagaagcttgctaggcgagagtgatgaaaagagtatggccagcctggattgtacctcttgaactggacccatttgcaactccccagcagtggggctgggaaactttattgcaagtctctttctcccttcatcctcctgtatctctcccagtattcaaatattactgggaagcgggtttaggcaaccccagctctctctggctttaggggtgacagaagactaaacctagagagatttcatcacctgcctgaagctgggtgctatggtagataatgtgaaatcgcttgacacctccttgtggatggggaatgtggcctgtttgggtggcttgaggaagtgcagcctcttcaccctaggagtctcaccctcttttatcctcaacttcgctccagtttccagcattggtgggagaagggatgaaattggctgtcccaatcacatattttctcagcttctcctactttcacagtgcattttttatcacgtttgctatatgtgccatacccttttttcccagtattgttccctcttttctttttcttcctactgctcagttagaggaacaattggggtttgggatgttgtataggcccaactcctgccagagtcacaggcccactcctacacatcctacagaggcctcccttccccctttccccttcctttcctctcttactttccactttctgggtgaagggtgactttcgatggagcactcaagagtgtggaagccatcacctctggattttcgcataaagatagctgctatgacaccctttttgtcacttctacacctctttccacagccctagtaacccagctcagaaggtagtattgtagaaagtcttactcaataatattcaacaaatgtcgtcattacttgtattcctttcttttcaaatcctgactatcattgtcccccatctcctgggccagctgaacttccagagatttcatactggtttttggtagcttccgtgtttctggttcattctattttgagcccctgacatctattttcttgccaaaactgctgcacaattggttgtagaggggtcagagaagggagaagacagacactcaagtcctaacgagagtcaaaagtgcctttacaggaagattgctccagcccaggaggttgaggctacagtgagccatgatcaccactgcacctgtctcaaaaacaaaaagaaagaaaaagaaaaaaataggccaggcccagtggctcaagcctgtaatcccagcattttgggaggctgaggcaggaggatcacttgagcacaggagtttgaggccagcctgggcaacatagggataccccgtctctacaaaaaaaatttttaaaaactaggctggcatagtggcacatgcctgtggtcacaggtacttggaaggctgagatactaggatctcttgagccaaggcggttgacgttgcaatgagccatgatcacaccactgcactccagcctgggtgacaagtgagaccctgtctcaaaaaaaaaaaaaaagtgccttcagggagggtggaggtgggggagtgaagctcccagtttagttgctcttctgcttttacatggctgaaggggaaaagaaagggaaatgttgccaaacaagcaatgcccataccatctttttcctcaacttaacccatggatctcctcacctacccgcttatccagactggaaggatatatgcatgcactcatgtgtccagacctatgtgtatgtgtgtacagcagggtgtgtgatgtctgtccaagccggttagcacagttacttagaacatggtgcctatgagactgaggtcacaggttcagtcacttgttcaggtcactgggcttctcacaaagaaaagagctcttcctttgttcatggcccatgtcccttgtgtggaggtgtcactaatgctaggggagaccaggtagaagaatagagatgacttcttataagccttccctgctactgggaaaaaaatgtgaagcacacagcctaatgatggctgctctgctgcattccacggtggagtttcgttgacatttacctccttacatctgcctaatatgcaccctaataagtataataatagtggtggtagtaatagtaataataattgccaacatttattttacatttagcaattaagtctgtgcgaggcactatactaagcactttacatgtaccaacttattttaattctcaacaaccgtatgaggtaggtaccattatttcctctatttcacagataaagagaagcacacaaattaagtaacttgctcaaactcatagcagataatggctgagccaggatttggacccagacagtctgagtttagaactcctgcttttagacctcacctaagacatagtgaaggtgtagggggcaactaccaagggagttgcagtttttcattcctgtaccttccggcatccttatgactcaaggataaaaagagatgaccaagaagtggttaataaatcaaaagattgatagtctcatgatacatggcatactcttctaactacccattttactctacccagatctatatgcaaagcgtcataattcttgagtccaaaaggtccatagaaactttctcttcaaaatgcaaatcaaaaccgcaatgagataccatctcacaccagtcagaatggctattattaaaaaatcaaaaaataacaggtactggtaaggctgtatagaaaaaggaacacttatacactgttggtggaaatgtgaattagttcagctggaaacagtttggagtttgttgttgttgttgttttgagacagcatctcactgtcacccaggctggagtgcagtggcacgatcttcgctcattgcagccttgacctcccagactcaagggatcttcccacctcggtctcccaagttgctgggactacaggtgcacatgaccacacccagctaatttttgtattttttgtagagatggggtttcttcatgttgcccaggctgatctcgaactcttggactcaagccattggccctccttggcctcccaaagtgctgggattacaggcgtgtgccactgcacccagtctcagtttggagatttctcaaagaatttaaaacagaactaccgtttgacccagcaatcaatcccattactgggtacatagccaaaggaaaacaaatcattctaccaaaaatgacacatgcttgtatatgttcattgcagcactatttatagtagcaaagacatggaatcaacctaggtgctcattgatggtggatcagataaaccaaatgtggtagatatacaccatgaaatattatgcagtcataaaaagaatgaaattatgtcctttacagcaacgtggatacaacatggatgcagccagagaccattatcctaagcgaattaacaaacagaaaaccaaataccacatgttctcactttcaagtgagagctaaacattgacatacatggacataaagatgggaaaaatagacactggagactaccagatggggaagggtgggaaggggatgacagtttacaaactacccatcaggtaccatactcactagctgggtgacaggatcatcgtacaccaaacctcagcaacatgaaatttacccatgtaacaaacctgtacatgtacaccggaacctaaaataaaagttgaaaaagaaactgtctcttcttagttgtttagccctgaataagtcacataactttctgggcttcagtattcttatctacaaaataagacatacagtatctactttaataagaaaatgaagggtcaaatcaaagtgtgagtatgtgaaagatctttgtaaattatgaagtggttgttattattattatccttttccagcctctaaaaacagagtccctatccatttctctaaatgttgctctaagtatttcctccccatctcccaccttcccactccatcttttccatctccccactgtgttcttctgcaatttgacccctgtgtcctgtagctaaatactagctgtgttttctttgttcctcagttctctgagagcccagggagaggaggggccagatcctaggtcatatacattcaaggaagcaaggcatgttgaaatatttacagcacttggcaggagctcacaaacctccctacaagtcaaggactgagtttttttagtaggagttgctacgggttgggggcagatggtggggtggagttagggtgtcacttcctcccgagggtctctcacagagcctctgttctcctgcaggtaacgaagaataaggaaagggatatttagggtcagaaggtctgggctaggggacatcaagcatagaaggagctttgctcctttgtattcagctttggagtgggccagtttccttgtgttctgaacaggatagctccagaaaacagaggccacaggattgtggccttcacaaagaaggattgccaaagcggttttgattaagcatttcaatggccactaagggagttttcattaagacaagctagtaggcaaatcagaacaaaaatgttttgcttttttgttgcaaacaacaaaacaaaattcctaaacccttctttaagactaagatttcaaatatactagggctcaccatattgattttcagtaatttaaatgccttctgatctggaaggcattttggaaatcacacagtcttactccctctggttcccatcttaaggtgaaaaactgagacctggaaagatgtgactttaatcagcattgtgagtagatgcttatagtagagcttggtttgtcagaggactggggaataagcggtaggctgctgtcgcattaggtgttccccagctcaatcactggcattcttctcccctttctctctccctgaacttttcaaagtcaatccccaggccctactttgtgaaaagagatggagacaaaattcaaaaggtatgatggtgaaaagtctctttcccactcctatctcccagccaccctgtttccctccctaaaggccaccagtgttatctggtgtgtcccttcagagatactctgtatatgtacaagcaattgtgtgtgtgcacatgtgtgtgtgtataccctacccttaacactttcaacttttactgtagattaaagagcacacaggccaggcatggtggctcacacctgtaatcccagcactttgagaggccgaagtgggtggatcacttgaggtcaggagttcaagaccagcctggccaaaatggtgaaatcccgtctctaccaaaaatataaaaattagctgggcgcagtggtgtgcacctgtaatcctagctacttgggaggctgaggcaggagaattgcttgaacccaggaagcagaggctgcagtgagccaagattgtgccactgcactccagccttggcaacacagtgagactctgtctcaaaaaaaaaaaaaaaagtacccgtgcagatttcttacgtgggtaaattatgtggcgctgaggcttggggtcttaatgatcctatcacccaagccataagcatagtacccaacaagtggtccttcagcccatgcacccctccctcccctgtctagtgatccccaatgtcgattgttcccatctttatgatcatgtgtattcaatgtttagctcccacttataggaacatgtggtatgccctacttgtaaagtacaaattgtaggctaccatccaccttatcctccactttgcttttcatacttcgaactatatcttggtacattaagttcataaagtcttcattttttttaaatgattgcaccatattccattttatggccatatcacaatctatttaatcaacaccttacattcatactgctactaacctttgactatggggctttagtgtcaaacagtgctagattcagattactttccacatgacttgccttgacaaagttttaaaacttcttggagtctgagttttctcatacataaaataagtataataataccatctgttattgctggtgtggagattaaatgagatgaggcatgtaaaacatctagcatacagcctggcacgtactaagtgttcactaagtgtttgtgctctccctgctcaccagccctccctataccttccacctccaattcaattaatattggttgaattcaagtcaataggtctttgacctatgttagactggaccttggatgcaccagagaaggaaaagggtccctcaagaagtgtatgattcccttgagaagacataacacaccaaacaactacagttgtgctaagtagttaaaaaaaaagtgtgtatattacattgaatgcaattttcatgtggtgatgtagaaaaagagaaatgattgtgagggcaggaggaatcaaggccctgatagaattggaatttgaaatagggtttagctaagtggagaattgggcagtggcagagtgggggcagagaaatggacagttgggctgttgcttggattctgggtctttgccctctggcagcctagtgagtcactgttccccattaggccttacccagcaggtggggtggaggggcaggaggagaggaaaatactgaggacatttggggaaaaggacacggggagggggaatgtttgggcactgggccacagaatgaggtgcctacagatggtttgtggcacagcctactcagcccccaccacctgctcttccatgtcagccacccaagtgcatttctaagaggtccaaggaaaagaagagcataagtagcagcagctctcaacccctcactctgtgtcccaaacaggtcctcagatcccataagccctaggagagggaagaatattgaatgataaaaattccctgtgtgtgtgggcattgtagtttacatcttagtttgtttttttttttttttttgagatggagtcttgctctgtcgcccaggctggagtgcagtggcgcgatctcggcttctcggctcactgcaacctccgcctcccaggttcaagcgattctcctgccccagcctcccaagtagctgggattacaggcacatgccaccatgcccagctaatttttgtatttttttttttttagtagagacggggtttcaccatgttggtcaggctggtcttgaactcctgaccttgtgatccgcctgcctcggcctcccaaagtactggaattacaggtgtgagccactgcgcccagccctacatcttagtttacattgacacttgcaacagaggcagttatgaaataaaatacccaattgaatttcatcatgtgccaatatttttggtcacatcaagtgctatgttgggagtttctggaaaatgaaaagtcaacgtggtttgtgttacttagggaaaaggtcactgcagtgaaggactgtatagagattcatattcccactttacagttgcagaaaatggacagcattttcattgagggcaagtgagtgccctgaggtaatacatttaatatttagcagattaagcccaggagtttgaggctgcagtgagttttaatgatgccactgcaacctagcctggacaaaagagcaagatcccatctcttatatatatgtatatgcatatatatatatgcatatatatatgtatatatatatatatattttttttttttttagtggatctgggactacaactgaggcctcccaattccatgttctatgggggaagaaatgtagaagctacctgaaaggtggaataaaaattttcctaaacttagtagcagcttaaagtttaagtgtatgggtaagaagcagtatagtatgatgaaacaaagaactgagagtctaaaagttcaggggctcatgaaaggaaggatctggacataaataatgcctgctggctgggatcaagaaagagcactggactaagagtcaggagacctgggttctggttctggctctgttactggctgtctttctgaccctgccaagtcccttcccctttctcaacttcaaatttctccacttatgcattgagaaagttgaacttcccagagacttagtgacacttagaaccaatggtatctgtaaaccaaggaggctttgggaacttcctgacaaggggctgagggtgatggagagtggtgaggttgtgagtggaagagaacttctctgatgaaaatggaaaacagatcctctcaaatttgagcaaaggtgagttttggaaagggtatctacctcatagtctctatcctatatccttggagaattctatccaagagaggggaaaaaggaagagtgtgtacgtgtgtgtgtgtgtgtgtgcgcatgcgtgcaagtgagcaagaatttcaatgcgaagctaatgtttggtgggacagattgtaatatgctgagtcaatatctctggaaatctctttaataatctccactttaagatcacttttctaagacgttggttttacttttaaaaaggggtttgtgtcttatgggtaagatactattgaaagtccccctttcatggagcccacttgagtgagccacactgtctggattaatcctggctccaccattcactagctgtttattgtggtaaggcacttaaactctctgtgcctctatttcctcatttgtaacaggaagatagcaagagtacttaccacgtagggttgttaaatgagttgatatctatgtctatatatgtatctctagctagctagcttagaacagtgcctggcatatgcaaagtactatgtaaatgtttcctattcttattatctactgagtagactacagctcatgcatctatacagctgggtttcagagagcaaatatgacccccaagtgagcccaaaggagctcagtattacccagtcagaaatttagggagttaggggtttcttatcaaggtaccttctaggctgttctgatgttggccacacctaggaccagattaagacctttagaggttctaaatactggtttactgatggccaaattctgaaataattaaatctatgtttttctcatttgatggtggtcctgcttcactggtgccctaagctcatgctcatccatctattggataatcctgtactggccacgccagcctgtatgctcctccctatgctctggagggaaccaatgactaagaggggtctacacattcacaaagaacagttttgaacccaagctgctccatccacagcggggtgccccgtgtcccagcttctgagagcttaacctgccaagcctcgtgacctccttgccggttgggacctcccatcctgttacttggaaggatggtttatcttctggggccaggggaagagaaggacaaatgcctggaagtccaaataaggccccctgcaggaagctctaaacattagcaagttaaagttctagtgacaagttcagatgactgagcatggtcatgatacggaagaggaatgtgtgaggctcttttgcctccacatgacgaggagatcaagctccttccctgaaccctaacttgttcaaggacttcagttcagtgttcccggaaaacttggagtcactatcagtatcttcattaccctacacatcttggccaggttctaaccatccaaatggtgaacagcacagttttatgttccaagagccagtgttttttgccttaccctagatattttgcctatggaaaaactagccaaaagcaaggtttccttagatctggccaaacagctgcagggacctggtggcctggataacggaggtcagcaggactccagacaggtttatttgctgccttcctcacagaatatctcaaacatggaaagctcaggtgaaaccggtcagaccagatgttgagaaactgcagcttttaggaagagaagacagatagatccacaggcagcaagaagagagaatagggaggtaaaaaacctattgttccagctcctaatcacaggacccccaccctcatcacacacctatgggctccagcatatcacttgctcaagaaggcaatggctcatctgtgtcccatgagtggatctgcttattatctccacgtaagaccacccaacctaaaggctactttccaggccatagctcaacagagactaacatttgccttgaggctctctttttaaaaatggaatctgtttttagcactaaaggaaaagatagccttggagtgggaagtcacaaagaagaccccaaagttcaactctcctttgcctcacttttccacatgctttgtagtatagggtaaggcacaggatcttataacagacagaccagtgttagagtcctggatttgccatttacctgatctgcaatcttgaccaagtctgagcttcactccctatctgtaaaaaaggggcagtgggagcatcataatccctacctcacagtcttacgataaggttcaaatgaaaagatggatgtgaaagccctttgaaaacagctttgcattatcatcatgattaccacatacataagtttatctatagacttgcacatgtgcttatgcacgtatagccagattgatataccacccatgatgcacacgtgtataagcaaccacttatatgtacaaaactacacatacatctgatcttaagcctgaactcatgacacagacaattaaaagtgcatacacatacacatttatccacatggatatactttctccttctctcacacacgtacacccacacaagcaaatgtatatgtatctctgtaagtgtgtgcatgcatatgtgtgtacatctatagcctcatagctgtacaggtgagcataccatacccttcagtttctgcctagataatccagttttccgggggtctgacaaaggccctgtttgtaaattcctccacttgatactgataatgtcccttttgcccttgctgaggcttcttctctgtctccaccttgtttgcagagtagcacagctgctgcaaaaattcaagctgcagtatgtgacatacacatgtctggagaacatggatccttgtccagttgctctttgaatagcactacgactctagcctgcacagcatatttatagccatgtttgcaaagagctgacagcattttcagacttttttcaaaacgtagttaatccagccacaaaaatagtcactggcccatatgccccaaagctaaaagaaattgggcagcgtgcctaatgaaaattagtcacagagcctaaatgaagttgaagttgaatcaaactctctctctccctctcattctctctctctctctggcttgctcaactctttctttctttctttctttctttctttttctttctttctttctttcttccttccttcctttctctctctctctctttctttctttctttcttctctctttctctctcccttccttcctccctcccttccttccttccttcctttcttcctttctttcttttttttttgagacagggcctcactctgttgcccaggctggagtgcagaggtgtgatcatggttcactgcagccttgatcacctgggctcaggtgattcttccacctcagcctccttgtgtagctgggactacagacatgcaccaccaggcccggctaattttttttttttttttttgtagagatgaggtctcactggtctcaaactcttaggctcaagtgatcctcctgcctcaacctcccaaagtgttgggattacaggtgtcacccaccacacccagcctcactcttgcgctttctctctctctcttttcccttcctgccctctctttgccactgctttttattctaaggatctctaagcctagggtatgtgtggtgggggagtggggggtggtaccatgaagtatatttgcttcaaagaggtcctggggtcattagagcctaaggttttggagagacagggaggaggaagagggaaagaagagggaaaagtgagggtattgaggtttataagcaagaggaacatagttggggaattaaatgaggtgagacaaaaaggagaaaagttacgcccactttgaggccaactagaattttggtggctggataacttctcaaatcaaatggcagagtccttcagcctcccctcaatcactagaatgtaggctagaaaattgttttgcttatttgcaaggttggaacaaaaaagaattcctagtgatagagttgaagagttaagcatggttagaggagagcaagatggtttctcaggaagagagaggcctgggctttatgtaatgggctcatcttaggtggcccagccatgaccagggtgaggagggttttagagagggagtagggttatcatatcatttattgtccaaattgggacacttttgagggtgaaagagaactctattaacatttttgttggaaccacaggcataaactagaattgtcccaggaaaaccaagatgtgtgttcattgtaagtttagaacaaatcgctccagcttgccgggaaagggcaaactataagggctcctcacaagatgtctttaaaaaaggtgtgtatgtgttctgttttgtttgtgtgtgtgtatgtgtgtgtgtgttggtttgggcagtagagagtagggcagggagattattcagccttttcagccttgggactggagattgtttactctgaatataaattcctttttttttttttttttttttgctgctgtacataaatatgtaatggagctcttagccaagcgtgtttatttcctggtcaacttcagaagagaagagagagagagtcaattgtggtgtgtggttttgtgtattgtgtgtatgtgtttgtgtcaaagctgtggaaagtatgtatgtgtgtgagtggaattttaagtatatccaactgtgtgtaactatgggcatgcatgtaggtgtggatgtgtgtggacgtgaacacggatgtggtaagaataaatgagggtgtgtgtgtgtgtgtgtgtgcacgcgcatgcatgagcatggatagggtagagtcaggtctgacctctggttcactgagttgtgaactccttaactttcaaggagcaatcacatagacgaccactttattttacacgtgaggaaaaaggcatgtgtaacgagacctacacactttgttttttgtgagagggagtctgtctctgtcgcccaggctggagtgcagtggcgccatctcggctcactgcaagctccgcctcctggatttttttttttttagacggagtctgtctctgtcgcccaggctagagtgcagtgacacgatctcggctcacggcaagctccgcctccccggttcacgccattctcctgcctcagcctcccgaatagctgggattacaggcgtccaccaccatgcccagctaatttttgtatttttagtagagacggggtttcaccatgttggccaggctggtctcgaactcctgacctcaaggtaatccacctgccttggcctcccaaagtgctgggaatacaggcatgagccaccgcaccaggcagagacctacacacttttacaatttgcttggcagtgattgagagtatactagcagcagtcacaataatcctgattgggaaccagctgctaatccatgcattggaataaaagcccagtatttatttaaggtttctgcaaacaatgggtgcttgtcaaggtgggttgagggagctgcctaagagtaagcttgaggtgtctgtaggcctagacttgagcagaaggagatttgacaaatggctgatccaccagacctgtctccctgaaggaccatgtccaacagtggaaactttccagggctttgaatatgttcaacttcccacctctccaaccccaccacctagagatgtggtttgccttggagacaaaccttgatctctattagagatccactagaggccttcacaggatgtaggccagacataagctgaaagtgtccccagactgggcaataagagacaggaaagcctccccctcacccccagtctctgaccttcctgtacctgcccttatcacttcaggttctggggcaggggaaatggctagagatgccccaggagtgtcaggactggctgttgaaatgggaatttgcagccgggtgccatggcttatgcctgtaatctcagcactttgggaggccgaggcgggtggatcacctgaggttgggagttgaagaccagcctgaccaacatggaggaaccccgtctctactagaaacacaaaattagccagacgtggtggcgcattcctgtaatcccagctactcgggaggctgaggcaggagaatcgcttgaacccaggaggcagaggttgccgtgagccgagatcacgccattgcactccagcctgagcaacaagactgaaactccgtctcaaaaaaaaaaaaaaaaaaaaagaaatgggaatttgtgcccccaggagaagggtgggtgtcagccattagtctcattagcgttggccgaggaattggtcatgcaagttagggtagcccattgctaatgaagctaaaatccaaaaccactgttcttttctcatctgaacaaattcatcttgcttgaacctctgtttgggctgtacccatttgtctgaccagtcacacaaaagatgagacaaaagagtgtgggatgctgcagcatagctctgagaaaacagtccaggtctcatgtcctagtgataaaccagttcaggttcagccaatatttattgagcatttactatgtacctaacatgatgttagacttttacaagtattaattatttcattgaatccttacaatagccctgtgaagtaggattagtcccattaagaccctccaagaggtccaggcgcagtggctcacgcctgtaatcccagcactttgggaggccaaggcgggtggatcatgaggtcgggaatttaagaccagcctggccaatatggtgaaagcccatctctactaaaaatacaaaaaaattagccaggcctggtggcacacgcatgtagtcccagctattcgggaggctgaggcaggagaatcacttgaacccaggaggcggaggttgcagtgagccgagattgtgccactgcactccatcctgggcaatagagggagacttcgtccaaaaaaaatgacactccaagaggtgaagtggcttgctcaaagtaaaacagctaggagtggggaagtgagaattcagtcttaactctgcttgacaaaaagaaattattgagaacctactgcatgctagacattatgctaaaatgtttccatgggttatctcacttaggcctcaaaatagctttatgaggggatattcctcccttttttttcacacattagagtattgaggaacagaaatgttaagtgactcatccaaggtcaagtgctagtattcacagtagatccaggattcaactacagacctgtgactctcaagccgagggtcatctcttccctgctcctctgtggatatctgattccatatctagatgattcctaaggccccttccagctttgacattccagaggtcagcaactctatggtaatccttccccatgaactcgagcagcctcgggtcccttggctgtaatctgccattctctcctccccactaggctctctccatgtgtggtgcagaaaaagagtgggtgagtgacccccagtcagctcgggctgagttggcccggggctctgactcagctgcctcactcctggctccaggtctcaggtgaggtactttctgtaacagtatccagaaggtgctctgggttctaggcctgggccctgtaactctccgcctcctgagaaaaacaggaaatatctctttaaattggcaaataagaaattcctgcaaaatgggctcagggaagccactccattccttgtgtgattgtgcctgtgtttgtgtgcgtccttctctgagtgcatgatacagctaggaggagttgcagacagaggctaaccttgattctgcattgtccacagccttcctgggtgggctgagatgaatatttccttccctgcccgccccatcataccttttcctcttggaagctgctgatggattttctatccccttctgcatcttgagcagaagaggaaggcagtttggctcacagagtaatattatccacagtctggtaccaggtgtgtatgtgtgtgcatgtgtgtctgggggcaggggcaggaggaggtggtggtattaggctggctccagcagagcactgctcagggtctggaataagctaagttgcttgtggaggcaacatctgagggaaaggagtttccctgggagacccctgagtagcacttagaaaattaatatggggaaggggctgtggttcagatacaaaaaccactcattcttcatcttctcttatcctcatgctctctgtattccctctccatactgcctccctcttcaatcctggctgtcctggcaccatatcctgcccctgactcctctacccttgttatttgttacaggggaaggagcatgccacaaggaatccgaaagcttgggttctaccactatctgcaaattttaccaatatctccctccctcttcaatcctggctgtcctggcaccatattctgcccctgactcatttacccttgttatttgttacaggggaagcagcatgccacaaggaatccgaaagcttgggttctaccactatctgcaaattttaccactatctccctccctccctgactttgggaaaggtgctttactgccctgaacctcagttccctcatttgtaaagaccagcctgttttttaaagtttgacacagggttaaatgggaaaaatatatggaaaaaacatctaggagatttctgttgcttgttttgaagatcaaatgagagaatgacctggaaatacttggcgagccctaaagtactgttcaaaaaggaggagttgttattgttaatattccctgctgcctgactgcccttccatatacacaataatgcaaatttgcccagcctagcttatatcctgtccacctccactgtttgctgtaaagacgaggtgatcatctgcttctgtaatgtctatgtccatgacagggaatcacacaggattctcacagggtcctctttcctcttccatggacaaatgtagctgggcttttctgcacagaaagaccttgtcatcacacccacaggagcggtgacaacctcaaatcaatgcaaaccataagagagatctatttgggaagttgcagcttgtctctggatattattattagcccattattgcagataaggaaattgagacgcagagaagtgaagtaaagggcacataaataataagtggcaagttctaagttgcgtgtgtgtgtgtgtgcttgcacatgtgtgcatgcattgaggtgggtaggaagtttttctggaagcatatgagaggcaagggatctggattcgctattaagataaccatcagtctccacgaatcaaataaaaccaggcagcaagcctaataaaaattaagcaatggatcaaaaagatactgactgtgcactacctttctgcctccttctctattcggcttgtgttcctgcaagaagacttatttcatttcactatatatagcacattttgctagatgctatgataggagagggtcaaggggagatagagaacgatgtctcatgtctgtatgtcttatgtctgtatgagcagacatacatacactcatgccatacttgaatcaaggtagaccatgacagatctaccttgattataaaccactatatctctccttatgaagcattatactcaattgttagctcttactgttagagctaacaattgagtataatgcttcataaggagagacatagtgattctagcacctaacacaatgcactatacatagtcagtgcttgataactttgtattgaaatgaaatgagggccaggagtgggagaacatgagcttgttttggggaaggcattgtgggcaagaggggccaagtggttcatgcctctcactccaggcatgctgggcaaagccaggatccactgctgacttctcaggccttatttgcaaggctgctttaaaggtgctttgtgtttgggtttgttttctgacatcattgttcttagcaaccaaggtcagatttttagcttttcctttgactgctaaccatgcccctctgcctaagaaatcccacaggaagcctccaagcttcactttgcctctagacacctggcaaatgactctcccacttccttgccctgtccacagactctgatgctagttgcgggtgccaagatttttttgccccctcctcttcccctgggaccaatcagatttctgagctccagggtagagccacactctcactgatcctctgtccaagtctagaattcccaaagcatggtctgcctcatctgtgctccaggtgcaactgggcaggataaatttctcacacattggtcctgtccttccctgggaagcctggctttcccactcccacttacctaagtcaattctctgctttaaggctgggcgcggttgctcacatgtgtaatcctaggactttgggaagctgagggttgagcccagtagtttgagaccagcctgggcaacatggcgaaaccccatctctgcaaaaaaatacaaaaattagccaggtgtggtggcacacgcctgtagttccacctacttaggaggctgaggtggaaagatctcttgagctgggagattgaggctgcagtgagccatgatcataccactgcactctagcctgggtgacagagtaagaccctgtttcaaaacaaacaaacaaacaaacaaacaaaacaaccaaacaaacaaaccaaaattctctgctttattccccttcatgagaaaagctggcaaggtgaacagactcctctcttgctagcccactgccatctttggataggtcaggcagatagaatcctgagttccagtagattctgccacataattatccagggttcaataatttaagcttacctacctcttatgcaaagaccagagtactgatgaggtaaacttgcagcagaagaaaattaagccaaaagaaagaacttctcaacttaggattctaaagcactgtgacagatacagttctccctaagcctttaggttcaacctcctgcctccagccatgccagacagatgaaggtctctattttcttactgtgggaagttcagattttggcctaaggcctgggtgaaggtgaggatgacagaatgacggagttacttgtttgcaacagagaatgcattcctccccaccctgtcctgccccaacatgtaattgaatatctttccttttgccacccctcaataggcttttgcccttctcttcctaaataaggttattaagttattgacttattcaaataaaagtttgtccaatattcaagagacattaagtatgttctttgggtctgaacacatggtcaatttcaatctttgtgagttttcacagaggcccactaactccctgtgtgaaaaaagtacccagacgtaagtcatatgaagggagttgcatgataaaaagctttctgggggcctggtgtagtggttcatacccgtaatcccaacactttgggaggctgaggtgggaggatcacttgaggccaggagttcaagaccagcctggacaatatagcgagaccctgtctctacaaaaaaatttaaaaagtagccaggcatggtggctcgcacactgtagtcctagctactcaggaggctggggtgagaggatcacttgagcccaggaattcaaggttgtagtgagctatgaactcaccactgcactccagcctgggcaacagagtgagaacctgtttctatgtatttaaaaaaaaaaaaaggccgagcacagtggctcatgcctgcaatcccagcactctggaaagctgaggcgggtggatttcttgaggccagaagttcaagaacaccctagtcaacagtcaacatgacaaaaccccgtctctactaaaaatgcaaaaattagccagacatgatggtgcatgcctgtaattccagctacttagaaggctgaggtgggagaatcacttgaacctgggaggcggaggttgcagtgagctgagatccctccactgcactccagcctgggcgacagagtgagactctgtctcaaacaagcaaacaaaaacacaaaaaaaccttttggacagtgacagtgacattgttatgataaagtacttggtccaaacctgccatacagggctagaaagttctcagcagtcatccatcccaacggttcccaaccctagctgactatcaaaatcatgtaaggagtatgttgaacatataccttccctggggctcatgaaacctactgaatcagaatttctgaggtaaggccccaaagtctgtattttaaacaatcttatcaggtgattctcataataggacaggtttgggaactatttgtctggttgaatcctttggatttttttttttttttttttttttttggatgaggaaaccaggctcagaggggcaggagcctacagcaaagtggccagatgggaaagtaagggcagagcatgtctgccttgcttctcatcatctcctctttgcatagaacacctaatattatgttctctcaccctttctgatcaattacttgtccttccatgtctctagaactgtgagtactttgatggtaggaccatgtcagatccatctctgaggtctccaagtccttgagcttgatccttaaagctaggctcccaacttactaggcaggtatacattcttagaccctatgcctctgtttccagggaccatgggttggggcaggagttggtgtcccccttccttcaaaaagcaaggcaggctgcaaagtttgaagtatgtgaaatatggaggccagttcttgtgccgagggagctggaatgtccagtggcaccaggttacctgaagcttgggctggggctgagtgttgatctcaggggaatttgggcgtcattcccattactatcactgacagcagccttacgtgcagcgataatgacatgctttgaaaaatgcctcaaatgtcagttacccagcattgagacagcccctgagagttgttccttcatgcccgcatctttagctgtgcttatcactctcatagcactgtgtttcaccctgcccaattgtgcagggctgtctggggccttggtcttctgttcttggagccaggataggaagtagaataaaaagatggctgtggaaggcaaggcaggactaaccattcagtagtttgcatttttgtgcgttaagatgagctcgtgccaaactggggagggaagtatgaatgaagcacagactgtcattagacctgggttctaaccttaccactgtcatgttcatttgctgtgtgactgtggactaggcccttactcctctaagcctccatttctgcacctgtgcaatgagtagcttggactcacaacctttctgttctaattgagtgatgctaatttaagagccaagctggagggtcaggggtgggtatctaatgagtgatgctcattccctgccttcattcatcgcatatcttgagtccactcttggaaaacatatgttgttagccccaaaggctcaagatataacctccaaagtaacttgcataatatatttgcaccctgctgtgttggctttgtgctgataacatctcaacacagcctggatccactgtactctggttatgtcaacttctcaaaggcagtcagatgcaattgaagactgcttttcccactggatgtgggtgcctgacaatgtaactaactctgtttttcagggtctcctccctggtcctctcttgttcagctctgcagcatctgtgcgacttctcagtgcattgactcctttagccacacacccctctaagtaggttacctgctggcactggctcagtgccaacaggctgtggtttctctaactgtaaaggccttgattcatcctggttgtgaggaactcttttaagtttggcagctgttttactctgggaatttctcctctgcctaacccttctcccatcaacaagcttccttcacttcttccctcccacctccctcaaaatcccctatggataatgggatgatctttgtcttgcaacagggcactatagacgaccaggatggtccatccttcctccaccactagtgacagcaacaaggctagcttggggaattttagcatcgctcaaagccatgactaataaatagataatttaagcaaaactcatgcacttgctatgctagcaagcatcaaggcaagtcctttagtcacctccttccaaccaaattgctttccctaagccctttctattgagaaattatggaccctccacccccattatatgccccagggcctagcacaagggctggctggcacataatagatgctcaataaatatttgttgaatgaataatggccgaacagatgaagactaaacatacctaaaagctaaaggaaataatgctagctgagtcaggagacctggatcagccactaatccatcttgtgaccttgagcatgttcctctctttgggtctaagtctcttcctctgtagaattttgcactgaactcagtgatcttttaggggtcttccatttctgggagttcataattctgtgatccgtactcttgtaccaaataccacttgccgccaccacccctgctctgccccgccccacccaaagaagtaaaagaaacttccatctagtcatcagatagtattgggatcatgctgatagggaaaagaatataacttggggttttggaccaagccaatatcagagaagccactgcttcccattatgccaatggggattgctgattaggtctcactcctatgacacaaaggcacaacattcaaggtcctccgctccttgcctcctctgccttgtctttgatgtcccatgagaagtatgttgaccagacaatatccccttggctctggtagtggttggagtcagtaagctgttggagatctgggagtcctggtcattgcagaacaaaattcttgtccactgttataagcacataggtcttgattttaaaagtcttatgcagccataaaaatatacacagaccaacctgcctgggattaaagggaactaggcagaaaaccagaaaaggtagagtctctcttagtgggcctttccctttttgtctctctgaattgggtttccatggggatctgtgggtaaaacacatgaactttaaacactttttaaaaaaacttaaaatgacatttaagagacctccaatattggaaatcttttattctctgattcaaaatatgtaaccagtagaaaggtggtttgtttcgtatgtgttcttttagtgtgatgagtcaggctgaagctgggattgggcaatgactatgtgagtatgtggtgaatttcagaggggaagtgctgtttgaggaaaggcaaagcatatttatcagacaaagaatgtatgaagcctaaagcatgtgtttaatactttgagaagctggttactcatacctccctcctccttgacacatacagttaggctccatgatcaaacatcagatttaggctagacaatctttgaggtttgttccagttctgatgttttttctctgactgtgtgagattattcagacttgcaagtgcacttttccaatgaatcccctgtggttactttcaatgttttattccaggcaaggaacaaatgactgtaaagtggctaaacctcagtaggcttggccataaagtgacacggaaaattgatagttagtgatgggccatgaactatgaagtagggtgaaccctttggatcctcaggacccaatagctcaaaaatagatcaagaaggaagtgtgtacatgagggaaaattgcttatagtgatgtgcctatttgcattgaaatgtcatcccttggggggtccccccacctgtcatgggacaaatgtcttatagaagaatgtgacagcaaatgtgccacactgatcagatgcttttggcatacttgaaccttcctggtgttataaataggagggaatgagcctggacttaaatatgtcatgctgtcagaaacagaagggatgtgctaccattaataaggggcttagaggatcctatagttaagagccaaagaagccctctatttcgagaagggaaaagttcaatgactgtccgctatcagagcacaatacgagctaaattactagcagtaggttggtccttgacccctttggatcatagggaaatgatgataatagagttggcaagcccccaaggcgccctccagactggacatgcatggaggctgggtcagccagtttccaccacacttccaattgccagtgtactctcttccttggagcattaccaccacactctcagcagggtggatttgggaagtggcctggaatatggcaggccttccctctcatcctgctgggaatagtcttgtccgttcccgttctaggaaagagaagcagagagatgccaaaggctcaggtacctgttgaatcagagagtgagcagtgagcaacacagaagggtgaaggcctagagcatgtggggacctcaaaggttatctagtaaaatgttttccaaaatgtccattataacccatgaaattaatttagaaggtcacaataagcattttaaaaataatatgcactagaaaatttcagagtttgtcacgcagagtagggataattagttttgtgaaatttgcttgaggtatatataaagattatatatatagttttaaatatatatcagttatatatgtgtacattttacatcacgacacatatgtgatgtatacatatacattattgcatatatagctatacacagatatataaatatacacaggtcgtccttcactgacggtcactgacatagtttcaattgtcctcagcctacagttcactctcctctggacacagtcaagttggttctaaagtatggagccccagaacctcagcagcccttcaaggtatagcctactcagagcagaggaaaacatgactatctcctcatttgttctgaccaagtacattttgaacaattcagttcaagatttccaataaggtagaatctcacaacttggtactcattgaacttacagttgcctaaaactcctaggtatctctcacacatgtcactgctaagccctagctcccttactcccttatcctactgctgtgcaggttgcttttttttttttttagacagggtctcgctctgccacccaggctggagtgcagtggtacgatcttggctcacttccgcctcctgggttcaagctattctcccgcctcagcctcccgagtagctgggattacaggtgccacgcctggctaatttttaaatttttggtagagacggggtgtcgctatgttgaccaggctggtctcgaattcctgacctcaagtgatccacccacctcagcctcccaaagtgctgagattacgggcgtgagccaacatgcctggcagcaggttgctttttaatcctagtacagaaactgtcatttatctttgttagagtttacctttcaccttgactcacctttttaaaatgcatttacacatcccatccatgaccatctctatgcatatttaaatctggtttcattggctcagagggagctgcatttaaaccccacgtagctctctctcagaaggtcatatttattttttttcagactgttcctttaaaaaaactgttattttttatttatttatttatttagaaatagggtctcactatgtttcccatcttggagtgcagtggctattcataggcacaatcccattattgattagcatgggagttttgacctgctccatttctgacctgggcatgttcaccccaccttagacaacccagtggttccccactcctgggaggtcaccataatgattccaaacttagtgcagacacccagtcggcacgaggtgatcttctcgtgcttcccaagtaactgggaccacacgcgtgtgccactgtgcctggcttttaactatttttttattgatacataataattgtacatacttatggggtacttgtgatattttgatatatgcatacaatgtgtaatgatcaaatcagggtaattaggtatccatcacctcaaacatttatcatttcttcctgttggggacagaccattcctttcattgctcatctattatttttctgactaccatgatgcccctattctagccaagccagtgtcctcactgttttctttcctgtactcgagacataattctaccactgggcagactgtaaactagttcaaccattgtggaagtcagtgtggcaattcctcagggatcgagaactagaaataccatttgaccccaccatcccattactgggtatatacccaaaggattataaaacatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagcaaactatcgcaaggacaaaaaaccaaacatggcatgttctcactcataggtgggaattgaacaatgagaacacatggacacaggaaggggaacatcacacaccagggcctgttgtggggtgcggggaggggggagggatagcattaggagatatacctaatgttaaatgacgagttaatgggtgcagcacaccaacatggcacatgtatacatatatgacaaacctgcacgttgtgcacatgtaccctaaaacttaaaataaaaaaaaaaattctaccgctgggcttttgactacactaagccttcacttatgataccctctttgccataatgtctttcatggcccaacttaagtcattatatcctccatgattctttattcagtagctctagatcatattgatctatcctctgaatttgtaaatttcaactgtatttcttgtgtattgcttcacatttagttttgtataagtgtatgtattcttataaaaaatacatataaatgtcttattatctgcattgttggtgcatggctgactcacacaagtgggcactctaaagccagaatgcctgggttcaaattcagatgtacaattctataatttagtagttgcatgtacttgtgcaaattacttaatctctgtatgtctcagtttcttcaaaatcaggataacatagtatgtgttgcataggtttgcttagtgtttaaatgaattgatatatctgaagtacttgaaacagtccctgacacatataaacactcaataaatattaactataattatgattaaatactatacgctttcatatattttatctcggggaaagttagagcagggattgtcatccctgttttatggatgagtaactaaagtttgaaaggttaagtgacagtgtaagattatataagtgagctgtctcagggtcattaggggattaactataaagtagaaaatactaaaggccataagagagggaagcaaaagacccttaggaatttagaagctcttctggctggggtgggtaggaaaggcttgctgatgtccatgaagaagcaatgaagaatgtgcaggatagggtcagccttggtaagtgtccatccagccattttaggcagagagggctcaagtggagtaaggggtagtggaggaggtagggtgtggctcctcctacattttgcttccggtatagagggcatggtcagaggccagaggagaaaaaaatctgaagaggagacatctgggcatggcagccatgtggggagcagtcagtagtagttctgtggtatgtgcaggagtatagtgtgtgggagagagaggagagcctgcagtggcaagacaaggctttggacctgtgttccaaaatacctattcacaaagtccatgaatatttggctactgctctgggcccttagaatccttgattgattagctcaggcaactttatcagattaaccagctgacctctttgaatggcacccactgttcactcagttgtgttaggctgtggggaactgaagagaaggaagaagcaaggtctctttcccaaggaagtcccagtctaggtaattgactatagttgattacgtgtgagttatggttgttgcacgaataaattattatttcatggattgtgttctaattcataagtagggctatcagggagagacaagaagtagataaagaaactgccaggtggcaggagggcactggctggggaaaagaaagtgcagagaagggaggctaagagttggattgaaggtgggagaagacattttgcttccttgcgattgggcagctagccattcttaaagtccagtgtgtgggccaagattcttggccaggcccgagcttggaaaatggtgaattgaaatatgagtttccatgtacctttctaccttagttccctgggtcttcatctgcccaggggagataaaaagaatgaataagagagcagttgaggtgatttcaactccatgggatgctgctacagacacacttgagctgtcattattatgggatgggaaaactggatgtaaattaagattattatcacctgtgcaacgacaacaacaacaacaacaaccactactactactactaagaataataataaactcatgtgatgctgccagcattctaaagagcctacctttgggtactgcccctgcttcatgggctcaaaattgaggagaaactgaagactgtttgcatgcctttcaatcttggatctgcatagacaattccttaggaccagcccttgctagtgagctgggttagaaatgctctttgcactcccctgctagccaagccttgtctgtgcaaagccaccgggtcccttctgtccggtaaatttctagaatgttaaagtacttggaaggacccttacaggccatcaagtctgactcctttgttatactgatagagacatgagggttcagagagaaacagggacgtgactagggtcacacagtaatgcagtggcagaaatggccctaatccagctggccctcccagctgataggccagtgtgcactttccatagtatccatctctctctacttcctatccttctatctccaccaatttcagtcacttgagttgttactggtatttctcagccccagtagcccatcaaaatcctctggggagcttaaaaaaatactgatgtcctggccccaccccagaccaaccgaatcgttgtctctgaggaatggagtgattttttttattatactttaagttctagggtacatgtgcacaatgtgcaggtttgttacatatgtatacatgtccatcaatgatggagtgatatttttaaaagctctctaggtgattctaatgtacagtcaagatcaaggatcactgctcaggagaaaattagcctcatgtctatgaggagacctaaaggacagactcccagtgaagcagacttcccagcctccattgactttgggccactctgcacctcagtaggtccccaaaccctggtatgtggaggacgtaggattctgaaagtatgaatttcagggtcaccaatgctgtccttgagctccattgaccctcttgtcattgcctttcccctcatgctagatcagaagtattttatttccagactttttactttttctttacccatcacgaaggcctctgaggagactgcctgcctccagtaggcacaaacaatttgtcccagcttctgactttttggggagacacacacacacaaggaatgtctcttctttggctccttccgaggggcttgtactgagtatctagaaccacccgccagcctccattccatctacttgccattcccacacatagagcttgcttcccaagaaccagactttgagggacagccagcacaaagcagagagaagggaggcactgggcaccgggacccctaatgctgttcagcattttgcctcttgtcttgctggctatgggcccatagttaatttataaacttgacttgcccagggataagtaagtacagatgtgtatctttttccacaccaccagtggtctttcttttttcagaaaataggattcactgaaatattccacaaaactaaacattagtgatactaaagaaacaaaacatcctcttcaacacattacataaacctgccctcaaataatcaggctagaagggattatcaataatgtttggcaatatatagtcactttgcttttttaagtggcctccccctcatcctagctttattggagcataattgacaattaaaattgtatatatttaagttatacaatgtgatgattttatatacatatacagtctgaaatttaccacaaccaagttaattaacacatccatcacctcaaatagttagtattgttttggtgtggcgtaaacacttaagatttactttttctttttgagtcagagtttcgctcttgttgcccaggctggagtgcaatggcgtgatctcagttcactgcaacctccacctccttggttcaagcgattctcctgcctcagcctcccgagtacctgggattacaggcatgcaccaccacacctggctaattttgtatttttagtagagacggggtttctccatgttggtcaggctggtcttgaactcccgacctcaggtgatccacccgcctctgcctcccaaagtgctgggattacaggcatgagccaccgtgcctggcaagatttacacttaacaaatttcaagtacataatatactgctattaactacagtcaccatgctgtacattagatctccagaacttgtttcataactgaaattttgtaccctttatccaatatttccccattccccacaaccaccagccttcagtaaccaccattctaaactctgcttctatgagttcaactttgttagattttacacataagtgagatcatacagtatttgtggtcgtttgatgccctcccttggtaagatttttaatcttccctctacctctttccatctatgactcagtgttcaggaatttgcttgttaaatctcctggattggtgttgtgtgggctttaaaatgtaaaatcaaagttagagcaataaagaaatccctttgggccagtgttgtgaaagaataacttattctattcagtgcagtgggtggtggatggactagagtgcccagaaagcccagctggatccccttaagccagttatagacctctgctctggcgtttacctgtaactgagccatgactccgatcttgatcaaccatgttatttagcagggtgtggtggtcctcagcatatatatatatatatctcacaagtgttcactgcctcctatcaaggctagaaggtgagcggtatcctgggaagaagaggctgaggccagtgcccccccaggggctggagttgagttgaagtcatggctgtcagcagatagaaatgtcaactagtggtggcctccagtggaaacatcttgcagggagagactgtaccccagccagtccctggagttttggaagacaaaacactcactgaaggacagagtttgagttccccctccccactggggctctgccacttagaactgtgtgactgtgggcaagtggcttagatacattctgttttctcagtcatcaagcaggtatacttaatacctatcagtgcagttgtgtgtagtaatgcaggttaagtatataaaggggaggtgctcaagaaatgttagtttcccaacctttccctctcctatcctagtcccaatagtcacacccactgttggaagaaaacaattgcatctgacactctctccaactcctacctcacctccttggccattctccagactcgggtgattaagaagatagaaaagataaggaatgtctggagcacataagggtccatacattcagggtaactgcaagggcttctggagtataatgactttggtcaacaactagcatgggtggcatgagcatgttagcccataacagaacaagtactgggatgtcagggccgtggaaggaaagagccaagactcaaggtggtctgacttcaatgcatcaagcagaggcttgctggtccctgtcctcttctgttctgctttttaaagactaaaggtccctgtgggtatggagaaagcagctgcatctgagaaaataagtaatacagtagaagctaaagatggagttctgtggcacccatgagaatgttcctggaagacttccaactacggggagcataattgaccaagggtcttggctgctgcactctgaaatcgtcccagcatttgtgctgaggtcacacctgctacatggccaagatactaaggtgggcctgttcttgggagacacagaaatcctctgattgccaactgaccaccaactgaccttggtttcatgaatccatgatggtgttgccaaaccttccttagagtgcagggcagactaggaagcttccacccaaccttccctcatcctctctttcactcagggtcagacttacattgcagtctcacgtcttccctagctttctcagacttcctccctatctgctgtcatttctcttaataaatccctgcatatgcaatcccattttattgcctacttctctgaggtcccagactaacacaaattctgaccaacatgaaatcaaatgtattggcctagagcctggcctgtacccagggtctagccttgggccacttttagaaaacattcagcaggttttttgtttgttttttgagacggagtcttgctctgtcgcccaggctggagtgcagtggtgcgatctcggctcactgcaagctccacctcccaggttcatgccattctcctgcctcagcctcctgagtagctgggactacaggcgcccaccaccaagcccagctagttcttttgtatttttagtagaaatggggtttcaccgtgttagccaggatggtcttgatctcctgacctcgtgatccacctgcctcggcctcccaaagtgctaggattacaggtgtgagccactgtgcccggccaacattcagcaggtttctaaacattggagaagtatccctaaagtttgaaaagacttcgggagtgatataaatttattgccctgctttactctgaatgaatatctcagacaaataagtttcttttatttaatgttccaactcagtgtcttatatgccttcttatggaagatgtttctttaatctaactatagtatttcccaggaagctctcattttctcctgtcctccattttggactgagagtcagagaaatctagctccaggtttgccagtgacaaacagtgtcatattggacaagtccttgtactctctgtaaccttctctttctgaacctcagctcttattttttgtgactaccactttttctgtttcctcagttccattcctcagaaccagtgttcaagttctcctaaaagatattggtgtgttagaaaaggagagaaagggagagagagagagtgtgtgtgtgtgtgtgtgtgtgcacgcgtgcatgtgtgtctgtctgtgaaaaagagggaaagagggagagggagaggaagaattggagagaaggagagaagcagagggagagagagggtgaaagaaagacatctctgtgcagcttatttccagctctgcttggcggttccctcacacgcagtgctaggcaacacacatggtgacctacttttgcaagaaggctctattttggagttacagtcttctttaccttcctcctttgcctgggatggctctgccactaaacagcagatacagatgtaaggaacagaggattggtggctctggtatcattaccaaattttaaaaattgtaaggatgaaaggcattccagctcttagctttgtgttaccagaaaccactccagagatttgaaactgaatcacttacaactcctcctaggaggaattcaggcttaatcccatctccatccccatctagagaggccaggatgctttgtcccaagcccctgaatccctcaaatctgaccctgtcccctgctgtggccaccactctctcctatttcattggagtgtctcctcctgagcctttcagcccagtccaggccagctccttaatagctgccccttcccgtgaactccctcttcctgcctcctcttccctccagtggcagaaaccccacctctgttggcccagtgtctttgaagagagtcctgagatgcccctcggagtttgggtagagcccttgcaggcatccagagaacaactggaatcaaggccctttgtgctttctggttcccaagcgcctttggggcttgaggttctcttcattagtggtggatctgaagtgtttgtttctcgagtagcctgactgctagtgtttcacccagagtttttggttatagtttggtgtttgtttgtttgtttttgagatggagtctcgccctgtcacccaggctggagtgcaatggcatgatcatgtctcactgcaacctccacctcctggattcaaatgattctcctgcctcagcctcccgagtagctgggattacaggcacctgccaccatgcccagctaatttttgtattttcagtagagacggggtttcaacatgttggccgggctggtcttaaactcctgacctcgtgatccgcccatctcagcctcccaaagtgctgggattacaggcgtgagccactgcacccggcaggtttggtgttcttaacccagcatctcacaacttctgtactgagccttctatggatctttgaaaaatgggcttctccagaaggtagggggaactttcacagccctgggagaccatgaccaaagggaaacatgactgaatgggacagaggagtaattgtgcttaggactagtttagcagaaattcattagggggctcaagacatctgtgaaaaaactgaagcaaaatcccataaaaatagaaggccttcagaaacactgcccacagactcaacaaagggatctggcctgagaagcccaaaacacttgggccaccaacttctgcttctttcttgtgagaccacatgcaggtctcttcatctctttgtggctcaatttacccacttataaaatgagggacctggactctatcttttaggatagtgaaaaagtagctagcctgggaaagaagagatatacacaactctagagattcttcagatttttccagggactactgcagagggagaggatggatggggacaaaagaaatgagaaaaaaaaaatcggtggagtttccagtaggctgacaagtgcctccatcacatcagagcattcctgcttttatattatttatgcaatgtacttcagtgtaaaattgcaattggaaaggaaagggggttccatggatttaggaaggttttaactttctaacttctagctgcaagtgagtctgaaaaagtaagaatgtagtttttatagcttttgtaatgatggtagaaacagagaagagggttgaaaataagaatattgagttagttcaacagcatccactatgattaatattttttgctctaaatttgattactttttagagcttattaatgcataactgatgtacaataaactgcacatatttaaagtacattatttggtcaattttttttttttgagatggagtctcactttgtcacccaggctggagtgcagtggcacgatctcggctcactgcaaactcctcctcccgggttcatgccattctcctgcctcagcctcccgagtagctgggactacaggcgcctgccaccatacccggctaatttttttgtatttttagtagagacagggtttcaccgtattagccaggatggtgttgatctcctgacctcgtgatccacccgcctctgtgtcccagagtgctgggattacaggcgtgagccaccgtgcccggcctatttggtcaattttgacaaatgtgtacattcatgaaatcattgcagtaatctagataatgagcatgtacatcatcctcaaaagtttcttcatgccctgttttagttcatccctccctccaccaccatcgtctggcaactactgctctgctttctgtaactatagattaattggcatttttagaattatttatatgtggaattatacagtatttactctttttgtctagagatttttcacttagcataattattttgagattcagaataaggtgtgtatcaatattttattcctttgtattgctaaatagtattacattgtgttgataacacagtttgtcatatctaattacctgttgatgggcagttgggttgtttacagtttggggctgtcaaataaagctgttctgaacatttatgtacaagttgtttacaagtacttttaaaatttaactaatgacttccattttcaaaatgtttccagcagaaactgacttgggaaatgttgcatttgtgtgtctctttgtactcaagctattttttggcagtttttgttgttgttgatattttatatcctttgatgttattacacattgttgatcctacagttgcacctccccaagcattgtgaataggtttctgaaagcctttgtaggaagaatttcagttgaataatttaagacttgtataaggagttttcttgagggggactgagaggcaaaagcccttgtaaatattttatatttactaaaacaaaccactaaatataataccaaataaagatggtattaatttccttttaaacccactggcctagacaaaggctagagtcttcacccagctaggggagactggaagtccataagtgggcaagagacacaaccctaaaatattcagtttcagacctaggctaggtgcagtggctcatgcctgtaatcccagcactttgggaggaggctgagcggggaggatcacttgaggccaggaatttgagaccagtgtgggcaacatagcaagatctcatctctacaaaacaacaacaacaaaaaacttgaggccaggagtttgagaccagcctgggcaacatagcaagatcccatctcaataacagcaacaacaacaacaacaacaacaaacagacctattgctcctccatggagccagggaacatggcaacacagaggactcccatctccagtactaggccagcctatggccagcaaacagctgttgtttcaggaaaggggttcagagagaaattgcatggtgtgaaaaactgttaatgaaacaggatatgagatccatctcatgtcttccttccagtactccccaaggaaatggccatacttgtatttcactcttattttattttacatttccttaataaaattttaaaaggtttcatgaggctatatggaaacgaaggatgactcttcaggccatgaggagagtgtggcatgagattttgccgcagtatggaaaggagaagcctggaatggggaaccaagcacaaaaactttgtcctgggagttcctgcaggtgtccttgagaatgaactatggcagagaaaggcaggggcagaacccttcagagagcattgactcatcagctgctacaacctgatgagccgatcaggttcttgctgctcttgcccacccttcagactctttccctgagcctcaaagccagcttgaacaatatttcactcttctaggctgcctggggagttgggagtggtgctcagcccattttgtgggggttggagactgtttgtgcaccagggcagtccccactagaaggcaggaaagagctggagagggttggagagattcccagtaagaagcatgctgcaattttctttcacaaccaacccccatattggggtgacaattccagggaaatgggatgcattgttctctacttgctgctagcctctgggccatgaacaaagtagtaaattggccctgtgagggaggggacagaagggggaggtggtggaggatatggggaccagaagcccctggggctgactgatctgcttacaaacatcagaacttcccctccgtgaccctcccagcccccagggaatgagaactgttttgctctcctagatcagaaagaacaagatgtccttatctggtgggagagggctggtcaataccacctccaaggagagaagagaaaggacccaagagaactgcaagcccagcaggaagcatcattcttggggaaagcctagaaagaagcaggcaggctccatcccaggcccacagggtttcaggagtccggatgggcggtggattcagactccatactctcccaccagtgcttcaaagccctggtgcttgtggctggtgttaattttttacttttattgtctttatgagctttttctaaacctggcttctaaaaagctatgaaagccaaacagcttttcaggctacagcattctccaccccctttcctgactccctacttaccattcctctgacctttcttgagcacctactttactgtgggagaacagccatccctcagtatatgtgggagattagttccaggaccccttgcagacaccaaaatccacagatgctcatgtctcatgtcctttacaaaaattagtgtagtatttgcatataacctatatacatcctctcataaactttaggtcactctagattacttatgatacctaatacaatgtaaatgctatgcaaatagttgttatactatattgtttaaggagtaatgacaaaaaaagtctgtacatgtttagcacagacacagtcatccattttttttcaaacattttcgatctgctgttggttgaacccactgatgcagaacccactgataaggaggcaaaagattctgtgtagggtctgctgcaaacccatgcttcttccagggctctcagtctctgttactttcctcaccaaaaagttgcccttttgtgtatggtaaaaacaacgttgtccttccctgaattaatttaccaaccttggtctagaagcccatgtctttgtcacaatactcaatatttagtgatgtggccctagagaggttttagactttcagtcaaggttctgatatttttggtctgattctgccaacccagatcattttatggccacagaaccaaatggagctagatgctttcctggcacaattggtgagttttgttcaattcaacaaacctttcttgagcaccatgtcaccatatgcccagatagctctctgccagagagagaggtataaagccctttaagggcccgcccctcccctccatcttcctgcctttttctaccttgctgcacttcttctgcccatacaggctcagctccatctagagaaagctaagctggaaagtggtaaggggccttagatataatcttttcagaacccctcatgatatagacagagaaagcaagacccagaagagtaagaaacttgacctaggctacacagcagattagcagtagggtttggagttggggtctaaggctaagggggggcttctaaaacaaagagaatatcccaggttagtatgtgcattggggtggatgtgggaacatgtgaaaagccggtcaagaccaataacctagactttgtggccacatctaggattggtttgaaggttaccttgtaggcccctagcactcccgcccaaagtatgtctcagaaacagaaatggcacctctgggtaattcttttggagcttgaaggctgtgcacatttaattttccaaaaataaaatcctagtataggcaaagccttgtaggaacaaagccctgagggaggcagctcagaaaagacaattaagaaaaccccagagagcctttgtaactacatagtacaaaaaattctaccagtttaaaaaagatattcttgcctccttccatatattccacagactgattgttgtcaggcatgctccatgacatagaaatctgactttgtcagtccccctcccagaaaccactcatgaatcacatagtcctggtgagattagatccaaactcctggccatgccattcaagttcctgggcaactttcccaggatcatcttttcccacccaactcttacctaaaccacccacacataccttcttcattcacaccatatcattcacatttcaagcctccaaaccactgttcatgctgttccatcagcttgagatacctttctctactttttgattattagattatccttcagggctcaactcaaagatcaccctctattctgttaaacttttaaaaaaatagctttattgagacaaaatttatttgccacacaattaacccaactaaagtacacaattcaatggtttttagtaaattcacagaattgtgtaaccattaccacgatcaattttagaacattgtcatcacctggaaagaaacatgtacgctttaggcatccctaccaccaaaatctccccatcaccccctcgcagaccttggcaaatactaatccactttctgtttctataaatgtgtatgctctagacatttcatattagtggaattatataatatatggtcttttgactggcttttcttcacttagcataatgttttcaaggttcttctatatcatagcatgtattagcaacaaatttctttttatggctgaataatagccattgtatggataaactgtaccacattttgtttatgcacttacaaattcatggacatttcagttgtttctactttttggctattatgagtaatgctgctatgagaagtccagtacaagtttttaaattagatgtacatttttatttgtcttggttatatacctaacagcagaattgttggatgatatggtacaattttaaaaaaatatttaatttaatttttatgtgtacataatagttgcactatttatggggtacatgtgatattttgacataagcatacaatcttataatgatcaaatcaaggtaactgggatatccatcaccttaaacatttatcatttctttatgttaagaacattctatttccattcttctagttatttggaaatacacaattttttgtaactataggcaccctattgtgctaccaaaaactagatcttattccttctatctaactatatttttgtaaccattagccaacccttctttatcccccactccccattacccttcccagcctctggtaaccatcattctaccctttaccttcatgagaccaatcaacctttttagctcctatatatgaataagaacatgcaacatttctgtgcttggcttattacacttaatataatgactttcagttctactcacgttgttgcaagtgacaggatttcattcttttttatgcctgaataatattccattgagtatatgttatcacatttcctttatccattcacctgttgatgggtacttaggttgattccatgtcttagctattgcatatagtgctgcaacaaacatgggagtgcagatatctcttggatatactgagttttcttcttttggatatatacccagcagtgggaatgctggatcatatggtggtaacttgatgtttaatattttaaggaactgccaaaatgttttccaaaacagctaacccattttacattcctacaaacaacacatgaagatttcaatttctgtacatcctcaccaacacttattttttgtattttttttatagctattctagtggttgtgaagtggtatctccttttggtttttatttgcagttccttgacgactaaagatattaggtatcttttcatgtgttcattggccatttgtatatcttctttaaagaaatgtctattgaaactcttggcctgctttttgtttttaaagacgattttagggcagttttagatttgtagcaaagttgagcagaaagtgcagacatttcccatataccccctaccccccagcatgcacagcacctccactattaactccttcaccagaatagtacttttattataattgatgaacctacattgacacatcattattacccaaagttcataatttacattaggttcactcttggtgtacattctataagttttgtcaaatacataataacatgtgtctaccattatagtatcatacagaatagttccactgctctaaaaattccctgtgctttacctattcatctcaccatccccctggcaaccactgatccttttactgtctccatagttttgctttttccagaatatcatctgattggaatcacacagtatggagccttttcagattggtgtctttcacttaataatatgcacttaagattcctccatgtgttttcatggcctgatagccaatttcttttgagtgctgaacaatactccactgtccagatgtaccagagcttatccattcacctaccgaaggaaatcttggttgcttccaagttttggcaattatgaataaaactgctataaacaataatgtgcagggtttttttgtgtgtggacataggtttttgacccacttgggtaaataccaaggagcacaattgctggattgtaccataagagcatgtttagttttataagaaactgccagactgtcctccaaagtgggtgtaccattttgcattcccaccagcactaaatgagagttcctgttgcttcacatcatcaccagcatttggtgttgtcagtgttttggattttggttattctaataggtgtgtagtggtatctcattgtttccatctgcaattccctcatgacatatgatattgagcatcttttcatatgcacattcaccatacatatatattttctggtgaggtgttcatttagatttgcctttaaaaatatcaagttatgccaggcgcggtggctaacacctgtaatcccagcactttgggaggccgaggcgggcagatcaggagatcgagatcatcctggctaacacagtgaaaccccgtctctactaaaaatacaaaaaattagccgggtgtggtggcggctacctgtagtcccagctactagggaggctgaggtaggagaatggcgtgaacccaggaggcggagcttgcagtgagccaagatggcgccactgcactccagcctgggctacagagcgagactccgtctcaaaaaaaaaaaatcaagttatttattttctttttgttgaattttaagagttctttgtatatattattaacaattctttatcagatatgtcatttgcaagtattttctcccaatcttctcattcacttgatagtgtctttcacagagcagagattcttaattttaattaagtccagtttacaaattatatcttttatggattgtgcctttgttgttatacataaacaattaccacccaaggtcattgaaatttgcttttatattatcttctaggaattttagagttttgcattttacatttaggtctatgattagttttgtgtgaatttttgtgaagggtgtaagctctgtgttgttactgttattttaggattaggaatgaaagacagttattataatcctgggacctcatttctctgatggctctaagaacagtggtttatttttcagtttgtttagctttttatttgttgttaggacagagtgataacttccaagctctttacatgccagactggaaaacctttgcccatttgtcaatgttatttgtctttttattgttgaattattaaagttttaaatatatattctggatactcaacccttatcagataaatgatttgaaaatattttctctcattctgtgtgttatcttttcactatcttactggtgccccttgaagcacaagtttttcattgttttattgtggtgaaatatacagaacataaaatttataattttaaccattttaagtgtacatttcagtggcactaagtacatttatgttcttgtgcaactatcaccaccatccatctccagtactttttcatcttcccaaactgaaactctgtgtctattaaacattttctcttcttctcagtccttggcaaccaccattctactttctgtccctaaggatttgatgactctaggtacatcaagtaaatggaatcacacagtatttacttgtctttttgtaactggcttatttcacttagcataatgtcttccaggttcacctatgttgtagcatgtgtcagaatttccttcctttttaagggtgaataatatttcattgtatatacacacatacatacatacatgcatatacatatacattttgtttatccaatcatccatcaatggacatttgggttgttcccaccttttggctattgtgaatgatgcttctctgaactttaggggacaaatatctgtttgagtccctgatttcaattattttgggtatatacccagaaatatgtttttaatttttatgaactccaatttatctagtgtttttttgttgcttgtgcttttaaaattatttctaaaaactattgcctattctatttacttctatgctttcttctaagacttctatatttttaattcttatatgtaggtatgtacttcattttgagctaatttctatatatggtgtcatgtaggaattcagcttcattcttttgtatgtgaatatctagttgactcatcaccatttgctgaaaagactattttatctatattgaattatcttggcaaccttgctattaatcaattcacaggaaatataaaggggtttttaaatggactctcaattttgtttcattaatctgtacgttcattcttatgcaagtaccacacggtttttattactgtacctttgtagtagatgtgaaattaggaagtgtgaatctcccaactttgttgttcatttttcttctttcttctttttttttaaaaagacatttattcagcatcataatcagactattacatttagcaatcaacagcatgggtgcaaaaaaaaaaaacaacctacattaaaacccttcgttggaatgctttacactttccacagaacagaagctaaaataatccgttatacaattagtcacaaatacagtcctcgagtttttttcccatacatatgagtatttgtctaaaacatgtctgctttgtagcagctaggccctgccaccactgtgctttgctaaattcacaaatctgttgtaacctgtagcttccctgccacttctctggctctccgctcctgctaaggtttgtttcctaattaaaatcttctgccactgccacagctactgctactactggaaccatcatagccaccttggttttgtggtttggcaaagaattggcctccaccaccataggggccagagcttctgactccaaagtttcatgggtccataatttgaagactgattgttgtaactgccaaaatcattgtagcttccaccacctccaaaattgcttccatcattaccaaatccattatagccatccccaccgccaccataaccaccaccaccatgactgccaccaaagccaccatgacaactgaagcttcctccacgaccaccacctccatgaccatgatcaaagtttccagaaccacttccacctctggctggatgaggcaatggccaactcttgctttgacagggctttcctaacttcacagttgtggtcattcacactatggtatttctgaatgacagtcttatccatggagtcatggttgtcaaaggttacaaaggcaaaatcccttttcttaccactgcctcagtcggtcatgatttcaattacttcaatttttccatactattcaaaataatctcttagttgatgttcttcagtgtcttctttaatgccaccaacaaatatctttttcaaagttaagtgggcacctggtctttgagaatcttctcttgagacagctctctttggttccacaactcttccatccaccttgtgtggccttgcattcatggctgcatccatctcccccacggtgtcatatgtgacaaatccaaagcccctggagggcttggtgtttggatcactcattaccacacagtctgtgagcattccccattgtttaaaatgactcaaccattttgagccattttcaggttgtttcaaagctcaacccttcaatgaagagcttcctcagctgttcgggccctttaggagatgctgacttagacacgatggcagagtgaagacagactttaatgacgcttcctcagcagtgtccatgggcagaaagctgttgttcatttttcaagattctttttgctattctagttctcttgcattttcatacacatcttaggatcagtttgtcaatttctgcaaagaaaatgcagccagggtttttatagggatattgttgaatctgtaggtaaatttacagagattgccatcttaataatattaagtgttctgatccatgaaaatggaatgtttccaattatttagatatttttaatttcctccgacaatattttgtagctttcagagtataagttttatactccttttgttaaatttattcctaagtagtatatactttttgatgcttttgtaaatggaattgttttaattttatttgaagattgtttattgctagtatatagaaatgtaattcatctttgtatattgattttctatcttgtaacattgctaaactaagttattagttctagcaggtttttttgcagattccttagtgtttttttttttttattatactttaagttttagggtacatgtgcacaacgtgcaggtttgttacatatatatatgtgtgccatgttggtgtgctgcacccattaactcgtcatttaacattaggtatatctcctaatgctatccttcccccctcctcccaccccacaacaggccctggtgtgtgatgttccccttcctgtgtccatgtgttctcattgttcaattcccacctacgagtgagaacatgccgtgtttggttttttgtccttgcgatagtttgctgagaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaccatacgtgtgcatgtgtctttatagcagcatgatttataatcctttgggtatatacccagtaatgggatggctgggtcaaatggtatttctggttctagatccctgaggaatcgccacactgacttccacaatagttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccgcttgttgatggagttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctaggatttttatggttttaggtctaacatttaaatctttaatccatcttgaattaattttagtataaggtgtaaggaagggatccagtttcagctttccacatatggctaggcagttttcccagcaccatttattaaatagggaatcctttccccattgcttgtttttctcaggtttgtcaaagatcaggtagttgtagatatgtggcattatttctgaggcctctgctctgtaccattggtctatatctctgttttggtaccagtaccatgctgttttggttactgtagccctgtagtatagtttgaagtcaggtagcgtgatgcctccagctttgctcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctctttcatttcatcaagcagtggtttgtagttctccttgaagaggtccttcacatcccttgtaagttggattcctaggtattttattctctttgaagcaattgtgaatgggagttcactcctgatttggctttctgtctgttattggtgtataagaatgcttgtgatttttgtacattgattttgtatcctgagactttgctgaagttgcttatgagcttaaggagattttggtctgagacaatgggattttctagatacacaatcatgtcatctgcaaacagggacagtttgacttcctcttttcctaactgaataccctttatttttttctcctgcctgatagccctggccagaacttccaacactatgttgaatagcagtggtgagagagggcatccctgtcttgtgccagttttcaaagggaatgcttccagtttttgtccattcagtatgatattggctgtgggtttgtcataaatagctcttattattttgagatacatcccatcaatacctaatttcttgagagtttttagcatgaagggctgttgaattttgtcaaaggccttttctgcatctaatgagataatcatgtggtttttgtcattggttctgtttatatgctggattacgtttattgatttttgtatgttgaaccagccttgcatcccagggatgaagcccacttgatcatgatggataagctttttgatgtgctgctggatttggtttgccagtattttattgaggatttttgcatcgatgttcatcaaggatattggtctaaaattctctttttttgttgtgtctctgccaggctttggtatcagaatgatgctggcctcataaaatgagttcgggaggattccctctttttctattgattggaatagtttcagaaggaatggtaccagctcctccttgtacctctggtagaattcggctgtgaatccatctggtcttggacttttttttggttggtaagctattaattattgcctcattttcagagcctgttattggtctattcagatattccagttcttcctggtttagtcttgggagggtgtatgtgtcaaagaatttacccatttcttctagattttctagtttatctgtgtagaggtgtttatagtattctctgatggtagtttgtatttctgtgggatcggtggtgatatcccctttatcatttttttattgcatctatttgattcttctctcttttcttctttattagtctagctagcggtctatccattttgttgatcttttcaaaaaaccagctcctggattcattgatttttttaaggggtttttgtgtctctatctccttcagttctgctctgatcttagttatatcttgccttctgctagcttttgaatgtgtttgctcttgcttctctagttcttttaattgtgattttagggtgtcaatttgagatctttcctgctttctcttgtgggcagttagtgctataaatttccctctacacactgctttaaatgtttcccagagattctggtatgttgtatctttgttctcattggtttccaagaacatctttatttctgccttcatttcgttatgtacccagtagtcattcaggagcaggttgttcagtttccatgtagttgagtggttttgagtgagtttctcagtcctgagttctagtttgattgcactgtggtctgagaggcagtttgttatagttacaatttctgttcttttacatttgctgaggagtgctttacttcaaagtatgtggtcaattttggaataggtgtggtgtggtgctgaaaagaacgcatattctgttgatttgggttggagagttctgtagatgtctattaggtctgcttggtgcagagctgagatcagttcctggatatcctcattaactttctgtctcattgatctatctaaggttgacagtggggtgttaaagtctccccttgttattgtgtgggagtctaagtctctttgtaggtctctaaggacttgctttatgaatctgggtgctcctgtattgggtgcatatatatttaggatagttagctcttcttgttgaattgatgcctttaccattatgtaatggccttctttgtctcttttgatctttgttggtttaaagtctgttttatcagagaccaggattgcaacccctgccttttttttgttttccatttgcttggtagatcttcctccatccctttattttgagtctatgtgtgtctctgcacatgagatgggtttcctgaatacagcacactgatgactctttatccaatttgccagtctatgccttttaattgggagcatttagcccatttgcatttaaagttaatattgttatgtgtaaatctgatcctgtcattatgatgttagctggttattttgcttgttagttgatgcagtttcttcctagcctcgatggtctttacaatttggcatgtttttgcagtggctggtaccggtcgttcctttccatgttgagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggtccccaactctcctctggcttgtagagtttctgccgatagatctgctgttagtctgatgggcttctctttgtgggtaacccgacctttctctctggctgcccttaacattttttccttcatttcaactttggtgaatctgacaattatgtgtcttggagttgctcttctcgaggagtatctttgtggcgttctctgtatttcctgaatgtgaatgttggcctgccttgctagattcaggaagttctcctggataatatccggcagagtgttttccaacttggttccattctccccgtcactttcaggtacaccaatcagatgtagatttggtcttttcacatagtcccatatttcttggaggctttgttcatttctttttattcttttttctctaaacttttcttctcgcttcatttcattcatttgatcttccatcactgataccctttcttccagttgatcgaattggctactgaggcttgtgcattcatcatgtagttctcatgccatggttttcagctccatcaggtcctttaaggacttctcagcattggttattctagttagcctttcatctaatcttttttcaaggtttttaacttctttgccatgggtttgaacttcctcctttagctcggagtagtttgatcttctgaaggcttcttctctcaactcgtcaaagtcattctccctccagctttgttccattgctggtgaggaggtgcattccttcggaggaagagaggcgctctgatttttagaattttcagtttttctgctctgttttttccccatgtttgtggttttatctacctttggtctttgatgatggtgatgtacagatggggttttggtgtggatgtcctttctgtttgttagttttccttctaacagtcaggaccctcagctgcaggtgggttggagtttgccggaggtccactccagaccctgtttgcctgggtatcagcagcagaggctgcagaacaatggatattggtgaacagcaaatgttgctgcctgatcgttcctctggaagttttgtctcagaagagtacccagccgtgtgagttgtcagtctacccctactgggggttgcctcctagttaggctacttgggcatcagggacccccctgaggatgcagtctgtccattctcagatctcaagctgcatgctgggagaaccactactctcttcaaagctgtcagatagggacatttaagtctgcaggatttctgctgccttttgtttggctatgccctgcccccagaggtggagtctacagaggcaggcaggcctccttgagctgcagtgggctccacccagtttgagcttcctggccgctttgtttacctactcaagcctcagcaatgttgggcgtccctcccacagcctcactgctgccttgcagttcaatctcagactgctgtgctagcaatgaatgaggctccatgggcctaggaccctcccagccatgcacgggatataatctcctggtgtgctgtttgctaaggccattggaaaagtgcagtattagggtgttagtgacccgattttccaggtgccatccgttacccctttccttggctgggaaaggaaattccctgaccccttgcacttcttgcatgaggcaaagcctcgcccggctttggctcaggctcagtgcactgcacccactgtcctgcacccactgtctgacaatccccagtgagatgcacccagtacctcagttggaaatgcagaaatcattaatcttctacatcactcacactgggagctgtagactggagttgttcctattcatccatcttggctccaccctcaagaaaaagtcagtattttctatataaaagatcatgtcatctacaaatagaggtagttttattttttccttttccaatctggatgccttttatttccttttcttgtctaaatgtcctggctgaaacctcaagtacaatgctgaataatagatatgacagcaaacattcttgtcttgttgtttatcttacaggggaagcagtctttcagcaataagtatattagccttgggattttcatagatgaccattatcatgttgaaaaaattcccttttattcctagtttgttgaatgtttttattgtgaaagaatgttatattttatcaaatgctttctctgcatctctcgaaataatcatgtgatcttctttgtcttttattctattgagatagcgtattacattggttgattatcaaatgttaactcaattttacattcctgggataaaccccatttggtcatgatttataattttttctatatgtaactggagttaatttgctagattttgtcaatgattttatttttgcatcaattctcttaaaagatattggtctgtagtattcttttcttgtgatatctttggctgacttcacagaatgagttgggaaatatttcctcctgttctagaagattttgtgaaggattggtattaattattttctaaatattcggtaaaattcaccagtgaagacatttgagttgggggtatatttagggggagcagagcattttaattactaattctatctttttacttgttacagttaaattcagattttctgtttcttgcatagattttggtcgtttctgtctttatagaaatttttccctttcatttaagtaatttaatttaatagcatacaactgttcatagtatttctttatgttccttgtatttctgtaagattaatactgatgtctcctctttattcttaattttactgatttgcatcttctctttatttttctcatgaagtctaattaaacgtttgccagttctgtggatcttttcacaaaaccaacttatgatttcatgtgattttctcctttgttttttactctattttatttgttcctgttaagtttttattattgccttccttctgcttgctttgggtttagtctgctattctttttctagtttctttagttggaatattaggttattgatttgagatgtttttaaatttttttattgagataaaattcatagaccataaaattcaccctttaaaagtgtacaattcagtgttttaaatgtattttcaatgtcttgcaaccattaccatgatctaattccacaacatttcaaaaccaccaaaataaaccctgtaaccaatagcagtttctcccttagtgccctaggccctagctcctaatgaccaataatctactctctgtatctctgaattttcctattctggatatttcatatacaagatttttggttgacagttttttcctttcatcattttgaatatgtcattcctctatgtcttttagcttctattctttctggtagaagtcagccataaatcttattggaattcctcttatatgtgataactaattttctcttgctacttttaaagtttcccttggtttttggcttctgacattttgatgtggtgtgtctgaagtgtctctccttgtgtttatcctatttgttatttgtagagcttcttagaggtgtagattaatatatctttcttcaaattttgaaagtttttcttatttttgaatattttcttctgtttatttctcgctctcttctctttgggaatcccattgcatgtatattggtgtgcttaataatgccccacatttctctgagtctctgttcattattcatcattctgtgtcctcaatcttcttcaatttgcacaatatgtattgatctatcttcaagtttgctaactttatttcctgccacctgaagtctactgttgatctcttctatgaatttttttgttccagttattgtatttttcaacactagacattcttagtttagatctctttattgattttctatttgatggaaagaatttctcacaaattcttttagttgttttttttttcttagacagggtctctctaggtcacccagggtggagtgcagttgtacagtcttggcttgctgcagccttgacttcctgggctcaactgattctcccatctcagcctcccaagtagctgggaccacagccatctgccaccacaaacagctattttcagctaattttgtttattttttgtagagatgggcactgtgttgcccaggctggtcttaaactcctggactcaagtgatcctcttgctttggcctctgaaaagtgctgggattacagacatgagccaccctgactgactcttttagttctttaagcatagcttcctttaggtctttgaacatatttatagtagctgctttgtcctctaagttcaacatctggcctagttcaatgaagcctatttccctgcagcatacagcctctgtgtcactcctcagaggtcacagtcttgggcatgtacacagtatctaccaccagtgatactgtgattttaactgggctgtctgtctccttacctaagatcctctttgagcttctggatgatctatctctaataatatcactaccagctattagcctccacttcttaattccattagtgtttttaaacaatgccctgggaaataaatttttccacattaaaattgggtcttctcaagtcttcaaggcttgcccagaccctaaaagggttcttcttagctttttctctggttctctctgttaaacttctagctggtgaaccattctgcagctgctactagaatcatagtgcttctggtgccctcttgattgcttaccaccaagattgtcgttgttcctgacaatactatagacaaaaacttcttcactctcttttccaaataaagatagactccttggggagagccaaggagctctccattcttaaaactcatctcacctcatggacagaatctctgctctactacactagacattagaggtagggagagaagcttctttcttccagaatgacacccctgctctatgagcagggtgctgggcaggaatggtagctatggattttctcaacttgtttttttctagcattgaacatgcaccctatgagtgagctggggcagagtgatcagagatacagtattattggcccaccatgcttgaggtagagattccattttaccaatgggagctgactaggggaagggcttcccagtcctcttggcctcacttaagtggaataaaacttctgcaacatggagcttgggattagaggatgagagattccagtagactaccctcctagagtcaaactgttgccctgtactaggagctggaggaagagagagctccatgttattgactacacccaactagaatagaatttccatcatactaaactgggaggtagggatgtgttgatgaaaagagtcaaactctgtaaaatatttgaagatatttattctgagccaaatatgagtgaccacggcccatgacacagccctcagaaggtcttgagaacatgtgcccaagatggtgaaagtgcagtttagtttcattcattttagaggggcatgagctatcaatcaaatacatttaggatatacattggtttggttcagaaaggcaaaacaacttgaagttggggcttccaggctataggtaaattttttaatttcctggttgacaattggttgagtttgtttaagaacctgggatcaatagaaaggaaatgtttgggttaagataaaggattgtggagaccaaagttttattgtgcggaggaagcttttagctagcaggcttcagagagaataggttgtaaaatgtttcttatcggacttgaagtctgtgttgatgttaataacagagaggtataatgaggcatattcaactcccatttcccatcatggcctgaaacagtctctcaggttaaattttaagagtcctggctgaggaggaagtccattcagatggttggggagccttataattttacttttggtttacattttcccctttttggccaagatttggcacaggaaacattaaaagccagcaaatctttattttgtcccatagcgttgtcagggtggcaaggctgcctgcaccaggtccattctgtcccttggtggggctctttatggcccagggccttaagagtcaaaagacttaacagctgattaattgctctaggccagataggaatggatgtggacaggcatttattacctcttaaaattcttattttggccgggtgcagtggctcacgcctataatcccagcactttgggaggccgaggagagcagatcacctgaggtcgggagttcgagaccagcctgaccaacatggagaaacctcgtctctactaaaaatacaaaactatccgggcgtgggggctcatgcctgtaatcccagctactcggggggcttaggcaggagaatcacttgaacctgggaggcggaggttgcagtgagttgagatcgcaccattgcactccagcctgagcaacaagagcaaaatgccatctcaaaaaaaaaaaaaaaaaattaaggaaaaagccaacaaacaaaaaaaggcaaagttacaaaactgacttatttttaacttctatgtgttgagctacagtaagcttggttttagttacagacttttagccattcgctaaagaaaacataagcatttttctagaaaaacttaaatatatatagatatctttatatatatatatatctttgcaacttataactgggagtattatactcagaaggccttgtcacaaggtatctttattctaatgttaccaggggatctttgctcttagagctcccaagatggtggaaggctgctcccaagatggggcggccactcccaaatggcgcggccactcccaagatggcagcaagccttttgttctctgacctggggttcttggcctcatggattccaaggaatggaaccttgggccatgcggtgagtgttatagctctattagaagccatgggtcacagaagagaaccgtggaacccagcgactagtgttcagcttgattaggatgaacccgagcacttagccatgcaggaacaatggcgagcctctagcctgatcgggagcagcaatgggtgcctggctggatcaggagcacagtggacaccctgccggatccggaggggtggaagtcagaagtgggtctgggatggtggcaaacagcagtggtggacagcgagtgaaagctcagctcgagccgtaacaaacacggaccagaagcgtgtgcagttgcaagatttaatagagtgaaaacagagctcccatgcaatgggaggggacccaaagggggttgcccactcccagctcgaatgcctggggtttatatcccaatcattgtccctccccctgtgctctcagatgatagattatttgactatttctttacctcctgcttttagcctaattggtattttagtgagccctctttactacctgattggtcaggtgtgaactgcgttccaagccccttgtttaaaggtgggtgcggtcaccttccccagctaggcttaggaattcttagtgagcctaggaaatccagctagtcctgtctctcactgtcagtaaatatttttctttaattctataggaagcagaaaattatttatggttgggatggatgcaaaagtgacacataatagtttagaagacttgttttatcagctgtttaggcatccttgtatcctcttgatttggacaatctgaccttgacctaattttgtccctcaaaactggcccttaaaatttcatgtgctcatcatcactggccatcagagaaatgcaaatcaaagccacaatgagataccatctcacaccagttagaatggcgatcattaaaatgtcaggaaacaacaggtgactttggagaggatgtggagaaataggaacacttttacactgttggtgggactgtaaactagttcaaccattgtggaagacagtgtggcgattcctcaaggatctagaactagaaataccatttgacccagccaccccattactgggtatatacccaaaagattacaaatcatgctgctataaagacacatgcacatgtatgtttattgcagcactattcacaatagcaaagacttggaaccaacccaaatgtccattaatgatagactggattaagaaaacgtggcacatatacaccatggaatactacgcagccgtaaaaaaggatgagttcatgtcctttgtagggacatggatgaagctggaaaccatcattctgagcaaactatcgaaaggattataaatcatgctactacgttacataaagcttgtttaaacatcttaaattttataattctattaacctgtaggtttttatgttctggtcgcaggaactttatttatttatttattttttacccttagatcattttaccttttttggtgaaaaaggatttgggttcccagcagagagttgcattcgtgagacccattgagggacaacaaattctataaggcttctcaaacagttctatgattctgtgggaggggcacccatgtaaaaaggggtcccttaaccctcaaatttaacatgacctgggtaataggcctattcgttgggggatatcccagtcattataaagctagttccacatggctcccatatgaaacatattaactgcttcatctggggtgctctacttggtgttttatagggagagctgggtagtcccctttacagggcaaacagacttacagtggcatttatctggcccactacgctgatcattctctcagaaataaccccctgtgcatttggatcacatatacttatcagtgattgtttaatagtgagttgtgggtcctgcattaacccaaacaagctcttaatttctgcagcatttaaaattaaggattttgtccttaaagtgtttatttttacaatccactaaagatttttttaaagaagtggatgataccaatttacaaaatggaacaatccctttacattatactctccggttttaaaagttacttggttttgcccttcctccacatcaacttgttggtagccacaggtctcagagttaacttttgttgccctggcataattgttggtttttttttccatttagttttatctgtatactttttccttcattttaaagcaactcttaaatagtttagaaataaacacaattttttaagaaaaatcaacatccttgtgttttataaacttcaccaaaaacatattttatgcatttactattttagcttgtagtaaccaaaattcccagtaaaaattctcagttatgttttaacataacattactttaagattttaaattactggagagagttgagattaaatttaccaaattaattttaccaaagattaccaaagtcatgtgaattaaaaggtatctgagctagcctctaccagtctaataaatatgtactttcaaaaaaattacttgattagagctcctccatgtagtttggtagtgaaatgtcacttccatatgacacatataaagatagagatataacaggcatgcagaataaaaaagcaggtccaaaatatatttttacctgttttttaaaaaattatctcccttactttaggtaattaataaaagttataggagtcaagaaaaggtgaaggagagagctattatccaaggcctttttaaaagagaaagaattgaacctttgagatgtttatctgaagaatttttaacagacagattatataaaaatttattgcattaagaataagtcaatattttaaacaaaatcttgttttaaccaattatttagttttgtattagtgtatatatttttaataacaaagactcatctctagaaagactattataattttttcttaatcatagtcaactaaattatacaacccttttttttaaacaaaattcctttttactaacattattacgacttgcatagactattcacaacatgtttggattttctgttttgtcctaaatatctctctttcttgaacaacccagtcattttattttaggacaaaaattcaccacacaagattctttcttatataaaattactttcatttttaccttctttactgaaaaatacctctttatatcattaactttctttccatctgttattttctggttccttttaccttgttttatacataacccttaaataaacttagaattagatgaagatatttaccttttaataagaacactttaaaaaaagttttactatagttttaaaattggaaattacccagatacttaatatttattaataaccttagatcctaaattatatgacaagtttgtttacaagcatttctttcattatatttacctgattgattgatttaattgtttacctagattatatacaaaaactgtgatagtcattccttaagttacttcccggttaaccattttgatagccgtgaatttcaggtgttagtcattctttaagttacttccctgttaaccattttgatggctttgaatttcaggtgtttccttaagtaacaaacttagggttaaatataagggtattttttaccaagaactcaggatttagctgttttcattaaaccagcaatattccatcttacttatcaaaaattatacaagcaaagatcattctgcctttggctgggttttatagttttataacccttatgactaatcttgtattctggaggaataagcatgaaagcacttgatcaataaacacaaacaaaaatgctaataattcttaaaacatttctaatattattttaccaataattttaaagccagcttatttattaaagattttactcaagtgatgtgaacttcaaaaagcatttgactagtctttttttgataaaatattttatttaagcacttgtttttctttaagccaattaattagagctcttttatatatttttagtagtgaaacattgtgtacacaacacataaatacatagatgtattaggcatgccgatagaagtacatcttatagattcataagacctcattgtttcctaacttagacttttaaattcttgataacctgtttcatcaacctagacagttgtcagctaaatagccctacatttgcctattaaaggaaacaactcttaggtgaaaaatcagcaaaatttacatctcaaggtaccaagagagaaagtctggtgtgctagagggaaattaaaacagatttaatttgccaattaaacatgaaattatagaagtctattataaaggtcacacacatacacacacacacacacacacacacacacacacacacacgcaaagatcctatggcttttacttcagaactttagccatgagataaatacaaattcactggcttgcaaaaaaaaaaatagttagatccaagtagtggttgttatctcagtagaaaggtaacagcagatttaaagcaggcagaaaagaaaatagagaaaaagagaacttaggaactttagagtttgcaggttgaccttggggttctttttccttaacgtaaatgtgaaaaatgaccatactattttcattttacataaactttagcaagtagaggtgccataaaaccaatggagtgccccaaagggggtaattctccttgttttctcctcattcttagattatttgtttcccacacttaaaaaaaaaaaaaaggaggaactgagctgtggcctggggcttttgtggagtgggttgaagtgggttgcttgcaggcaggacttcacagtgtgtcaccactgagtcattgtgccctcttacttatctcagttttcctctctggaggtctaagcccctccaggagggctcaaatcgtggagtgaccagctcctatatgtgtttcctgaataagccttttttaaaactaatttttttgggggttccctgtagggccactgcacatcatggggggttaacctccaccagacactcccatgaggcccttggtcacgcaggggcacgttttgcctgggagaagcaaatgtgttttctcttcagagctaaggaaacacagtttctcatttacctataaaaacaacagtataatttatcatgcaaatgcacacagacaagccaaactgagattaattttgggagaaaatgcaatggagaggattctttaaaatgcacgtctgaactagaagtaggatctttaaacaacttcctaggagaaaaataaaatagctcagaataaatcaaggaccattaaccaacgggagggccaaggctcgggaggacttaccagttccaccagaggagaagctcgaagtcaggaaggcttcaatgggcctctgctccttagctctgagtttgggcaacttccttcatggtcctgagtcttctctgaggtcccacgttgggtgcaaaattattgtcaatgaaaagagtcaaactctgtaaaatatttgaagagacttattctgaaccaaatataagtgaccagggcccgtgacacagccctcagaaggtcttgagaacatttgtccaagatggtctgggtgcagtttggttttgtacattttagaggggcatgaaacatcaatcaaatacatttaagatatacattggtttggttcagaaaggtgaaacaacttgaagctggggcttccaggccataggtaaatttttaaatttcctggttggcaattggttgagtttgcttaaggacttgtgatcaatagaaaggaaatgtttgggctaagataaaggattgtggagaccaaagtttaattgtgcagaggaagcttttagctagcaggcttcagagagaatacattgtaaatgtttcttatcagacttaaagtctgtgttgatgttaataccagagaggtataatgaggcatgttcgactcccacttcccatcatggcctgaaacagtctctcagattaagttctaaaagagccctggctgaggaggaagtccattcagatggttggcgagccttagaattttatttttggtttacagatgggagcaggttatggcttaaataccagagactcttgctattcttaccaagatgtattagagtttcttgaataaatgttccttcatttgctgtagaaaattaggacaatttccagagactttgaataattgatatttaaatgaatttcgccagttgcagtttttccttttgggtccacagggctcctcatactcccattctggaactggaagcctctctgttaagtctgtaaacacttcctttcccccaacacagatttcttcaatctgtctaacccaaaaacactgccctgggacaggatgtccctatgtaagcaggacagtgggagaagcctggaatttaaggcccaaattgggtctagacattcttgataaatgtgcctatcctagcgacttgccatttaaaaaggctaaacacaaggtgggacataggggatcagaagggagcaagtgaggccactcccccatactccctaccctgagtcttgcccctaagagttgaatattggtggtgggagggggactcatagaagagagaggctatagctctctatagcaaagcagattagagtagctccattggccccctagggaaggagcctcagggaggctgacttgggtttcacaagaaaaagtacattctaagggtaaagtacataaagagctgcttcaggaagaagtgagctccctgtcatcaccgaggttatctaagtaaaaggtagagggccacatgtccaggaccctctatcattcatttagagttagaatcccaggacccttgggagaccattgaccctaaaattcattgatcctctgtgtttggagaaggaactctgcccagttttgtctagccaagtcaggtgattcctaggatttttgacataataagagttcagaaacaccccagggaccacgggcctttcctggggttttgcaaaggagcagaattagcattcattactcattcattactgctctaatcagcatcttaattgccagtcttactctcagtctttatactgagtacctggtgcatgttcactctccacccccaacgtccagctaagcctgggggcaaacacgagattccctagaccatctgcattccaccttctttccctcccccttttagagagctcaggaaattggttttaatccaccaagctcctgttgcttagtaacagaagcacctgctcctagcaaccaggagccacaaagatgctgcagaaagagggggctgtctgggccctgctcttgctcagctatagacagctggcctccccgatgtttttctcatccagcacagacactctgtctcagatgtctgttcttgaaaagctgatctctggggcagcttctgacctcaacccccaacctgcctgcctggagcccctctgaatcccacctcccaggccaccaggaggcagtcatgttcacaatagtgtggctctgggaagtgccctcactgaagagggacagaggtaagtaaccagctgtgttggttacttcagtctagcctggtgggtgggagtagggtgtgccacacaggctcctataaccctgggtgagagcaattcctgctcggggtggaggttggggagcgtgttgtaatccagtccatttgagcgtgaagagaggcaagagaccatataagataattccctcctagagatcaggaaactgacagtcaggacaggcttgggcccacacagccctttggtgacagccaggtctgaaggaatgccagaacgtggggctccccaacacagtcagcacccatgagactgccaggccactgtgcagtgccagaggcttctgcttcccgtccccgaaggacagcaagaacacacttctccaccacctaagaagaaccctgccctcttgccttctgggatggcccgagctcagggtgatcgccaatgcagattttttcatttgacgagctgctttcctagaattgttgaaataacaagagtttagaagtacccaggagaggtctgtccagagctctaactctgtggactggtgctaattggcatcttccttagtcacagatttctctgaccttcacaggaggtgcaggtgcgtgcattccctctctgtctctctggggcttcaagctctgaaagtagggctgtccaccaggagtaaaccacggaaagtgggggttgtgaggaccttacccccattcccatccccccagccctgggccagactctcaggcgggaacaagccttccagctgtgagcttctttcttgcttctcccctccctctcccctttcttcctcccaagaaaagagcttctggtctctgccttccattgcctggcaaccaaaccagctgccacaggctgagaggagcaacacagatgcttctcaatgaggggctgaaatgagggggtgcagttgctgtctccagtcacaagcacccatcggcaatactgctggtgctcacactttggatacaaggcttttcttacatttgccagtgttatgtgtatttgaaaagtcttccaaaggacagatatgccacaattgggtaaactgctccacgcttctctatttcatatttaaagcatgtcgttatggaaaatttcaagcctatacacaagtggaagggcgtagtgacccctcctgtacacagcatccagcttcaacaattatcagcgcctggccagtcacacgtcattggatccgtaagtatttcaatatggagctctgaaagacaagaacccctttcagcataactacagtgtcgttataacacctaaagtaattagtaatcattccataatatcgtcaaatacccagggaatgtccaaactttaaatgtctcatgtctcatcaatgttatggagggttcatgttatggtgttttttccactttttgtagtcaggatgtaaataaattaatctatgagttcctccttatgaatatcctgaaattacaaggaactaggattgtcctggaaaccatggacctgcaggctcttcctgagacccctgtgagctccactttgatttacagaaggtattgttagttcccaaattttgagatgagactgagattcaagaatgaagagctcagtgtcacccagctactgagggactgggtcaggttgttaactcatatcaggagtccaaactcctgtatgtgctataatgaccacactctgacacccctacctgctctacctccagaaaggtgagggaagcctttaggaagggggcagtaaaggcctccaccactcctgcccccaccctcatactagtccaggtcctacccaggatctgtcaaaaccagtgcaagcccaccttctgtgatctccctggcccatttctctcctcccaggtgactgcccttgggtgcatgtgcctcagtctccccctcacccagaagaaaccttgattcctaaatatctgtgccccacaccccaggtgagccttttggaagcagctccccaaaggagtgctgactgcccgagtgaggggctttctgtgtgtgtgtgtgtggcaggggagggtgcactgcaagtacagggaagtctccggggagagatcacagataccagccagggagccagccatcagcaatgccagagtgacagtgtccctcttgtcctcagcaggggaaagggagtgtccaggcaacatcctgggcctgagcatcctgaggacaggggctttggcctcacctctccctcccacaggccttttaccctctggggacaagaagttctcatctgtacagcaaagatactcgagaaaatcagccaggctgtcctgtggttgaaggaggcctctcagcttggagtaatggaaactgatctggccagagagtcccagcatcaggtcttggtctctgctcttacattatgcagctctgtgaccctgggcagggaccttcttttgtgggactcagttttcttatctatacaatgaaggggctggaccagctgctctctgggggcccattagcttccaggtttctataatctccaggaaaaggagacccatacattccttggtaaatggtttctggtcttaattacctttactgtcaggaaggtcttcctgcctttttgcttctgtctctgagccttgtttcctctggccgaggcccttgtctagataagcatgtttattgtcccagaagtgcctgggcaggcaacaggcattttcatcaccacaactcaagccaccatggtgggagagtggggtctagacccagccaagtccctgctcccgatccccaaggtgttcaggagggggcagtgttcaggccacaggcagatgagagatcatggaaccaactggctccttgctcttcaaggagcccaactgcccggtcttccagataaggaagcaggaactttccccaggaaacacagagctggagaagggaacagctggggacccctcagaagggatctttcctggtcaggggtggggatggtgaagaggagagcctaaggagcagagttagggcattaactaaaagcagtttatgaaacaaatcctcagggagctcctgggtcctccttggggaagacagaaaacacacacacacacacacacacacgcacacacacacacacacaccccacaggagaagagattacaagcatatctgactatcaggtaactgagatgggactctaacttgaccatcccacccaggggccacgagtctcccagcagcttcatgtattcaacaaatagtgactgagttactgggcatcaaacagtaaacaagggggacatggcctcagccctctctctcaggaacttgcagcctagctcagcaggggcagatgctcaagagaggattctgatccagggagctaccccaggctgaagtaagccagggaactgtgggaacccagaacaacccatctcaggtgctcaagaaccatcctgtgctgcaggctgtgtcctggtgaagatcaattagaccctctaccttgtcacaaggacagaggattatctgtatcctgggttcttgccttggtgtaccagaagaatcagatcacatctgggcttggagaatgagtgcaaggttttattgagtggaggtggctctcagcagttgggggaagccagaaggagctagaatgggagggttttcccctggagtcgggtcgctcagtggcctgggctctcctccgagtgtcccagtcaaactccacgttgttctgctggtcggggctgttcgaggcctgcaggtgtgctagtgcctgttggtgcattcttctggacgtccagctgcccctgtgttcctccactgatgcgctcctctctgtgtttagctgcctgtgtctttttctgctgatctgctcctctggacgtccagcagcttgtgtgtgtgcctgctagggtctaggggttcttataggcacaggatgggggtgtggcaggccaggggaggtcttgggaaatgcaacatttgggcagataaacaaaaatgcctgtcctcacttaggtccataggcacaggtccggggtgaagccccagccaggggccaggaccttaaccccttgtatcatttaaagggaccatgctctttccttcctagcacttccatatcactggctgtgcccatttctgggggagtcagttctggttgcttggagatggtagccttagggagcaattggtctcccctcttcaggacagacaaagaagtttgaggatgtgcatgaccttccagcactttttgtcatctcagcgagaattgggcagcttctggggcttggaggagagctgaggctacccttctttatactagaggttctcaaagttttttgtttttggttctcaaagttttggggtcggtaccccaaagctcatggttaaagcttcagtggtttttccaagcagaaattgcatattgaaactgggtgccctttcttttgctggctgtggggatgtgaagtgtgggctgtagggcctcagataatagcacaatttctatcaattgttctgtaaaatcttttcttctcttccctgctgatgcagagggccaaaatgtttccttcttcaaaccagtgcccgtgatttagctttcattgacattgataatgaacataaaggtccctgagcaaggctgccccttttgtacatccttgctgctcttctcctatgtatgggggtgggggggatgacactggaaggaagggggaacgaatgagaaaatgtcctgtggattctatatttaatgtgttcagtgacatgcagagacgtttaagtgggatttttgtaaccacctttgcaaaatgatgacagtaagggaaatctgacatagttgagtccatcttgcttctaacctccaagcagtccttggtcactcctgggtataggccaagctaactttgggaggaatttagtttatggtttaaccttaaaggaaggatgataatagtctttcccaaaactaagcagcctttgtaaaactaatgaaaggccacaagattaggattatgaggagcctgaattctgctaagatgtagggtatagttagacaataaccagccattgttctggaggtcacaagatttgtaacttcttcaattactcctgtggataacatcactattatagaacctaagattggtcttctgagatatttttcagacttttacattctgacaatcaactgaccccacccagaagtggactcaagactcatgacccaactgatcctgttaacccccctcaacccagaggcagtctcagcacatgaccatagttttccacacctctatgattggatcccaaatcagtcagcagcatgcattctctagtcccctgtccaccaaactatccttgaaaaactctaacctctgagcctttggggagactgatttgagtaataactctgtcttctgcatggctgaccttgtgttaataaagcttatttctctactgcaatagcatggtctcagtgaattggttttgtctgtgcaatgggcaggaagaacccattggttgagtacactttcaaggaaatactaaggaaatgctttattttagctgcctggtcagtcccattgttcgggtttctgggtcttcctcttctcaaggctggtttgtaaatcctgagctattgaggagctgtctgttttctcaaaagagcagatgggccctctgatccccgacatgaccccctcctccactgactcttcatccacctgggggtttttgcttttggctactggcccaggtaaggggcctgtgcctatggaatacagtgggtctccagtcctttggggctcagggttccacctcccttctctctcctaggccagaccccagtcagactttggatgaaggagaaggcacaggcatggtggcattggcaatgaatctctttggaatcaaattttagtcaggctcttctaagtcctcttcttggctgtatctggaccttgccctcatcattgctacacctgcatagccccaatttgcagtaatctggcaaagtcagtttaaagagaatcccctcattcttaatatctgattagtctgctctcagaaagaatcctgtttggtcaatctaacaagaatcctctctatccttgatgtctcttatcagttgcaccccctggctgcacccaccactactcttctccttgactaagcattcccagccccacagaattcagtattcatctcctcctcaatattcagaattgggaccagttccatactgaggttttcctctcttgcaataatttcttttttcttttctttctttctttctttttttttttttttccagatagagtttcactctgtcacccaggctggagttcagtggcccagtctcagctcactgcaacctccacctcccaggttaaagcaattattgtgcctcagccacccaagtagctgggattgcaagcatgcgccaccacatctggctcatttttgtacttttagtagagatggggttttgccatgttggccgggctagtctcaacctctgggcctcaagtgatctgcccaccttggcctcccaaagtgctgggattacaggtgtgagccaccacgccccatcatctcttgtaatagtttctgaataaaatattttttttactggtattatccaaaaaaccactaggatggctaaatagtagaaaggagaactttattagcaatattggtctgcaagctgggaagagaaagtctccagcaaagagagtgaccaaaggtactctcttcaaagaagggaaggacagattgggtcttatgcctcacaggactggtatcttacatattcagtaggtttgaggggaaagctatacatatttatgagaagagccaagtgcatgcacattggctaaacatgttgtaacatacatcccaagttcactttggggtgaggttttggcattaaaatgaggtataatttggctttttatgtcaaaactgtcttgggacacaagacagtttgtgcacattctctataaactggctaaaactggcgtaaggtctgccccacccccatcagactttggatgaaggaggaaacacgggtatggtgacatcctgtcccttatttctcagagctggtaattgaggtccagggaacacagggcatttgaccctcttccaggaaccagaaagctggaaactcctgtattactcagttgctagtaatttaaaacagtgcttattgcagagctatattctggaatagaatgtatattttaaaaaaattttccatatgttattggggtacaggtggtatttggttacctaagttctttagtggtgatttgtgagattttggtgcacccatcacccaagcagtatacactgcaccatatttatagtcttttattcctcgccccgccacactcttctctggaagtccccgaagtccattgtatcattctcatgcctttgtatccttatcgcttagctcccacatatcagtgagaacatacaacatttagttttccagatgtacaatttttgatgaatctctcagaggcaattatcaacctcaatgtaattctgagcttcccccttgcaccctgtttactttgtttcacaattggacaaaatgagttctagagaacaaaggtcatttgcacaaaattctacagcaatcgattgcagaactcaaagtaaggttcttttaataataggtatcctttataaatagaatgaccggatgttccagtttataaatattgtcccattctaattattaaaattaaaagtccttctcaaaattagcatggtacatataataaaatatgtttccccccatttatgtgccattaatttttcttcatatattaggctggtgcaaaagtaattgcagttttcgccattgagagtaatggcaaaactgcaattacttttgcaccaacctatattgtttcatatagtctttacaataaccctacaatgtgacaatttctctcattttacagagtaggagattaagtttgaaaggttttagttacctgcctgaagaaatataaatggtaatataaatggtaaatggtgaagccaggcttctgattcaggttttgtggtgctagaactgggcagtcaattgccatattattctttagtgtcgaccaaactctccccagagagacctgtagtatgcccagaacagtttggcctctacttgtgccccaatggacatgctatttacctgggattggcagacagtacagagaacaaagagcctagggtaggaggagggcagagggcttacaatcctcaggcctgttgatgaaaagacttttcagaggcagctgatgacaaaagcactagccagtttcatggggaggttgtagaaggtgcaactataaccctggagcaggtagagcatggaacaaggacccagtgctgctactgctgtctctggtgggccccccctctgctccagcaaaagttaccacatggacaccattagccaaagcccagaccagctgctggcccaccgcatggaaagtgcgtctggggtattccatgcctcaggcctaagggtatggcctcagcgactctcttcaaagtgttccccaaaatcctgtctaccctccacagggacgggagggtacagaaaacatttttggagtcctgtgttcaagcactatctgggatataggtataggcttaagcattaggagatatacctaatgtaaatgatgaattaatgggtgcagcacaccaacatggcacatgtatacatattaacaaacctgcacattgtgcacatgtaccctagtacttaaagtataataataataaaaaagaatatattaatttgaacataaaaaaaaccttgtagtccttctcagctatctcctctcccctctgcagacagactcttgtctcttttgatatcttaaatctttgtgtagtagaaaaatacagtgtgttactttaggctctggtactaacagatttgtgactttgggtgatatcatttaatcttcctgggcctcagtttctccacatgtaaaatgaggaggttagtctagatgatcactgtgttgttattccaaactcttgcgtatgtgattcagtcttatctctgctaccattcagtaggtccccagaccaggctccttcctaccctccctaaaaaattcagataccagcctcatcagtggcagcttcagtcctgcctccatacccttgcggatataataaccacagtcatagtttttaacattccactaggacttgtgtgggctctccagttcctaaaggttcaagtgcatttcttgaccctgtcattcaaagatctctacactcaggagttggtggaaggcttacaacacatttattttgtgaggctctctggatatttgtaaatgaagaaatgccaaaatacagtctcaaaaattgtggtacttttgaaatacttacttttaacagctaaacattgtaacacatatcaagcaaatataatgaaatagatggcattcacaagataattacaggatagataaagtgtacactagagatcttttgtgaatgagaactccagccagatggtccctctaacctccttctcctgctcttcctgttccccacaacggaccctgacaattgacaatagtagttgatccaatccattgcctctcaaacctggcagtgccctcatattacccacatggtgcagatgcagctagtcaagcatggtccacgggctggcatttgggatcaccaaacaagctccctttacatgtgtgttagccttctgcttggactggccagatctttggattgcattactccatagctactacaacccctagcactaggccaaaatcctggcaggttcttagtgttgatttcagagctgaggaccagggtggaaatgtgtttgcaacctttcctgtactcctgttctctccccaccctcttcaggaccatcacagagcctctacaagaagacactccaagcctttaagaccctgacattaccttccttctacctctacccaaattatatgattttttcaaatccctcttgttctaaaggaccctgaccttctcttcagccacctcacacagacccaattaaaaggagatggggagtagactaggtttcttttttctgattttcttttgacccatactgctttctttgctgtcttgtgggcacatacataggtattcaagtgaaacaagcccagacttcaaagttaagaacttcaggagtggaatttctccactcttggtacagtggggagtctggagcaagctgtttgccttctttgcaccttcgttacagatcaggcatcaaggaatgaagattaacccttgaccttgctggaagatggcatgtttacctgatccctgatgttccaatctcatagtgaccacaggagcctggagcatagtaccaagtgtgtgagggcatgccatagataatgcagctgggaataagggaaataacgttagatggagggtcagaagacccaaagttaggcctacttctggtcttctggtactaacttgcttcgtatccttggagaagacattcaaactcttcagcctcaatttctttctttgcaaaatagggtacatatagcataatagctaagagcaaagaccttattgtcagacagacctggattggatgccaactctaccacttactagctgtgtgacctagtctacttaccaagtctttcttggtatgtttatttacttgagggcaagtaaatggaacactaatattatttactttatgcagttggtgtgaaaattaaatgaaatagcatagctaatatatgtaaagaatttgacacggtgtctgtcacatagtaagtgctaagtaagtgttaactattgttactactagtagtactactacttctacttctactatgaagaaaagaaatatgtgaggaaggacatttgctgccctatttatcttacacagttgctgtgaagatctaatgagataagtgctgaaaaagggttttgggagataaaagaactctacagaggtgaggtgagattgacattaaattacaaaggtgttgggaccttcccccttactgccaggtcgctcttgagtccatcgactctggcttgatcagtgctggcatgagtggctattgccttcccttcccacccacccatcttgcctcctggcatattgaattagaggaaggggttagaaactttgacctccaaccttctgctactctaccactcccacccctactacagaggcacctgtcacataagtagccagtacccaacccagacccagagttcactttgcatttgccctactgagggcctgggacatgtgctctcttcattagcagcctggagaagtgtctgtccacatctgccttccccaggactatatttaagtcatacaagccaggtctcttacattagctcacctaatcctcacagaacaatcatttagttggtacttttataagatccattttccggatgagaaaactgaggcttagagatgtgaaataagttgctcaaggtcaaatagaaagtgaggatgtagagcaatggctcacgcctgcagtcccagcattttgggaggccaaggtgggcagatgacttgagctcaggagttcgagaccagcctgggcaaaatggcagaaaccccaactctacaaaaaatacaaaaattagcggagtgtaatggcgcatctgtagacccagccacacgggaggctgaggtgagaagatcacttgagctttggaggttgaggctgcagtgaactgtaatcatgccactgcactccaacccgggtgacagagcaagatcctgtctcaaacaaacaaacaaacacacaaaaaacacaaatagcaggtacatacaccttgttcttaaatccatgtctgtctgactcagagcctgcacatttagcattatacaaacattatagaaagattaattcagcccatccctgatagtttagtggctaggaaaaaaaaattctaaaggaggaaaattcatctatcctagaaccttcctgtagtgacagaggtcccagccttatttcagagaggctaaggtgaggcttaaggaaatttcccagctgggaagcaggttgttaactagccaaccgatgtaatatcctctgtcctgaaggggcttttgatttccttcctctgctgtttcctcattttccccatctctctcagaaaacacttaacaaaaaggggcagtatcctggaaaaggcattttagattgaaaaatgagctctgtccatacttttgcagttcctctgccttcttttcccctacctcccttccttcagacaagtaattcaagggtgctagggattgtcagcctattcctgctcagaggcaggaacatggcctaagtggtctcttgagatttcctgcaggctttcatgcttcatgaagtcgtagcagcaggccccctgacggtggagccaacattagtgcttggctcagctctgaggatcaaagccatattaatcctggcagccagccttccctggattgattaccttgtcatctgccccagaccaaccatcccaggtttccttcctaatgttaaactacagtgtagggagagttgcttctggtaacagagtgataacctgtcccattggggtgcctgctggaagcagctgcccaaactggctgcctctttagctcaaaagtggccttaaagctataagcagggccctattcagtctcaagggtaggaagaggctcatcattttggtacttgtttcttgttttggctttacaaaggcactgatgcttcctgaaagctgagcttagaaaattgttcgtctgactcctgctgcttcttctctggtggtgggacagatcaatggagcagccatgtttccaaggagggtatagagatttgctaacctaataagaagcagctggtgagctctagacatcattgcccagttctaatttcacactcactccttctgacccatgggctcagggttccttttcctaacctcacagggttctggtaaccataaggcctccaacccaccatttaaaggttgcaaggccgagatgctaaaatgacagagagccagacagggaagtagatacggcatggtgatggaggagacctgagaccttgtccctaccctgctataaaccaagtctgtaggcctcatgtcttcatctgtaaacaacagaaagatcattgatcggtctttgcttaatacctctccatgcctagtgatatggggcagggagcctgggaaggggactgtaaaaacctcgaggtaaatctaggctgggaggcactgccctagagttcaggaaggccaagtccataatgtcattgcctaattgaatactagaaaagcacccctggaggcaggtgagtttggctgagaggtaagttgggatttacttaatgtctaaagagagagagaggtcaaagtaaatggttcagtgggcagagagagaaaagcaggtctagggcagaagggagatctcagggactttcccatggagccccaggggagagactcagaaagatgagggcaatagaagggaagatatgacagaacagtcttatcagaggcttatcaggtatcacagtgcagtagaaggagcacaggattaggactccaaagatcggggtttttatcctggcttagttagcaattgacttgctgtatgtccttgagtagtttatgtcctctctgagcttcagtgttctcatctgtgatatttattatttatttatttatttatttatttatttatttttttttttttgaggcagggtctcgctttgtcacccaggctggagtgcagtggtgcaatctcagctcactgcagcctcgatctcctgctcaagcgatcctcctacctcaacacccgctccccccccaaccacaagtaactgggactacaggcccgtgccaccacacctggctaatttttattttattttatttttttgtagagacggggttttgccatgttgcccaggctggtcttgaactcctgagctcaagccatctgcctgtctcagcctccaaaagtgttaggattacaggcatgagcaaccgcgcccagcctcatctgtgattttttttatttttgttttttcaaagctttattgaggaataatttacaaatagtaaaccgcatatatttcaagtgtataatttgacgcatttttacatatgtagatatgcaggaaaccaagaatgtggagaaaagggaacacttatacactgttggtggaaatgtaaattagttcagtcactgtggaaagcagtttgcagatttctcaaagaatgtaagacagaactaccattcaatccagcaaccctgctactgagtatctactcaaaggaaaataaatcattatacaaaaatgatacctgcactcatatgtttattacagcaatattcacaatagcaaagtttacaatattcacaatagcaaagtcatggaatcaacctaggtgtccatcagtagatgattggataaaggaaatgtggcatatttataccacagaatactactcaagcataaaaaagaatgaaatcatgtcttttgcagcaacatggatagaactggaggccattatcttcagtgaaataagttagcacagaaagtcaaataccaaatgacaggatttcattctttttgatggccaaatggtattcccttgtgtatatatactacattttctttatccatttatctgttgatgaacacttaggttgattcaatatcttggccgttgtgaatagtactgcaataaacatggcagtacacttaattctttgacatactgattttctttcctttggataaatatctagcagtgggattgctgggtcatatagtagttctatttttagttttttgagaaatcaccacactgttttccataatggctgtactaatttacattcctaccaacagtgtaattttatagtaagtcttgaaacgagataatataagtattctaactttattccttgtcaaaattattttctcaattctatgttcttttcctttacacttaaatttgagaatcaacttgcaaaattctatcaaaaaaacctcgctgggatgttaattagggttgcattgtatctacagaacaattggagagaattgacatctgacccatgaacaatatatatccctccatttatttgtcttctttaatttctcttagcaactttttgtaattttcaatatagaggtctgacatgttttaaatcaaatttatccataagtattacaaatttttgatgacattgcaaatggtatttttattcgatgtttaattatccattgctagtatatataaatacaatttgtttttgtatattgactttgtatattctgagatcttgcttagcttatttgttagttctagtagctttttttgtagagtcctttgatttttctaggtaaattataatgttgtctgtaaataaagacggttttacttcttcatttcctacctgtgtgtcttctatttctttttgctgtcttgtttgttcgtttttaacttttattttaggtttgggggtacatgtgaagatatgttacataggtaaacatgtgtcacgggggtttgttgtacatattattttatcacccaggtattaagcccagtacccagtaaatatcttttctgctactctccctcttcccaccctcccacgtcttcttactgtcttattgcattagctagaacctccaatggaatgttaaatagaattagtgagagcagacatcctttttgtatcctttttgtttgtttgtttgtttgtttgagacagggtctcactctgttgcccaggctggagtgcagtggtgcgatcacactcactgtagcctccacctccccaggctcaggtgatcctactgactcagcctcttgagtagctggaactccaggtgcgtgccaccaggcctagctaatttttgtattttttgtagagagtggggtctcactatgttgcccaggctggtcttgaactcctggactcaagtggtccacccgcctcggcctcccaaattgctgggattagaggtgtgacccactgcacctggcaccctattcctaaccgtagtgtggaaccattcagtctttcacaagatgatgttagctataggcttttcatggttgccctctatcaggttgtgaaagttcccttgtatttctggtttgctaagagtttttttaaaattttgaatggatactggattttgtcaaatgctttttctgcattggttgagatgattatatatacatttttaattttaagtctggtataactgcatattgcattgatcgatttttgaatgttgaactaaccttgcatttccaggataaatcacacttgatcatgatgttttttccccttttttttgagatggagtctcactctgttgcccaggctggagtgcagcggcgcaatctcggctcactgcaacctccacctcctgggttcaagcgattctccttcctcagcctcccgagtagctgggactacaggcacgtgccaccacgcccggctaatttttttgtatttttttagtagagacagaatttcaccatgttggccacgctggcttgaactcctgacctcaagtgatccacccacctcgaccacccaaagtgctgggattacaggcgtgggccaccgctcccagcctatcctttttagatattgtgggattcaatttgctaaaatgttaagagtttgaaactgtgttcaggatggatcttcatctgtcattttcttttcttgtgatgttttttatctggttttggtgtcagggtaatactggccttatagaatgagctgagaagtgtttcctccaattttttggaagagtttgtgtagaactggtattatctcttccttaaatgtttggaattcacaattgaagccaacttggtcagcccctctatgattcatatgggccctttcatttttaacatcttgcagttctaataagaccctgtcatcaatctttttatgttagatatgtgtgtctcttctctgtctccttatttcttgtctgtctttgcctttggcctgtttcccatactttccattaggtgaatgtctgacaatctgagtctgtaggtgctgggccagccttctcagagaaagatgaggaaactgtttcaagtcatagtttctcccaacactggtgtgttttagtaaaaaaaaaaaacaaaacaaaacacctgtaatctgccttagctactaaagtagataactgaccattgtccaaaaccagtgggttcaaatcagtggccataggccattaagtagagcccagttacccttgaaggactgggacaagagttaaaatgtctcattttcagacttggcatgggcactcttaagtgtaggtctctctgtttgactctgtctcagtttgactctctgtaaaattagtaactgaacccctaaatcttctaactccaaaactgaaagtaaataaacaatagctgcagagggaagcaggccaaataacctaatatggaggtaataagacaacttatattttcagtgaatatttgactttaaaacctttgaaacttgggctgggcatagtggctcatacctgtaatctcagagctttgggaggctaaggagggaggacggcttgacaccaggagtttgagaccagcctaggcaacatagcaagatcccatcgcttcaaaaacttaaaaaaaaaaaaaaaatagccgggtgtggtggtgcattggtgcgtgcctgtagtactagctaccctcaggagactgaggtgggatgatagcttaagcatgggagcttgaggctgcagtgagccatgattgtgccactgcactccagcctgggtgacagagcaagaccctgtctctaaaaagaaaacaaagttttgaaattcaaattaggtagcccacgaaaattggcatgtcttgagacaaaatgtggagagataaaaatgagattcgtggttttttttattttatttattttatttttttttgagacggagtctcgctctgtcgcccaggctggagtgcagtggcccgatctcggctcactgaaagctccgcctcccaggttcgcgccattctcctgcctcagcctcctgagtagctgggactataggcacccgccaccgtgcccggctaattttttgtatttttagaagagacgggatttcaccgtgttagctatgatggtctctatctcctgacttcgtgatcctcacgcctcggcctcccaaagtgctgggattacaggcgtgagccaccgcacccggccgcgatttgtttagatatggaatgcttggaaagtaatgtttcctagtattgctgtgccacccccagaaaaacaccatcacattataatgaagaaaaaagtaagatactgagaggacccaatgccaggacaaatatgaaagtacttttggacttttaaaataaagatttgctagaaatatgaagtagaattctagacacaatggatggatggtgagtagctaccaaagtaaatgggcttagagtgtctgagtgctggaagaaagagcttttcaacacagtgtttgtcagaaaatggaaaaaggtttgaaagaagcttctctgagcaagagtgtttcatctattcactggacagacagttatgtagcacttaactctgggccctgcacaaggccagggaaataattaataaatgacgctcagctggaggtcactcttctggtgagccgcagagataagggctcctgttatctcagtccccaaagaagaacagagtcttgcatttcttccctctggagctccccagctgacccctgaagtgccttcacctacatcctccttttaaatatgtttcaccaattctttcagtcatctcactaatgcgtgcccaccacctggctggatgtgccggcataagtcatcacagtcctaagctgcctgctacctaccacacactgtccccatgccaaaccaataccattccaactatcccatttattcaaactagatgtagacacatcaccatgttctgggaactctgaagaggtgtggtgatggggcagaagcaagtgaatatttccggcaacacagaatccaattcatggtgccattctctccacttagcactgggtatagcagttggatagcttagccttagaacctgtcctcttaatcctatttgctattctctcactgtactgtgcatcttgtcaggaagtaggggctcttgaatagagccatctctgcccctgtgtcagccaccttatctctcttcctatctacccttgacctatctttgacctttatttgactttgcaccgtcattccctcatttgagcttttgttagttccccacaataaaaggaatttatgaaagcttgtgatgtatttggagagtttggctcttggagtaccccctctctctctttcaactcagagaggttggctttcagcagccaaggagtgaggaatctggtctcacacttgaattattttctgagcagtctcctgtacttcaaagacattagcctgagtgcctgggtaaggagccaaggcactaattgagtatttgagtaaaaagactttgaggatgaggaagcttgagggccaacagatccaggatggtgctggaaaagccagagttctggtgttgtgctgcccaggtccaacagaaatctagttagatatgggtgctttgaggaggaaagtaggggtgcctgctgaatacagacatatgttcacttaggtacaggccttttggggccaagtctcactccatgataccataggagaggggtaggccttgttaccgctgagaggggaaggttaaggttgaaaataactctgggaaccactgaggaaaagtgtgaatggtataataattataccattgaattatatgaattataatagttcatcctcaaaatccaaggatctgttgaacacaaaatttattagtcaggaatcagatacttgctcagcacttatgcactgtggattgaaaataatgctttctccctgatggaatgttacaaggttccacctctgatttttccaagtctgtttagaaagataggtctgtacattgcctgttaaaatccacccaactctcccacgaatctcagctgcttcactgaaatctctttctttgtcttccccatataagagcaggggtaattatggggaatgaaagaaactcctagctttgagtccaagaattgttagaattctagaaaacctctacctactctttgcattttccaaaatgggaaactgaatataagaaaggtaaaggataaccagtaacacccaataacacctatctattatcaataaggttataattgtcaccataattgttatcatgactattatttcttcttttttaatacagtcattgcttgattatttttctcttactaaaattttttgataacctatcccactaacagtcccttaagtcacttctcttatataacgctattcttcttcagtcacaatctagctattagattacctttctctccctttatagaaaattttctctcacttggagtttctgacttctctgaaaatctttaaatagaaaattttattctggccttgaaccatgaggttcataaattttattgccctacttaaaaaaacaatgtgttccctactccactgtgagatccttgaagtcaaataccatatgtcactcatttaacatcttgaatgcctatgggatagacatgtgtctgggccagagagaatgttaaataattgttgaataaattaatataacatgtgaattacttcatttttaaaaatatacatttagtattaaaaactatattaaggcacttttctctatacttccaatgcagtacagctaaaaatgctggacattatatctaaaacaaatgtagcaagattgaaaagtggagagaagaaggcacatgggctaggaaagttgggatctaagaaaaaacgtaacagaaaacctgagttttctttttgcttcacatatcttagacctggagctgaagaagccagcaaccaagaaatgccaatggaagcagaccaaaaaaaaaaaaaagcttgatttgtctagccaaaagacgggaaaaggggcagcctagcaaaacaaaaaagctttaaacaataatccctctactccagcctaacaccatgggaaaaaatgcaccccacttgacctttgccaacaaaggcctactggggagccaagacttctacactcacccagctgtaacaaggtgctccaacctccccgcctcccatgctgaggtggtgtcagagaaaacagtaggaagccaggaatttcttcccctctcagcagtaacaaggcctacccctcccccatggtgtcagtagagaccacatagggagcctggactttcactcttgcccgggtataacctccaaccacctctcctactcctggcaaggtgccaaggtggtgtcagtgaaagccaagtaggaaactgggactttcaccatcacttactgaggtaagaccacatgggaaacagtaacaaggaacccctactcctcccaaccaggaagatataaaaagaagcctagtagggatcttgaatacccacccctgctcagcaataacaaggtacccttccttcttagagtgtcaatagaagctaagcagggaacctggatttccacccccatttggtagtaatgaagttgtccctcaatggcacagtatcagaagaggccttctaaaacacaagatttaaataagatccagagtctcatatctaaaatttccagaataccatagaaaatcacgaatcacaccaaggaccagggaaatcttgacttcaacaagaaaagactatcaactgacactaacatgaagataacacagaaattgaattatttggcaaggattttaaagcagccaacaaaaaatgctttaacaaatcattgcaatcacacttggaacaaatgaaaaaaatactaagtctcagtagataattagaagatataaagatgaaataaatggaaaattttggagctgaaaaatatataaccaaaataaaataagcccactggatgggccccacagcagatgagagaagacagaagaaggaatcagtgaacttgaaggcagaacaataataattatccaatctggaccacagagagaaaatagattgaaaaaaatggaaagagcctcagatgcctgtgaggttataacaaaatatttaacatttctgtcatcagaggagtcccagaagaggaaaaaggcagggctgaagagatacttgaagcaataattgctgaaaacttcccaactctggtaaaaacataagtctgtagatttaagaaactgagcaaatcccaaagagaataaactcaaagaactctatgccaagacacatcatagtcaaactttcaaaagctaaacacacagacatgcacgtgcatgcacacacacacacacacacacatcttgaaaacagtaagagagaaatgacacgttaactctaggggaaaaacaattaaaatgacagaagatttctcatcagaaaccatggagggcaaagtgctgaaataaaagctctcttagctcagaattgtatatccagtgaaaatatccttcaggaatgaatgaggaaatcaatacattctcaaacgaaggaaaactaagagaatttgtccccaacagacctaccctaaaagaatagctaaaggaaattatttaaccagaaaagaaacaatagaagaaggaatcttggaacatcagaaagaaagaacagtggaaaaagtaaaattatacataaatgtgacagatattataatataattgatttagatttcttctccttttgtgtttttttttctttcttttttttggagagaggctctcactgtgtcacccaggctggagtgcagtggcacaatcatggctcactgcagcagcctcaacctcctgggctcaggtgatcctcccacctcagcctcctgagtagctgggactatgggtgtgcaccaccatgcccagctgattttttgtagagatggagttttgccacattacacatgctggtctcaaactcctagactcaagtgatctgcccacgttggcctcccaaagtgctgagattacaggcatgagccatagtgcctggtcccttttgtgttttgtaaattaggtttaacagttgaagaaaaattataataatgcctaatgtggttattaatagatgtagaggaaatatttaagataattttattataaatgagggagggtgaggagatataagggaggttaggtttctacactcctctccaactagtaacatgtcgacaccaatgatgttgtatacatatgatgtgataccattatatatatataatgtgatttctttgagtacatttttcagtggccactaaaaaaggtatacaaaggaacacactttaaagcacaataaataaagtggaattctaaaaacttttaaagtaacccataggcaggcaggataaaagaatacagagaaactaaaaacagaaaacaaacaggaaacaaaaataaaattgccctaatgtatcaatgattacatcaaatgtaaacgatctaaatatatcagttcaaagacagagattggcagagtggatagaaaaaaaaatcatgacccagctatatgctgtctataagaaactcacttcaaatatgtatttccagggaattatgctgggtaaaaaaaagtcaatttcaaaaggccacatactgtatgactccatttatataactttcttcaaatttgtgattgctaggagttatgggtcgtgggggagtgggctgagtgtgactgtaacacaaaggagatctttgtggtgatggaatagttctgtatcttgatcacaatggtggtttcaggaatctacccatgataaaatgatacagaactatatgcacatattgtgccactcctaattttctggttttgatatcatgttatagttacataaggggaaacttggtgaagagttcatgggacctctctggactatcttggctatttcctgtgaatctatagttatttcacaattaaaaatttttttttaaatgaaatagattaatttttaaaagctatatcaaacataatttaaagtttctttgactgtacaaaaaattccttataagaataatcatcagttttcattatatcatagacattcagaagggtcaaataatggtcagttctagttataaaatgtcagtaagatgatttgctaaatttaattattttttttctctttgacaatacaactgagctacttttttactctggccagaataaagatacatatatcataaatgagatcttgaactggcactttctgctttcccgccttctccccacctttaaaaataacatcagatttattgagatataattacatatggtaatattcacccttttttacatgctcagttctatgaattttgacaaaagaataccaccatcatcaagatatgtaacatataaagcttagaaaagagagactcaagatgaaacttgataacattttcattacccccaaaaagtttcttcatgtccctctgtagtcaattgtctccctcatccctcctcctgccacctactgatttgttttcctgtccccatagttttgtcttttctcgaatttcctgtaagtggaaggaataatttgagtctggcttcgtttacttagcataacgcctttgagattgttcaagtttcagtagttcattcctgtctattgctgtgttgtattccattgtattaatgtgtattcatttgtttatccattcaccagttgaagtacatttgggttgtttccagatttgcacaattatgaaaaaaaaagctagtgtaatcatctaggttcaggtttttgtgtgaacataagttttcattcatcttgagttaatatctagcagtgggttttcgggatcatggtaaatgtatgactaacttcacaggaggctgccaaactgttttccaaagtgagtactgttttgcattgccaccagcagcgtattacatttccagttcctccatatcctcccagtattaggtattatcattttgtaaaaacctttctttgctgggcaccattgctcacgcctataatcccagcactttgggagactgaggcaggtggatcatttgaggccgggagtttgagaccagcctggccatcgtggtgaaaccccatctctactagaaatacaaaaaattaggcatggtggcgtgcgcctgtaatcccagctacccgggaggctgaggcacaagagttgcttgaacccgggaggcagaggtggcagtgaaccaagattgcgcctctgcacttcagcctggagacagaatgaaactctgtctcaagaaaaaaaaaaaagaaaaagaaaagaaaaaaggctttcttggtaagggctatctcattgtggttttaatatgcgtttctcaacttattagtgatgttgagcatctttttatatgcttaattactattcatatcataaatgtatgtgcacatgtgtaattgtgtaatctctgttcaattcttttgcccatattttaagttagattgtttgctttattattgagttatgagagtcaactcactcttgtatggtggataccggtctattgtcagattttgtgtgctgcaaaatttttctgtctatggcttgccttttcattttcataactatttttgaaaagcagaagttttcaagtttgatcaagtctaatatatcaaatcttttcttttatggatcatacgatttgtgaatatctgcaaaatctttgcctaaccaaaggccaggaagatttgtctcctatatgttcttctagaagttttatagttttaagttttacattaagtctatgatccattttgcattgatttttaaacatgatgtgattattgatatttacaaagttctcttcttatacatataattttatctgattttttttttttctttagatggagtctcactctgtcacccagcctggagcgcagtggtgagatctcggctcactgcaagctccgcctcttgggttcaagcgattctcctgcctcagcctcgctagtagctggaactacaggcgcccgcccccacacccagctaattttttgtattttgagtagagacggggtttcactgtgttagccaggatggtctctatctcctgacctcgtgatctgcctgccctggcctcccaaagtgctgggattacaggcgtgagccaccacgcctggccctgatcatcagcggatcacaaggtcaggagatcgagaccatcctggctaacacagtgaaaccccgtctctactaaaaacacacaaaaaaattagccgggcgtggtggcaggcacctgtagtcccagctactcaggaggctgaggcaggagaatggtgtgaacccaggaggcggagcttgcagtgaggcaagatcgggccattgcattccagcctgggtgacaaagcaagactgtgtctcaaaaaaaaaaaaaaacaaaaaaaaaacgaaagaaagaaaaagaaaaagaaatgtttgaggcaggcacaagcagaaattttaatctccatttcacagatgagaaaactgaggattagagaaatgctgtgtgacttctcaagatctcacagctgataggagatgaaatggcaaggtaagaggtgaaattgtgataaaaagttaaggtctcctgctgtcccaggctagtacttttgaagccaggcagagagggctcagggtaaggctccaacaaagtaaagattcccaatggggagctgagcaacctatttggcactgaggtaagagacacagccagttgactagccccagactgagctcctttggcccattggggctccacaattggagagagccagaagttggcccagtgcctagctcatgtgtcactctttgatgatgatgatgaagagctggaagtgttcaaaggagagttctgaaattaatttcagagttagaaattaaagctaagaggaaaagttaaggaaacgaagattatttggcggagaaaagagaggctcaagatgaaacttgataacagccttcagacgaaataaaaaaaaaagcttgaactttccttctgagggctgagcaaagggaaacagtctggaagaatctaaataaaagggcaagttccttcctccttagtgaggattgttatagacacttaagagcctttagaaacaggataatatctgcttgagtttgaagtcaggaatttgccaaacatgggctctgatgacggatttcagcatgagggttacatgactcttgcacagtgtccttagaaatctttaggtggcctatgaacttgccttgtatcctagtacaattccagggggcttttgtctgtggccttctctactccttagtcttatcgtcttcacagggttcttctaatgctggagacaagcctgaccttagctcctgaaagcttaaccccaatgttttttgcccctgaagccagtggcttagaacctaaggctatagatctggcttagcatccctggaaaggcctgaaatattgactagtccaaatcttaccgcagtgatagaatcccctgttttatatctagtctcttcttgcaaaactctctgaacatcagggactagcaagctggcaatgcagaccaatgcaatgccccctgtgaaaggccagagaagaagagctgagataccagcagtaccaccaggcactacactaagctaaagtgtctttgcacttgttttctctgcagcatgggtcggagccctcgcgatgggtatgatcttcttctgttctcccattgtgagtatattcactgaccgtttgggctgccgaatcacagcaaccgcgggggctgccgttgctttcattggcctccataccagctccttcaccaggtaaggctaagagttggtggttatttccccaaggctgagggttggtttttttctgggctttagctagggttacttttctcactgcagaatcccctgtggccatggccctgtagggccctcaaagatcctgcaccctggattcagaatccagtgaattcatctgggtagggtccccaggacacattggtagggaatatccccagagaggacctaagagttccaaagtggtaggagtactctaagcctggtagttcgtagagctgggcccaagtccggttttggccactgaatggcaatggaacaattgatgagtaccattgttctctctgtgcctcaatttctatatctgtaacatgaggggatttgaccatatggtctttttacatctctttcaactctgctatttgattccccttcagtgtgccacacatctcacaacctcactttccatcccaagattgagcttctcgagtgagcccatgtgaacacctagcacaggattcccaaaggaatcttatgctgaaaaaagaggtcaactgagcccaaggatgtttagcatttctgactcttttccagatagctcaggctgctgacatatggatgatttgggacagataatgatttacatcatgggcatcagaaggatgattagcaatatcccttactgagatacaaacccagaacccagctacccagctaggcctgggctaaactgaaaccctagtcccactggttccactggcagaacttggcagtatcaggtgagaagcaggctctaggttcattttctgctttcttttctgccagccctgcagaagaatgtgtgtagggtaagggagaataaataccctaaccacagcctgaggaatatggaattcctaaagaactctgttgactttctgccaaagacactttggaagttatggtacctcctacttccaatctgcttgggccgatgtaggggaatgccagcctggaaacacagaaatgagaaatggccgtggtgacatgtctgggatgaggtcagagctaatttgtcagagacttgctttctgagcttagttacccagaaaagcgtcatggctctctaggcctaaggttccactcacagtagagaatgataattgtgttttgccttaactgggccctgtgaggtaagccagctttctttatgacttgagcatttccagctgcccagcctaccctacagcagagcttggatttggcctgcagtcatttcttggcttcgtcctgtccaactgggacagagaagggaaaaaccgtgtcctgcctggaaactactcagcactcccagggcagcagctccaaaccttttcagaacccctctggtggtcagcctcattcacccccagcaagctggtgcctggctccttgtggggaggagctaggcttcaaaagcagctccagtctcagcactatacagcaaaggtctgttttttaagaccgagcagagcaaagtgtaaacggattagcaacatatggattccatttcccttccaatccacatgggctcaattacaggaggggaaggagctcagatgtggtgttttcttctggcacgctactgtaggcacattggagtaggcgttctgttctctagcccctaaccttcttctctacccgctttgttctttctgtaagaggatcttcagagccaagaaactttctggatggcttcacatccagtggaaaaatggttcttctcatggctagagctccaaatcatccttcctgttgtctcaatcagggccctgagttcctccgaatgacatggaatggggcaggatgcaggcagggctggtggggctttggaaaacccaaacaatgggcatccatccctggggcccagctagaagtagatccaccacatggatctaaaccaaatcctatgtttttcccccactggccccttccctgaaggtctaacacaaggccccttggataaggcccccaagccaggccgatcccatagggtacctagaatctaatgggcacaggcccaaaggaacctgacagaagaggaaccgttggcttagctatgtgttccaagcagagacaaccctttcaaaaccaaatccttgctcacgtccagtgaataccagcagatggaaagcaatagtgatgacagctatcttagaatcatgcaccatatcttctctgcagcttaggcccagttctttagtatgaggactgggtctatctccagagaagaactgcctgaccaagaagagtattaggtaatttagtggccagataagaactattgcaaaatatattgaggcatcaaaaagaaaacaaaattctttactaggttgtgccaatattatctgggggcatatggctggccaagctgaccttcctattgcctttccccttctgaccctttatgttacagaggcttatgtccacagcagggcctatgagttttaagccaggacctgtcttacttggccaggcccacaaattctttgaggctccacttcctgtcaaggagccaggctactctagggaacaaatctataccatatccagaaacaaaggcaggactctaaaagttaaagagactccttacctaatgattcccgctgagatcgtccagggcctagtgtaaagggacttgggatatgtggaccttgggcagggtttgggagggcgtatgtctcagaagaacatcagccattctctgaaatattaatggccttagcatggagaaagacactgaagagtcccatggaaggtttcaatcttccaggattttgacttcttgcagacctttgttgctacctgggataaaagctttgccaccaccaatagtaaggtgaggctagtctctctaagacaatgactccctgtagcccctcatccagcttttacatgggctagttctggctttcctttgaacagtcctctttgatggggtgctatgagtcatgctagagtcacacagacctggattcaagtccaagttttgctgattcccagttatgttaccttgggctaattattttacctcgctgagcctctgcttccccatctgcaacacagggatcagaaggccctcttctttgtctgttctgagggtcagtggcaagtggggctgtgggttaagggcggaggaatggaagtctcaggaagctgacaggggagggcaggtagattgctggtcaggctgctgaggacagctcttggtatttctcccacagctccctaagcctgcgctacttcacctacgggattctctttggttgtggctgttccttcgcctttcagccatccctcgtcatcctgggccactactttcaacgccgcctgggtctggccaatggtgtggtgtctgctgggagtagcattttctccatgtccttccccttcctcatcagaatgctgggggataagatcaagctggcccaaaccttccaggtgctgagtaccttcatgtttgttcttatgctgctttcactcacctaccggcccctcctgcccagctcccaggacaccccaagcaagagaggtgtccgcaccctgcaccagcgctttctggctcagctcaggaagtacttcaacatgcgagtgttccgccaacgcacttaccgcatctgggccttcggaattgctgctgctgcccttggctactttgttccctatgtacacctggtgaggaataccagagtgggcccaccccacctggccccaagaagctaccctcaacctgcctagattccagagggtgggggtgggagacattgaaagggcagagctgggacctttgggaaaagaaacaaaatattggttggagagatccagagagggaaaaagagagaggttgagggaagaccttagtggaaaatgggggcaattccacagggggaagcccatggaccatggcttctcccacagtaaaaatttagatagattttgaagagatacgcattgccaggatgcaggagactggcccgggtgacccaagacaggattctgtggaatgctggtctttgtggtcaaatgattttgtttaggaagtaacatatactggatctctctagctttataatgtgtagtaatctcttaaagggactaaaaaaaattgtaggaaagaaacccattcagctttgtttaactcaccatccaccaaacttatgcaactacagaactgttggttgtagtccagctgttatcctccacaggcttcatgtttcctaaaacacactttggaagagttgcctggaagttgctggattcttctcccctggtgatttgatgttgccctaggctgtcagtttggggtaagggaatggggagattgtagagaaacccttggattttctcaatcatttaggctattttctgtcttgctggggcttagaaggggcgtggaggtacccaccctccttagctgttgctcagaagtccagaatccagacagccaagggataagcagccagagagcttgtcatggaggtagggctacaggagagggggtttctgtcctgctccaggaaagtaagcagtaggggattctggatatgcctacagttaaccagtcagctcctctttctcctcctgtttctggggatccttgtgctatgcttttcagatgaagtatgtggaggaggagttctcagaaatcaaggagacctgggtgctcttggtgtgtattggggctacctcaggccttgggcgtcttgtgtcaggccacatcagtgactccatccctggacttaagaagatctacttgcaggtgagtgtgaccacttgtccactgtggggagaaacagcctgccacaaatgcaaggttatccacagcctttgggatagaatggtagcttgttgtgtcgcatgggaaagtcaatcaaattctctgagcctccatttcacctgcttttaaacaaagaaaatcatccttgttctgcctcttttaccaagattgagtgaggattctgtgagagcagtgtatatggaacctattagaacacgtgtaaaggaagattttattaataatggctctccatgctccaagactattttctgtgtgaactaggctctggtctggtctgaatacaggccactgttcaggctgtcagtctttatctacctggcagcagtattgcctttcttacctgacttatgatcctgcaggtgggtttatgaagtggtacccaagtgcagagccctgtgaaggggcaaagatagcccccaaaatcaagtagtcacaagtaatccatcaggaaggtgattgagttctgactcatttatctcctgggaaagccctaaaagcacatgcaaggggccctagctacacttacagtggtgatttctctgtctctgatagccccaagtgccctcctaagtaccctcaaatatcttggatggaaatatgattaacttttccttaacttttttggtgttagattacaagagttggtaaatctgctttgtcagaggcagggttgcttttaaggtccatccaatccaacctcattacagtggtggagaaacagagggaaaggctcacacagacagtagtagcagagctgaactcctatgcaacacacttctcatattctaccttgccctaagtgatggcagagccaagtctcagagatgataagtgacttgaccaaggtcaaaccaagagataatcttgtgattgagataaaccaattgagattttgaattcctgtgcaaatatcagcaagtgctttatctgggtggctatttgcataggaatatgtgtggctttcccagcctcacccacatgacacccctgtgagtcttccctgccagtattagcagctccaagatgccaaagagttctggaaatcagggtaatctggcattgggccagggctttatcttgagaagaggcagcagcccctgcctagtcgtataactcatgtgattcttactacagtccctaggagaaaggtagagtctgagcagcttttgctttctgttatacagtgggagtccaagggacagggaggcattagccagttagaggccaagataggcttaggacccagtgcctctgctgaccacccacccactgctcctgccccttttccttactcttacttcaccgagttttacttagaataatataaaataatcttagaacattatagctgaaacatatcttcatcaactagtagttgaacttcctcattttacaaattgagtgtcttgggccaagagcacaagacaatggatgaacttctttctcttgagtttgttaagatactccatcacaggaatttgcccccctttctccctgcatgtaatgcaggagtacaggcctaggggaggaaacgagtgtacacaccttcaggttctgaagagctatccactagactctgtggctcttaatgttggtaaagacaagcacatatctctggcttcaagcccctggacagtctgctggaaaggaaatagcgacaggctgcaggacagcctcactttgtgccaattcttgaggcctgtttctcacgtccaagagggattttaaatttctgaatcttgaggcctgtttctcacgtccaagagagattttaaatttctgaaccttggcaaagcctcatggaggatgtttaacagacagctagatacaataggtaatacttagacctgattaaaatcagttaatagggtcctttgtgttatataatggtattaacttttaatttccataatgggctttgttgataggtgtgtctggttttatcccatagttgtgtgtgaatctcttagaggagaagctcaggtaccggggttcttattcctagcttctgcctagctacctcaaaactgcctgggcaaagttcaaagtctcccaacaaaaagatgtcctcagatggcattatcctctccaaaaatcaactgatcaacctaaaaaactcactgccagcaacaacatagaaaatctttagggcaccaaataaccttgacccccactccttccatgtgttcttggctaagttggcttgcttgtgtgaactactggaaaatccttgggcctattaaggccttgatagagagatcagatcttagccctgaccctgggatgacctggctctgacctggctctactggctgcagggggttggcagcagcgggatgggggcagggttcctttctctgcctgaagcccaggtcttcagtctagctggccaacacaggttgcaaatgaagaccagctgtgtttgcagcagcccttttctctgtggagaaggaaaaaaaaaacaacctctggaaaggcagtttcttcattttggagtcattttgcttagcccagagaaagcccagtggctagtcagtgttcctgggttggcttcattctccctagacatacaccttcccagtggcttggttcccctggaaggctcctctgttgccttctcagggtgtccagccaagcccagaggcccccagagccatgtgtctgagatgtctgagataggcagtgcagtccatgtcctaaagcataggaacctgggtgaatgtcccaatggtttcctttatgccaaggtattttataaaatcagcccccacaaaaatgggctctggctccttccccatttcaagaagctgtgccttccacttacaaccccatctgatcatcatgcaagccatcctcatgtcctcccttccctctttccatattttacttggatctgagaacaccggtatggcctgatcccagaccctgatccctggggaagccaaatacaggctcagaaagcagaaacaacaattccttttatcttagggtctagtgcaagacaaacttcttgaggccaggggccaagtatcccccaactttctttttttaatcccaacagaatcacagttaagtaggggctttcttggactttgaatccctcagtgcaagactttgaaagggcctaaccattcagcccaactgctctctctgttgacaccttccccctcccaccaccccattttatagatggtagaaatgaagacttgagaaaggagatgtgatgctatgtggtcttggctggccagcacaacctgacctcaggcccttgtttctccaggtcctttccttcctgctcctgggcctgatgtccatgatgattcccctgtgccgggacttcgggggccttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggtgaggctgatattccagggagggcatgaatcagggagtccttttttccctgggtactggcactcctgagcatctctccttgaggccccttttcctcttatcgtctatttaagcagctttgtcagagtgcgtgaaaccccttatcactactggtggaagagattaaacacagtacacacgcatggatccattctgcgggatggattttccatggtggtatatctgtttcaataggattttatttcagacagcagggatccttccagcggggtggagagaaaaatgagtttggctttctgacagttccactgatctagtatcctctcactctctccacaggcaagtgattatttgcaaggtagttgggtaggaagagaagagaaagcaggctctggttttattaaaacctagggacatcctcctcctcctctgctggcttctgaactgagcctgtagaagatatttgattaaagtaataccccagaattaagccagtgaggctcaccttcagcaggaaaagtgttgacttgccatctttcagcactcctggttttctccctccattttcccagaagggcactgttggtatcccagggaacgaggaacagaaaaccaatgacaagagaactccaatttcttttcttttctcttttttttttttttttttttgagacagagtcttgctctgtcaccaggctggagtgcagtggtgcaatcttggctatctcagctcattgcaacctctgcctgctgggttcaaacgattctcctgcctcagtctcccgagtagctgggagtacaggtgcgtgccaccacacccagctaattttttgtatttttagtagagacggggtttcactgtgttagtcaggatggtctcgatctcctgacttcgtgatccacctgcctcagcctcccaaagtgctgggattacaggcgtgagccaccacacccggcaactccatttcttttctgtaggatttattgtaaacattgattcacgcattagcttctcctaggctggtcaaatgagttaattcaacaaatattcttcgaacacaaattatgtgcaaggtgatatgagggcactgtgtgacagtggcaaaagctttcactcaggcttctgggcaacagccacactacccattgggggaagggggcctctactcaccccctgatccaaacagtgccccagaatccacatttctttccaatttgcttaactcctgagtaagcaaaaggccaagggcctttttgccttttctgaatactgtttctgggctctgaggtactacgaggtaccacatattagcttctggaagtgagtagggaaggccttgcatcccatgtcaaacatatccttggtttggcagcttggagaaacccagaggggacaaccatatatgtaactgaaaggaacacgtatagcctcttgctaggacaaatggaacttcagagaagggtcacttcagagaaaaggaaaataaaaactcatctgaaatgtaccacaggaaccatttgtgggggcagggggcgggggtaggaggctgggaaatatcactgtggaccaagacaacacttggccatcttctgtggatttcttttaaactaggtttcctcctaactccgtaactaggtgtgactagatcttagattgatgaaagtcataaatggagaaactttaagagaagcttcattagcttctttcataatgagcattcgctcaagggcctgcagccccaatgccttgaagttgagggagctcctgagttaaggcaatacacgccaagattatctggataggcactgtgatggcccctagaacgggctgagagtacctttggacagtagggcaaagctgagcttgacttgtctctcttgactgtttcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcaggtagaggaggactgatgacacgagctgccatggcgggaggaggggcagtagttattgatatggtgagccccatctctcagttttcatgacaggtctatatttctacctgggccaggccaggaaagagactatttaagaaaaaaaaaatcaattcctagcctggatcccaaaaaggtacaggcagcagttgcacatagggttggaaaatttcttttgggaaggggaagccatcccagcctttaccacccaatgtgtctcccatgctgggcatcctaggccactttgcttagagggcattaaaggtgccatgaaaggtagactctgaaccactttgatccctctgaagtaggtgactgatgcctccttatgcccaggctctggcaacagtcttactgaagaacattcccagtgcccctggctaggggcagagggcactgccaggctgtgttcagttagcacagctcacctcattaggagctcagcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaatttg

SEQ ID NO: 3502 - DNA, 1625 bp, human
atgaagcaggtcaatgagctgaaagagaagggcaacaaggccctgggcgtggaaaacatcgacaatgccttacagtgctactctgaagccattaagctggatccccacaaccacgtgctctacagcaactgttctgccacctatgccaagaaaggagactaccagaaggcttacaaggacggctgcaagaccgtcgacctaaaagtttgactggggcaagggatattcacgaaaagcagcagctctagagttcttaaaccgatttgaagaagccaagtgaacctacgaggagagcttaaaacacgaggcagataaccctcaactgaaagagggtttacagaatatggaggccaggttggcagagagaaaatgtatgaatgctttcaacatgcccaatctgtaacagaagttggagagtgatcccaggacaaggacactgctcagtgatcctacctaccgggagctgatagagcaactataaaacaagccttctgatctgggcacaaaactacgagatccccggatcctgaccactctcagtgtcctccttgaggtcgatcggggcagtatggatgaggaggaacaggttgcaacaccttcaccaccaccccttcccaaaaaggagaccaagccagagccagtggaagaagatcttccagagaataagaagcaggcactgaaagaaaaagagctgaggaacgatgcctacaagaagaaagactgacagccttgaagcattacgacaaagccaaggagctggaccccagcaacatgacttacattaccaatcaagcagcggtatactttgaaaagggcgactacaataagtgttgggagctttgtgagaagtccattgaagtggggagagaaaacagagaagactatctacagattgccaaagtgtgtgctcgaattggcaactcctacttcaaagaagaaaagtacaaggatgccatccatttctataacaagtctctggcagagcaccgaactccagatgtgctcaagaaatgccagcaggcagagaaaatcctgaaggagcaagaacggctggcctacataaaccccgacctggctttagaagagaagaacaaaggcaacgagtgttttcagaaaggggactatccccacgccatgaagcattatacggaagccatcaaaaggaacccgaaagatgccaaattatacagcaatcgagctgcctgttacaccaaactcctggattccagctggcactcaaggactgtgaagaatgtatccagctagaaccgaccttcatcaagggttatacacggaaagccgttgccctggaagcgatgaaggactacaccaaagtcatggatgtgtaccggaaggcgctagacccggactccagctgtaaggaggcggcagacggctaccagcgctgtatgatggcgcagtacaaccggcaccacagccccgaagatgtgaagcgacgagccatggccgaccccgaggtgcagcagatcatgagtgacatagccatgcaccttatcctggagcagatgcagaaggaccccccaggcactcagcgaacacttaaagaatcctgtaatcgcaaagaagatccagaagctgatggatgtgggtctgattgcaattcg

SEQ ID NO: 3503 - DNA, 30876 bp, human
ggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatataactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgagcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcacccaccaccacactcggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactgcactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgagaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccatgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttctcgagacacagtcttgctttgtcacccaggctggagtgcaatggtgccatctcggctcactgcaacctccgcctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtaagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttctt

SEQ ID NO: 3504 - DNA, 31000 bp, human
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatataactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgagcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcacccaccaccacactcggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactgcactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgagaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccatgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttctcgagacacagtcttgctttgtcacccaggctggagtgcaatggtgccatctcggctcactgcaacctccgcctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtaagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaata

SEQ ID NO: 3505 - DNA, 31021 bp, human
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatataactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgagcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcacccaccaccacactcggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactgcactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgagaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccatgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttctcgagacacagtcttgctttgtcacccaggctggagtgcaatggtgccatctcggctcactgcaacctccgcctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtaagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttcttcttcacttg

SEQ ID NO: 3506 - DNA, 30373 bp, human
ggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatataactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgagcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcacccaccaccacactcggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactgcactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgagaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccatgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttctcgagacacagtcttgctttgtcacccaggctggagtgcaatggtgccatctcggctcactgcaacctccgcctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtaagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagcctt

SEQ ID NO: 3507 - DNA, 30187 bp, human
atgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatataactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgagcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcacccaccaccacactcggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactgcactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgagaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccatgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttctcgagacacagtcttgctttgtcacccaggctggagtgcaatggtgccatctcggctcactgcaacctccgcctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtaagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttg

SEQ ID NO: 3508 - DNA, 30393 bp, human
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactgtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggtgctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatataactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacctttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctctctctttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcaggagatcgagaccacggtgaaaccccatctctactaaaaatacaaaaaattagccaggcgtggtggcgagcgcctgtagtcccagctactcgggagactgaggcagaagaatggcgtgaacccagaaggcggagcttgcagtgagccgagatcgcgccactgcactccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgcaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccagctactcaggaggctgaggtgggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggctgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcgcaagtgtgcagagtcttttgagatgtgggatgatcgtgactcccactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatatctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacatggcaaaaccccatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggcaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattatgactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacataaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaataaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaaagtgggcaaaggacataaagaaacacttttcaaaagaagacacacacgcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtggcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacactgaataaatgtcttttttttttaatgtgctgtgtaaagttagtctacactgaagccatcttggtaaatttccccaacagtgtgaagttagcattccttcagggtgatgccaggttctatttggaatttatatacaacctgcttgggtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcacccaccaccacactcggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactgcactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgagaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccatgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcacatgcctgtaatcccagctacttgggaggctgaggcaaggagaattgcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttctcgagacacagtcttgctttgtcacccaggctggagtgcaatggtgccatctcggctcactgcaacctccgcctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagatggatcacgaggtcaggagttcaagaccagcctggccaacatagtgaaaccttgtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctttactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccgggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtaagtactatttttatccccattttacaggtgggaaagctgaaacagagagaggttaagaaattttcccttgtcggacattgtggctcacgcctgtaatcccagcacttagggaggctgaggcaggcggatcacttgaggtcaggagtttgagaccagcctggccaacatggtgaaaccccatctctaataaaaatacaaaatttagctgggcatgctggtgcgtgcctgtagtcccagctactcaggaggctgaggcaggaaaattgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttg

SEQ ID NO: 3509 - DNA, 30876 bp, human; identical to SEQ ID NO: 3503

SEQ ID NO: 3510 - DNA, 31000 bp, human; identical to SEQ ID NO: 3504

SEQ ID NO: 3511 - DNA, 31021 bp, human; identical to SEQ ID NO: 3505

SEQ ID NO: 3512 - DNA, 30373 bp, human; identical to SEQ ID NO: 3506

SEQ ID NO: 3513 - DNA, 30187 bp, human; identical to SEQ ID NO: 3507

SEQ ID NO: 3514 - DNA, 30393 bp, human; identical to SEQ ID NO: 3508

SEQ ID NO: 3515 - DNA, 32951 bp, human
taggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggtaagagtctgatagtgaaagaaagacctgtggagaaagtggacacaggatctgtgtgtccttggggtacccacgcttcctaaggctcaggggcactctctgtatacatgcaaccccttggatagcatggggaatatattgggcccatcctttattactcattatgtcttttattggggggcataaggaaaggaagggtgttgggctgggcagctcagagggcccactgcagctgagcggggctggttccatgttaaccttctaagagttacaggtccaggaatgtcctagaagagtatgatccttcagggcatggtctaggactaggcaggtccttcctttggcttggcttctctgtggcatgccttccattttccacaggtgtctctctcctgccatcggcttttcctctcaagttcctagcctttttcatagctcctggctcatccccacttagaattccatgagctccatatctgcctgtcctctctgctcctgtagtagtgcgatggtggtggtgtatgtgtccgcctgtgtatgttggtaggcaggtagaggatgtgtgtgagacagtagagagggcagccccctttcccgacaatgagggaggtctagggaaagttgactggagaagggagacgcataagcatactttggttgccctacaatgctttggggtccagagactatgggggtgtgagaaagtgctatgtctcctggagcctcacagatgggctgcagtgctgagtcactgctgggaggcaggcagcggccgaatatacaggaaggaggaagggaggaagaaaggaagtggggatggagaatgtggatgctggggagcctgttttgggggcagtaatgaaggaaagtcaaggtccagagagacattagagtcaggtccccctgagctattttccccacatccagctagaaagaaattactgcctcgaacatattctcaaagcgagagtcaacatagactcccccattaacctaccccttccccggagtgggactttcacagggtcgagggattaagaaaactgagcccttccaaaggcttaccctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtataccgggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctccaccccagaaccccagaaagagtcaggcagctgttccaactattcctgtaggtggacctcagcatggaaacaatgtggaactgttggaaagcccagaagactctgtgggagataaataaggatgggaacagaaccctttttggtaaaaacgatgtgttttccctcagtgctgagggatgggggaccagcttgggaatgttaacctttccccagacaagtctgctggaaaaggagaagagtggccacttccaggaggggccctacccctcaggccagtggcttacaggaaagggccttcccctgcccccacccagggtagcacaggcaggacacaggagcctccctggcaatggctgcctacatggaactgctgggtcccagtgacccctttccctcccctgtgaaaattcaacgggatgcccactaactatccatttccctttggcctcagggtacagcgagaggtctgagggctatggctctccctccactcctctctgcctctcaaaggcagggcagagcacccctccattttcacagtagactctgacgaatctcctggcctctgcactcacccaaggataatcacatttagagggattctgctgcgcctgcttgccgatgctgccatcccatggctctgtccccagatgtgccacaaaccttcctcactgtctctgaggaggcttacttagttgaagacaaggcttattttccaagcccatcctcttatgtcttagggaaattgcttaccagaagcttgtcaccaaagtggtctgatcttatcctccacctcaggggaggggtgggcctagaggcagagtgagccctttgtgtcttccatggaaagggaaaataaatcaacagaagctgccctctgcatgcccctcctcagcaccatggaatgcccagtcccactcccgccatccttgccagcctgagagggccatcctggccctggtgtggcaggcccagttgggagtgaaccggaattctccagagacaaagctctgattcaccagccaggccctgacatagccgccccctccagattcctggggggtcagtaaacaaacagggtgacccctgcctcctggcctggctcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggaaagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttaccagtgcccaggagagcaagcaatagactgtgtgcctgagggctcaagactagactttggcaggctccatggcttgtcctcttggccatcaactctggtcagagtcctctgctcatctttatgagcagttctcttgaagactgtgtccaggcttcctgactgtggtggacacatcaaagccaagtttcatatgggaagtaagacgtggaccactgatagttctctcttgccagtctactccctctataaatctttatggagaaactcctcagcttgcttttctagaaggttgggtaaactgtaggaccctgaagtatgagccaacagcttacctgcaatggtatggttgcccataatttgggcaattctgtgcagcttcttacctaatgcaggtacttccaagaccccatctgggcagtggtcctgaggagtgggggcccagcttgggaatgttaacctttccctaggtccaaaatttataatcatgagtaacaataatagtaggcagcagttctatgtaactgacctgtaccaagagaagacttggcaatgaacaggaccacagggtctttcttcatctcagtccctgaacacacagagaatagcatttctgaaccctggcagcaacccttctctccccttgttcacacttgtctcacccttggcttggtgcagaccagggtgtggcacaatccaaggatcacaggatgtttgtgtttctgtccaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccctgaatactttgtttgagttctcgaaatgttagcttccatttgttttttataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttggaaaaaaaaatgttttgccacttaaaaagaagactgaacatcactggttttactcattgtgtgcagcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggtaggttagaatcagagaagccgtggtgtgtagcctctcagctggggaggaatcccttcttcagtaccctgacagacacccagctctgctgagacacctaaatgaataggaggctgtatgcagtcctattagtctgtggctagcatgccacagcctaagtcaaatattttctttctacccctcccatcaaattctagcctcccttaaaatactgccatgatttttaatgggaacatggggaaatgaacataacataatgctaagtgaaaaaacacaggatacaaaactaagtgcaagtggatctcaattgtataaaaatgtatatagatgagtgtgatgtttacatacatataacagcataggaaggaactatatcaaaatgttaacaatggttaactctaggtaataaaattggagttcttaattttcttcatatctttctgaaatttctaatatttctgtgatatatattactgctgtagttaaaatacttcttaaaatgactacagaatgaaatataatacagcaataaaataaactataaccacgtgccacagcatgggtgaatcttacagacagacaatatgttgagtgaaaaaaagccggatacaaaaagagtatatactgtatgattccacttatacaaagtttaaaaataggcaaaactaatcagtgattttacaagtaaaaattgtggtcacctttgtgggaggggagggaggggtggggcatgaaggtgagatagtgactaggagggcccacctgggatgctgatagagttctgtttcttgatctcagtactggttacatcaagatgtacagttttagtttgtgtatcccgtatatatttcaaccaaaaatttaattataattttaatataaatcctgcctatcttggttttgatttccataagacccttacaggaagctttctgagtcttctggagaaccaagatccccacatttttctctatcctgtggcatagacagacaaatttcatactaaacagaccttccagtgtcagagttatttttctgtctatcaggaggattgcacgcctttttgtctaggtagttcaaagatacctgataatgccaaagaatcaagacacactgagaagaagaaaggttgtcaattgcaggatggaatgtaaagtgattgaaaaactttcctttcctgttgaccatattgctaaactttataggcctttatggaagaagtcaagtctcggggcccctacatctattctgtgctggagtcagctcaggccttcctgtcccagcacccatttgaggagttagaggagcctcattctgagagcaaaggtaggtggtcttctgtttttcccacttcttcttgagccatgtactgctgaatgctgaacaaacaccctcctgccttccccaaactcattttcttacctgttatctaggaggatagtttcccccaggagtccatccaaagttggggggaagcaagattcctactgcaggaaaaaaagcaaagagaatatagcctggagcaggggtcaacagttgtgtgacccaaagctgtatgtggctctttggagcagcatgtgtggccatttaatgagatgtggaaaagaaaaacaaaaaaccactcaaatgaattgaactgactcaatgaataaaagtaccagtatgtcctttaaaaacatagtgctggctgggcacagtggctcatgtctgtaattccagcactttgggaggctgaggcaagaagatcacttgtgcccagaaattcaagactagcctgggcaacatagtgagacccccatctctacaatttttttttgtgggggacggagtctcgctctgtcgcccaggctgaagtgcagtggtgtgatcttggcccactgcaagctccgcctcctgggttcatgccattctcctgcctcagcctcccgagtagctgggactataggcacctgccaccacgcctggctaattttttgtatttttaatagagacggggtttcactgtgttagccaggatggtctcaatctcctgacctcgtgatccacccacctcggcctcccaaagtgctgggattacaggcgtgagccaccacgcctggcccaaaatttttttttaaattagctaggttttgtggtgtgtgcctgtagtcccagctacttgagaggctgaaatgggaggatcacttgagcccagaagttcgaggctgcagtgagctatgattgctccactgcattccagcctgggcaacagagcaagaccctgactctaaaaataaataatatacaataaaataacaaactaaaataatcataatttaaaaatactgctttattccaacatcgagggacatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcatcctgagtagctgggactacaggcgcatgctaccacacccagctaatttttgtgttttttgaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaaaggacccttcatgaattgagccctttgtcaatgccatatgcccatctcagtttatttctggcccttcaatgggagggctagtacttaatttgatgcccgatgggcctcagataggacaagctctagaaagagcagcacaattctagttagcctggggctatggggctctggatcttctgaggagagatctgagggaggaagaagaaatctacagattaggagcctaggtggaaaagccagacacattataccaacttctcctgggctgagccttcataaaatgcctccctttggctggaagtgggcaacagaaactaatgcaaaatcacattccagggtcgtatgaatagggctctagatgacttgcctcactataccttttataatgtcttactttttcatttcctactgttttaaaatatgaggaaatcctcatgatatagtaagtggaaaaacacaatatggtctcttgactgtggtggcggatatataaaccaacgcatgtgataaaatcacatagaactaaacacacgtgtacacacacacacatacacacacgaatacaagtaaaactggggaaacttggacaaaattggcagattatgtcaatgtcaatatcctgattgtgatattatactgtagttttgcaagatgttgtcatttggggaaactgggtaaagggtacatgaaatctctgtgttattacttataactgcctatgactctacaatgatttaaaaataaacagtttttttttaaaaaaaacgtgactgtattaaagggctcaaccatggaaaaatatgtatttgtgtgtgtatgaatatatacacaaacatgcccacatgtgcacacacacatacacacacattttataaagggctgtttctgtctctttctttgagctgaccctgcctggttggcctaacctggcttcctgcctcctcttgcagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaaggtatgcaagccccctcccctgactacagtctaccctgagacctgacactctccccagacactgacaatgtttctgctgctgagactccattgttggcctggactacaactgagttgctgtcagtttatgtgctagatttggggctggtttggctggagtctcttctgttttcctactttcttctcttttcctggtgttttctgaggatgagaggaagaggataaggacagtggccgcccacaccttagtctggttgccctaataggcaagcactaggctgtgttattgaaacaaaacctctgggtgaagagggaagagtagaggtgaatgactaatgtttcttctttcccactctgtctgctgtggcacttgggtcctggttctccagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggtagaagagcagcctggagtgaaccatggggaggtgcctccatataactaggcttgggggaaacttcttcaggggtatggaaataggatctgcatgggaaaagaggagtggagaatgtggagctagggaatgggcttttcaacctctaagctgcagggaatgattaaaatgaataagaggggtctttctggatttgggcactcagggtagacaggggcaggggaagagtgactgtggcctggaattagggatgctctgctgtgacctttgggagttctgggggatggctaggagttgggtgacggtgggagaggctggaaccagagaaaagccagtccctgaggaagctcataaagattcccagaggcacctggggatcccactctaaatagctggaatgaatctactgacctcaccctgttctttccataggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcagtaaggataaaacagtgtggtatagtggttaaaagaacagtctctcggctgggcgtggtggctcacacctgtaatcccaacactttgggaggctgaggtgggcggatcacctgaggtcaggagttcgagaccagcctggccaacatgcaaaactccgtctctactaaaaatacaaaaattagctgggcatggtggcgggtgcctgtaatcccagctactcggaaggctgaggcaggagaattgcttgaacccaggaggtggaggttgcagcctgggcgataaggatgaaactccgtctcaaaaaaaaaaaaaaaaaaacacaatctctcaaatcggagagatctgggtctgaggcacagcacctcaacctaataactgtgcaggctcaaaaaaaaaaatagcttactctttctgaacctcaattttcccatctgtaaaaggaaggaaaaatattacctagctcatcaggttatgggaattaaatgactttattttttcaacaatatttattgagggccttctgtgggccagatactgctctaggcactggggctgcatcagtaaacaaaacacacagaaatccttagacagcttatattctagctggggaaaccagaccacaaacaaataagtaaaatatatataaggttacttggtgacaagggctatggacaaaaagcagggaaggcgtggatagggagtgctggacttaagcatggaggtgttgcaattttgaacagggtggttagcagaggcctcactgagaaggtggcaattgagcagaggtctaaagtagatgaagagatgaaccgtgtggatgatagctgagggaagagcataccaggcagagggaacagcatattccatacctttaaggtaaggatgtgtccaagaaacagtaaggagagcaaagtgtgggggagtaggggaggctggagcatgtaaggccttgtaggcaatgggaggaacttcagattttattctcagtacagtggagaaccatcggcagggtttgagccaagggatggcatgatctgccttatgtttcaacagagtcagggtgttgagaagagactactggggagcaagagtgggaacagggaggcctatttggaggtacattgcaataatccaggtgagggattatggtggcccagactagggggctggtagcagtggagatggtgagaatatacagacagaaaaatgagatatgcacacaaagcaatgagcataatatctggcacatagtaggagctcagtaaatgttaactgtggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagatctcaagattctacttgggtaaaggtgaacccttgggctttggcatcttgggtttaccctcgaaccctgcagcttcttgcatccaacctgtcacttgagtggtgtgcacatctgagtgtgggggtgggtgggtggtatagatgctggtactattgatgctattgtttgtagccaccaggctcagaccacatgctgggaccatcccaagatgacagagttataccaaaccctaggtaagaatgtgggcttcctgtatagggtgggcatatacacagctgcctttgtcctataatgtccatctacagatgaatggataaagaaaatgtggtatatccatgtaatggaatattcagcctttagaaagaaggaaatactgccatttgaaacaatgtggatgaacctggaggacattgtgctaagtgaaataataagccagaaacaaaaggcaaatactacatgatctcatgtatgtaaggaatctaaaatagacagactcatagaagcagagagtagaatggtggctgccagtggctgaggggaggggaaaatggggagatactggtcaagagtacaaagaagtttcaattatacaagatggataagtcctagagagatctacggtgcagcatattacctatagtgaacaatactggattgtatcgttaaaaatttgctaaaaaggtagatcttatgttaagtgttcttacagaaaaaaacaataaagagggtagttggaactttttggaagtgatggatgtactaatggcatagattggggtgatggattcatagatgcatacttgtctccaaactcatcaacttgtagacattgaatctgtaaagctttttatatgtcagctataactcaataaagtggttttaaaaagaatagaagagaatcgcagtcaataagcaggtgggagagggaatgagtgcctcatcgtttctccaacagcctgccttcctttatcctcgcacctttctcaactggaggctctacattcccctctggaccattttatcaccggattagtgcattattcttacagatgtgaagtctgatttgctttaaaagactgtccaggctgtgatgagcgtaactcttgtgtgccttatctttgcctactgtgagagactcatcattatgtttgttgcacattttatccatgctgatgcatgtgactacagttcattcttttttaccactatagaatgttccattgtatatagcacagtttctgctgttgacagacacgtgggtcatttcttgttttaagctaatgaggacagtgctgctgaggagtttcttatatgtgtcttccagtacatgtgtgcaaagatttctctggggcatgtttttcagtctgcaggtcataacatcatttcagtgtgttgtgacaaacatttaaaaagttgaaatagaccaggaaatattaatatgcaacagatccttagcaagagtcatagttgatattaattttgttgttttcactctatgcaatctagtaaggaattgcttcctgaaatgtttgatttagttatttttacatatatacatgtatactataaaatgaatttcatactgtaagtcttgatcaaaaagcatttgcaagtcactgctctgggatatatagctggctgggtggtgggatatgtgactgttccattttactaggtgataccaagttgttttcaaagatgattgtgtcagttcacactttcactggcagttctcattcatccccactcttgttgacacttgctattgtcagacatctattggttgccagtctggtgggtgtaaaatggtatcttgttgcggctttaacttgaatttttctgatctgagtgggtctctctccattctttgcagctgatctgaacaacattaagttctcagcttatcgcactgccatgaaactccgcagagtccagaaagccctgcgctgtacgtctcctgttgtacttccctatgacgttcaccacccctctcctgttcctcatctgtctgctgtttctcattttcctcccaccttggcaaaggttgttgattggcttggtggaaactctccaaagcctgcaatatgctagctgtcaacttctgctcttcccagttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagcatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggatgagggtcttagtaaaggacaagcttgtatcatatttgcaaatggttgatctggagattgagtcaaatttggtgatgctggtggctttatctccttatttaatccctggggttctacttttggctatattttttttctcttctcttctttccttaccagtggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgataggtaagggctttcagctctggaagcctccaggataaaattcaatgggatatctcaagtgggcctggtgggaaggtgttgctcccatagtagacttggacccagctcagcttggggcatggttggaacagggccctgctgggatcaactttgtgagggaaatgattgccaagatgttaaccctttacatacattcatattctcagtctcttctttttaaacctagtggtcgcagcggaaagatgcgggcattgtcttttaagactggcattgcatgcttgtgtggcacggaagtgaaggaaaaacttcagtgtgagtagaactccaaagtgtggagtggtgttgggtagagggaaaggtgttgcagggaggaggaagggtgtaagataagcagaaagtacatcttgtgactcagcagagggctacttgggctaccttatgatgcttcttggttcacactgttgcaaagaacacatgacagccaaaggacaagatgggcctaaggcctattactattcccagtgtcactccaacgggcttcattccttctgaattgatggaagtacttagtcaggatctatgttggcattttgaggtacccagggccctgatgttctagttgcattcccctgtggcctatcaggcttagccctcttccagtctgaagctcaagccatgtcactagagacttcttatatacacaggcagggcacaataatacccaatatctgggaggcggacactatgttcttctgtagtttttcacatctttggcttatagtacctttgtgttcccctctgtcctccatcttgtgttcagcattttgaacttctcagtagcagcatgattagttgttgagtcctaatatgtgactgctaaatggggtgagtgctaagttaaattagacgtggtccctgcttccaatgatttacagtccagaggaggagatggaagtacacagaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctctttttggattatgcatgccagtgtttccttccatttgtgtggacaattgagagattactgcagtgtcagactacataaacaggagagatggtatggcagcctgactgtgactcatgttcaggtgcccctgagcccgtaccccatcatcctgcttctggaagaatctgttttcccaacagtatcatatctgtgtctggcactgctcttacacacagtgcactcgacctctctctctcttgctttcactctctctcactctttctctctctgtctccccctccccctgatattctctctttgtgttggcctgatttttctctctgaactcagagaatgctctttttagaactcggctactagaaggtcagggatagacctctatgtagtccagtttgaaaagtcattagctcagtctgtgctctttccctattttccttttctgccctttctcctcaccattctccggccattcctgtgtcggggttggccattcttgacggtggggccagcagacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttgtgagtatggaactggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattcccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaatacatctgaggtctccttgattatattcctctccttccccaacaaaggtaaccactatcctggattggactttcatcataaaacactcaactttttacctttgtaaaacactaacccacaactctccctgtcatcaccctgcttttcgtaagatgagcaaatgaggcacacagctagttagtggtagatctagactagatattggatcatatgactcctctaagtctaggcatttcactgtcctatgctacaaggttgggcagttcagccaggctttggaagtagatctgaagggctattctttgttctgcaataataggtatattattatgaacaacctttggaaataacttttagccaacttagccaaggctggtagaaagaactgccttcatattggaagtgtaatttctccagggtaggtggtggtccctgggagcctggacctgtttgggccatccttgtttagaaggccatttgatatgatgagatatttacccctgcttccctcctgtctcccttaaacaaaggtggtgagacaatgctatttcccacacttcatgggaatctggccttgtgatttcatagagatttatggtctctagaataaagttattcatctattgagaattcagccactgctatgtatacgaggttgggcatgttatggctccatgcctcattcatccccttctactgtgtgtgtatattttaatgttaggggaacagcggggaggtcactgtggcacgttggactctctttcctactacatctcctctcccccaaggtaccggagtctgaagcaattcaacgttgacatctgccagacctgcttcttgacaggcagggccagcaaaggcaataagctgcactaccccatcatggagtattacacaccggtatgaagcctccaggctgggtgggagggttaggcagctctcaggtactaggccttgatccactttgcccagcattggctcattgttttctgctctcccgtggggagcattctccaaggagctctggtgattcactggtttgggaaattcaggcctctctattcttccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttcatttattatcattttaaagaaaacattagaaaagtcatacatggaaaactggctggatctggtagactgataatcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtactagctctctgccatctttccaagtcccttcctgttgcaagatcccatccttctatacacaactttgaggaacgaagaatatgccctccctcatctgaagttgcagaaaggagccattatcttgtgctcaagatgccaaagccctatctagtgctacactaaccctgggagacatcagggacttggctgaactatagccaagggaactccctggtatgacagcccagagaaggggccttgtgtctctagggaggtccccaccctgctcagaggtcctaggagcttctggctacatggatcaatctgccctgactgggacccagatccctctagaggaagaggaaacaaaggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacacccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctattataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtgctgggattacaggcatgagccactgtgcctggcctgaatccttttaatgtaacccaaatttttccaagaacacacaagatgcaagcagagagaatgcatagagaaaacaggagagggtatgacatgttcctgccctcagagacctttcaatgttggaagtggaaagaaatgtgtatcacctagtaaaagtattccagaggacaatgacactacatagagcgttggaggtctggaatagggatggtgaagaagaatacagggaagacatgactttccataaagtaaaggtggcagcaggtacctaaggagggtccaagcctcttatggggcatgaagtagaattcgtagtaccccttagagcagtgctttgcaaacagtagtgcataagatagtcacttgggaagcttggtaaaatacaaattctaagtcacaggtctgggtggggcctgagtttctgcgtttctcactagctcccagtggatgcccatactgctgttccacaggccacacttggagtagcaagtctttagaacagtgctactcagagtttggagagcagaccagggccagtttgtgaccagtttgtgaccagtccaaggcaagataaaaaaaaaaaaaaaaaaaaagagagagtaagcttttagaaacttttacagcaatttgacattgctatgatattcaagcaccaaattagtaggctcatctcgttgaatagggtagagaccagtttgagtgttgttgaacttgtgtgatgaattacgtggtgtgagctatgtactagtcatgtgcattgggaccacatactggtccacaacagagtgaaaaaaaaaaaaacctggatttttgccatgaatcatttgagaaacactgcctttgagcagcagtctgcaggccctgggaaacactgggctgagagtgactgttctgttgcaaataaagaaaaaacgaacaaagccaaaagtgatatccccaaaagtaggccacctgtttggaatttgtttttttgatgacccagcatgggtgttcaaagtgggccaaagaggaggattgtggagagaagaggcaagacaggtggtctcttgtttatgttatgttttcccttggaatctaaacatctaaaaatggagtaggtgagtcagtggccctaatgcctcctttatttgcagactgtgtttctgcctgattttaaggtcagaattaatccctaaagcagcacatcaaagccctgagacatttcttacgcaaaatgtcaactttctctgctctgaggtctcaggatggcagagtaaatgacatatgtgctggagaggaagtggatgtggccattcaagcaagagcacagctgggggtggggatgggggtgggggtgaggtagggtggaagagcacagggattgttcacacctaggcctgaggggacatctgaaacctggacagtcagagccctgttagagccataggtcttggtgtctctctccatggcaggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcaggtgaggatggagacaggaaaagagccagggtggcctctgagcccaggggaagggctggggagctgagggctgtggcaaagaagacacaagagagagctccttggcagtggctgtcaggtaacttcctgaagagaactgggcctgcggttggtgggggggcgggggaaagaagagactggtatggtcacatcttcagccaactctcttccacctaccttccatgccaccctgtgtgtcactctccagccactgtggggcctggggcagagagaagacttctgagggcttatttcttcacaacccattggaatcccatactaaaagaacaaacttcaaaaatcatctaaaacattgattttgctagtatggtatttgctagaaagaagtgggttgggacaagtttggcaagagaaagattagtgctatctaaaggtgtttcttgttactttttgcacctttcatctctgagaggcaatgtgtatgctgtggtaaagctctggagtcaggcagctctgggtttgcatgtggctctgccaattgactgtggggtgtttggacagttagttaacctctctaagccccagtttcctcatctgtacaacagagatggtaacagtaccaacttcatagaattgtggtgaacataaaaggagataatgcatttatggaatttagcatgatgccaggaatttagtacacacttcataaatgttacctattattgtcattatatgtaatggaaaataccactcttctgcctcttccccagatcctccaaggaatggcctctatggattcctggaggtttctaacatatgctatgtcatgaaccaaggatcaggtgtgaaactctacatttccagagagaattgtgttctaaatagcttaattatagctgaaatgacagcaagagacctttaggtacaatgccattctttatttaattaattaattaattaattaattttcaagacagagtttggctcttgttgcccaggctggagtgtaatggctcgatctcagctcactgcaacctccgcctcccaggttcaagcgattctcctgcctcagcctcccaagtagctgggattataggcatgggccaccatgcccggctaattttgtatttttagtggagacggggtttctccatgttggttaggctggtcttgaactcctgacctcaggtgatccgcctgcgtcagcctcccaaagtgctgggattacaggcgtgagccaccgcgcccagcctacaatgccattcttataagaactgggagcctttgacacatgttgttaaaggaagaaggtaatgggtaattcaatattctaagaagtttcctaaaagtggaagccactgttttaggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttt

SEQ ID NO: 3516 - DNA, 44552 bp, human
agcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcggtctgcttgcatgtgcctttagtggaaaacttgcatttaaaaatgcccacaataaagtagtcaccatttagattcataaagaaaaaaaaaaagatgcccaagaatagaaactcaagccgatttgagcaactaaggtctaaaaatgaataagaaggaggtacacagtttgcttctttgagaaaagaggggcatttatttattttaggttctcaatagcatgctttttgtccaagggtatacttcttggcaggagggaagcaaaggtgtgtggaaagccttggctaacaagggaggagagaggaaacatgggaccttggagcaggttccctgaacaaatgagtattctggccagcagacaggacacaggagttctttgctgaagtaaaccaggctctgacctaagagcctggagctgaagggctcatctcatctctgtatttacttcctggctctgttgtttttcctgtgacatttttcccccttatcttctcccctggtttcctttctacaccctgtaatcaggaggcatctttccactcttgaaagcatagcttggagtggtttcaaatagggcttgcttctcttggagtccaacaccctatcaccttctgctctcaccacctttcccagcatcggaccaagtgccccagcctagtaagtgggcctgagactatatgggtagttaatgtttatccttcctttggtaggcaggtcgagccaggcctcacaggtgttgggtctaagcaggtggcaaggctgggctggggtggggtggagtggggtagaggagaacgtcagcagcagctgctgcctgcttccgttgaaagcatggtgcatgctgtctggaaaagaacatactttttaaaaatgttttctttttgattgtcaaaagaacaaaagccttaaaaaagctctatgtctagttcatcttaattcctgacttttccaaagaatccttgtttctagatgaaaggccctcaggtaaatcaccttttaaaaggcctgtgggaaccacaagcctcaggtgattttccttctaaggtttgcgtggggagatgatcccagagaatctcagggccttctaaggaaacctccgtgaaaaggcagtgttggaagtggcagtgttgtgtcctgtttctgaaagaagaccaagcccctctgtctctgggttggcaggcctctgtcctgtagtcttgctttctgtaaaccattgctgggggatgaaggcacatggaaagaactcctcttcctgtgagatttgtacttctaggcattcagcctcagctaagtagctctgtgctccaggtcagattacccttcaagtccaccataaaggaggggagcatagcttgaagcaatgaatttagcaaaggccctgagccagatgcggagagcacatctgcgattcagcccttctaactatggatgctcagaagtttctgatgttggatctgccaccatgccagctaggatggggtctcactaatgaaggccaagaagatagtcttctaaacttctcagggatacacactcagaggaaacccattcagtggaaattatactatgaaatgacattcctcccttatgaaggattctaaacatgcatcagcaacaaaaatagcaagtgagataaatccttctaggatagcatttaccaaaccaatgttctatagagccccatcctgagagaatgttaatagattctgttttaaaataagtgttgggggtgtgtgtgtgtgtgcatgcatgtgtgtgtattctgcagttcaatacttttttggaaatgcttcttaaccgaattctcattttggagagtcacagtgtatgtaacgcatattaaagactctgagaagtactgctgtaaatgaatgtttaattttgtttaacccagtacatcccagactggtttgaccagggaacacttttctgtatggaaaacactttttgcctcttgcagatacagtttggggaactgctgctaaaaaaaaataataaaataaaaaataaaaaaataaaaaactggaagaaatcgtcacatggataacacttgtaaaataatctagtccaacaatgcatttctaaacatgaaaaacccaagaggttaatcatattgttttccttcccatagctgatgagaatctgggattatctcctgattccccagcccactgtacccaactgctgcttctctagcaggtcccctcctgtgaaactagttccaggaaaatgaagcagatttaaggaataatccttaaattttgagtgcaatatttacatttaatacatttcttctagtattttgctatatgcaaaaattgtcaactttcttttcagcatgggctttgttgcattcttttaaacaatgtgttatgaaatatctttgttcattcaaaaaggtataaaaataatatggtgaaaatcaggttattcactgcccagcttaataaagaaacattaccagtagagttgaaaccttctgtctattctccatgattaaagttctctctttccttccaaagtaaccactatcctggatttggtgtttattattcccatgcattgatttatatacttttactacacatgtatatatttttaaacaacatatactactgctttatatgttttaaaagtttgtatcagtggtgtatcatacgtattcttctgcaacgtgatttctcttttcttttttctccccgccaagagacgagatcttgcactgttatccaggctgaagtgaagtggtgtgatcatagctcactgcagtctcgagctcctgggctggagcaatcctccagcctcaccaccccccaggtggcaccaccatgcccagctaattttttttccttcatagagacagggtcctgctatgttgtccaggctgatctcaaactcctggcctcatgtagtcctcctgcctcagcctcccaaagtgttgggattacagccatgagccactgcacctgccttgaaacttattttttctattcaatgttatatttgtgaaaagcatccatgttgtaacacgggtctctagtttactcatttttttcactattgtatactcctgtaatgactataccacactttatctattctgctgttgatggacatttaggctatttctagttttgagcaatcacagaggtactgtgatcattcttgtgtagctattcttaggtgacaatttctactgggtaaatatctgggtggaattgtccccttacagggtatgtgcattgtcacctttgggagatattgtcaaatcactgtgcaaaatagtttactaacttacactcccaccatcagtgtataaaggtttcaggtttattgcattaattggctcttagagttttctcccatggggatgcatctctgattttttaattggataataaattttatttctcaaaattgcttgacagctaaacttctcaggaatacgtttccttgttttcatttgtaaatgaggggattggcctagatgatctcaaaggtcctttctagcttgaaaatctgagtttctatgatttattcattaaatcaggtacatctgaagcagaaccttggttttttgggtgcattgcaggaattattttaggaactataacaaagtttgttaccagtgaaatgtgtatcttctctcttactgccatgctgtcaggtagaaagccagtggtatgagagaaaaggcagttacacagtgttaccttggattggggagaggattctgtagcccatgggaagggggtcgccttcccattgccctgttctttacagaacctctacatcttagaagtcttccctatctcttgaattttttctcccaagaataataaatgtttgctgggttttttttgttttttttttttttttttttttttttttttgagatggagtctcgctatgtcacccaggctagagtgcagtggcacaatctcggctgggaggctgaggcaagataatcacttgaacccaggaggcggaggttgcagtgagccgagatcatgccactgcactccagctgcactccagcctgggcgacagagcgagactccgtctcaaaaaaaaaaacaaaaaaaagcccaaaaaacccggatgtccaggcttcctttctgcgcatgcgcacagtagattttttaaaaatgtttttacaaaattggagttccactaagcatgctattctggcatttgttttctttggcctaaaatatataactttgaaatctgtccaaatcagtgcatatagatctacctctttctttttaacagctacataatattcgccgtgtgagtggctatcgtaatagataacatttgaatatctactaaatgccagaaactatgaattaactcctctcaacaaagctaagaggtaggtctttttgttatccctgtttcacagatgtggggactggagcacagtaaggttggggagcttgtccatatatgtgccgataagtggccaaggtgcaagccagagcatcctggttcagagcctatgtcccagacaataatgctgtgatatgtctcagacatagtctactcaccagtcccccgctggtggacatttgagtgaatgcagatttttgctattgcaaacaatactgcagcaaacatctttgtccacttctggaggtctttttgtaacataggctcttagatttctctggtttctaggtggaaagagcttatttattgaaaaaaaaatttattgagctctaggcattggggaggctctgagcttaaaataggagacttgaccagaatttcacttctcagatgtcctataaaggtcacttaagtgcttttcatgatttgccagcctggtgctgccccattagactcactgcatcttatctgtttttaattgcttgtgtctttgcctgggtagtggcataactgagtcaatgcttgggctcgcacctggtggtctatagccaaaaattgtctccattgtatccattgtatggatacactttccaggtatcagtgattacaatgcctcagagcctgggttctagaatttacagaggcagaatagcataatgataaataacttgtattctgagacacaactgcctgggtacaaatcccagctcttcacgatgtattcacaatatgactctgaacaagttacttaccatctctgtgcccccattttctcatccacacaatgaggatagcaatagtaactactttatagggttgttgtaaggattaaatgagttaatgtatgtagactgcttagttaatatatataaaacacagaatacagttattatttatttgattatggaaaagctggcacaccaatctttccataaaatagttgttgacctccttgtattttggtggggagcggagagggggcgaagaattagctgttattaaataggtaatgtgttcacatgggtcaaaattcaaaaagtacaaaatgatatttagtaaaaaattttatctcctattggcaacatggggcttatgtggtgtggggaataattctgtttctcaacctgagaagtgattatatgaatttactttataataatttaatatactttacatatatgctttatgtacttttataggtatatttctcattttgaaaagggcagaaatagtagaaatcccaaagacatggggagaatttttactgctcagttcccttctccaatggtaacaggctcttttgtatacttccaaagatatttttttgcatctataagcacatatttttagtatacaaatgtagactaaccaccaccttgatttttctcttgttttctttttacttaaggtatatcataagagatcattttgtattggcatataaagagttcttaattattttttaagtagctgtatagaattccattgtatggatacaccattatttaattagtcccctagtgatagacgtttaagtttttgcaattttttttgccatttcaagccttgtttcaaatgctgacattgtacttattattgtacttgtttcaaatgctaacattgtacattattccacacaaatttaagtagcatatgttcctatacatctccagtttatgggtgcctagcactgtgttaaaaatatgtgggatataaataaatatcaggtgtgggttttgtcccccatgagccaacaatcttgctttcatgctgaaatcctaatatctcccctgtgtttttaaagctttttatctctgctcaagagaaacaatgccttcccactgaatcctcctcaaacagcctgtgtatggcttttagaaccaggaagagtatttgtagtagcaaaaagccacagtttggtatccagcagggtccctaggggagggcagggaaggcttattgccacccaaaaagcatcctccacacctgcatatgtcaaaatcttctctttcaccttagctcgaaagcttcttttccataaatacatcccaaatccctccaactagaagtgaacacttcctcctctgtgacctcttataccataatttctgtgtcttgctgtctcagtccattttctgttgcttataacagaatacctgaaactgagtaatttataagaaaaggaatttatttcttacagttatggaagctgagaagtccaagtttgaggggctgcatctggtgagagtcttcttgctgtcataaactctctgaagcatcccaagatggcacggagtatcacatggctagagggcttagtgtgctagttcagatatctcttcctctttttataaagccatgaattctcctcccgtgataacttattaattcattaatccatgagtggattaatccattcatgagggcaaagccctcatcacctcttaaaggctccagctctcaatactgtcacattggggacagatattcaaaccacagcacccacgtatggtatgaataattttccccgctaaaattatccttttttttgtttgtttatatgtcttgtttcctacatttgaccagttggggaccaagtctgattcatcttcaatctctcatagcctttgcaaattaaaaagaggaataggaaaaaaatcagtatgtgcagatggtgatttgagataggatggagctagatagaggcagaagaatctttgtgtataacaaagagtactcgcccaggaatcaggaggccctggttcacttgtgtctcagcatcttcatctgtaaagtgggatcttaattctgactgggacaactttactaggttgtactgaggatcatgaaagacagcacagccgactacaaaggcatgctatatgaatacagagaatgatagtgtttggtgcttagcaacccttaaacattaacacttgatacattagcaaactaaggcctagagaggcaatatgacttgaggtcacagtcaggggcaaagtctaaaaagagcagaggatagtcattttaggaccagaagaaatctattccttttctgcctgtgttaggattagaaggtctgaattctctgactccttggtttatcttagttttgttttgtgaagccttaacctagcatcaggtcagtagaggaataagaaagaatcttataatctggagagaaatgaatctcaaaagagaagaaaagagatagttgatgaaagaagagatacaaacgaccactaaaagtgtggaggaaaagctaaatatctttagcaattaaggaaacgcaaagtaatcctcaaaatgccattttcacttacaaagttggcaaataaagtaagaatacatactgtggacaagtgtgctgggaaactggcactctcatacattgctagtagtagtgtaaaatgatataactttttctagggcaatttagacatatgtatcataaacgctttgatccaggaattctcccttataggcaattatcctatggaaagaatcacaaatatgcacaaggttgttcactgcactttgatttataaaaaagaagaactataaacatatgtctaattgttaaactatggtgtatccattcagtgggatactatacaatgacgatagctaacacttattgagttgtgtattgttgccagacactgtgctaagttatttaaattattaactttaatcattagaataattctgtgaggatgctatcattatttatccccattttgcagatgaggacactgaggctcagagaggttaacttgtcctggaccacactgctaataggttgaatagtgtggatttgactctaggtctgtctgatgccagtgcccatggcctcagtcacagtgctgtacttcctatgcagctgttaaaaatcatgttttaggctgggcgtggtggctcacacctgtaatataaacactttgcgaggctgaggcaggctgatcacttgagctcaggagtttgagaccagcctggcaacatgacaaaaccccgtctctaccaaaaatacaaaaaattatccaggcattgtggtgcacacctgtagtcccagctacctgggggtactgaggcaggaagatctcttgagcctgggaggttgcagtgagccaagatcacgccagtgcactccagcctgggtgacaaagtgagagaccctgtctcaaaaaaaaaaatcatgttttaagggaatagttaatgacattctaaaatgaccatgatataatggcaagtgaaaaaagcaggctacgaaatgatagcatgtgatggcgattttattttaaaagtgtatgtatatatttttcagagaaaaactaaagttcatagctgttagtaatgattatctctgggtggtaatattacagattatttttattttcatccttattattttttgtatttcccagtttttctatcaagaacatgtattacttctataatcagcaaaaataaaaatgttaacataaaaagaggtctgaaagcaagcctcttgtagcctttatgcttataacacatccatagcagtacttcattttttaatctaagtgactaatgcttttgtggtgtctgatcacagaggagccatattttcagtcattctttggggatgagtagctacatagctgtataatctatagggactttgactacaacaaagtaccctttagaccacaacctcttgtgcccttgtgatttgtaataatctccattctttggactatggtctcctgaggaggaggggtgggtacttaatgcaaggagtccacatatctttaaatgcataaatgtttttctcactcggtaagttctaaaagtacagctactattgtgggtgagagtgggtgaagtgagattttttttttttagtcttaagaagggcctcttatatctaaaacattgtgaaccactggaatagagtctaaaaatggtggttatttaattatctgcatcatgaataaaagatgctcagttccggccctttgaatcagggtttgtgtgtctttgccccacactaaaagagatcaccttattatttgcaagcatcatctttgccacccattctcatcacatttgtttacattctctaaaccatcaattggtttgtacatctaaactttgtccccatatttctcctttactaagcttagctctttacatctaaagctgaatatgtctcaagcatagcttattatgcaacactgcccctattccctacacagcaaatttactctttctcctgtcttccttctcttgctgttggcaacattatccactcagctcccaaattagaaacctttgactccttctcctcccttactgttcacatccaattgatcatcaagcccagtgtattttacctctccaatgtacctcagagtcatgctgtctgcttcatcctcacggcaactgcctgcctattctaacagcttctcaacaggttcttccttttggagaatcactctataaggaaggcagggggctctttctaaaatgcaaatctcggccaggcacagtggctcatgcctgtaatcccagcactttgggaggccgaggcgggtggatcacctgaggtcaggagttcaagaccagcctggccaacatgacgaaaccccatctctactaaaaatacgaaaaattagtggggcatggtggcaggcacctgtaatcccagctactcaggaggctgaggcaggagaatcgcttgaacctgggaggcagaggttgcagtgagctgagatcgcgccactgcactccggcctgggcaacaagagcgagactcccgtctaaaataaataaataaataaataaaataaaatgcaaatctcattatgtcactccctgcttaaaatcttcagtgcctccccattgtctacaagataaagcctacaatcctctgcttgtcattcaaggcatggcccaatgtggccacagcctcacctcctgctacacacaacaaggcacctaccttgtactctggtcacacggaacacaccatatatttaattttcatgtttgtattttttttaaccttcactgcctaatgacaaatctgtttctctttcatgactcacctcaagcacatttcctctagggagacttttcttgacatgaccagatagaactcacgattccctcatctgtctcttcacttcatcccataaacaattccattatgacctcaaataacactttatggccattattttctccacatttgttctctctgtatgtgatactcctcaggggaagcccccatgtctttttcatctctgtgcctcttaaactctaaccataccgatcccattgtcctctgaacatgctaggcctttttatgacatccacctttgcacaggtggatctgtctgctgggaatgccattctccctttctcctctgcacaagcaaatatctacttatcttttgagactcatctcaagtgtgctctttctgaaatacgtgcatattctcagagttagctgttccccactctgtgctcccttagccttttggtaaactcttgattttagcatttgctatgtaagcattttattataattatcagcatacatgactgcctcccctacccatcttgcccacctccacccttaggctttgagatctcagcagttatctttatgtctctagcacaaagcactataggtaaacaataaatgcttccttggtcaataattaaataaagtattttatggtacatggtggcctgggtaggtcagtaagttttgaatacttatttgtatatctggtcaaggcacctctgggtagatgcttgattcataggcttttctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggtaagagtctgatagtgaaagaaagacctgtggagaaagtggacacaggatctgtgtgtccttggggtacccacgcttcctaaggctcaggggcactctctgtatacatgcaaccccttggatagcatggggaatatattgggcccatcctttattactcattatgtcttttattggggggcataaggaaaggaagggtgttgggctgggcagctcagagggcccactgcagctgagcggggctggttccatgttaaccttctaagagttacaggtccaggaatgtcctagaagagtatgatccttcagggcatggtctaggactaggcaggtccttcctttggcttggcttctctgtggcatgccttccattttccacaggtgtctctctcctgccatcggcttttcctctcaagttcctagcctttttcatagctcctggctcatccccacttagaattccatgagctccatatctgcctgtcctctctgctcctgtagtagtgcgatggtggtggtgtatgtgtccgcctgtgtatgttggtaggcaggtagaggatgtgtgtgagacagtagagagggcagccccctttcccgacaatgagggaggtctagggaaagttgactggagaagggagacgcataagcatactttggttgccctacaatgctttggggtccagagactatgggggtgtgagaaagtgctatgtctcctggagcctcacagatgggctgcagtgctgagtcactgctgggaggcaggcagcggccgaatatacaggaaggaggaagggaggaagaaaggaagtggggatggagaatgtggatgctggggagcctgttttgggggcagtaatgaaggaaagtcaaggtccagagagacattagagtcaggtccccctgagctattttccccacatccagctagaaagaaattactgcctcgaacatattctcaaagcgagagtcaacatagactcccccattaacctaccccttccccggagtgggactttcacagggtcgagggattaagaaaactgagcccttccaaaggcttaccctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtataccgggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctccaccccagaaccccagaaagagtcaggcagctgttccaactattcctgtaggtggacctcagcatggaaacaatgtggaactgttggaaagcccagaagactctgtgggagataaataaggatgggaacagaaccctttttggtaaaaacgatgtgttttccctcagtgctgagggatgggggaccagcttgggaatgttaacctttccccagacaagtctgctggaaaaggagaagagtggccacttccaggaggggccctacccctcaggccagtggcttacaggaaagggccttcccctgcccccacccagggtagcacaggcaggacacaggagcctccctggcaatggctgcctacatggaactgctgggtcccagtgacccctttccctcccctgtgaaaattcaacgggatgcccactaactatccatttccctttggcctcagggtacagcgagaggtctgagggctatggctctccctccactcctctctgcctctcaaaggcagggcagagcacccctccattttcacagtagactctgacgaatctcctggcctctgcactcacccaaggataatcacatttagagggattctgctgcgcctgcttgccgatgctgccatcccatggctctgtccccagatgtgccacaaaccttcctcactgtctctgaggaggcttacttagttgaagacaaggcttattttccaagcccatcctcttatgtcttagggaaattgcttaccagaagcttgtcaccaaagtggtctgatcttatcctccacctcaggggaggggtgggcctagaggcagagtgagccctttgtgtcttccatggaaagggaaaataaatcaacagaagctgccctctgcatgcccctcctcagcaccatggaatgcccagtcccactcccgccatccttgccagcctgagagggccatcctggccctggtgtggcaggcccagttgggagtgaaccggaattctccagagacaaagctctgattcaccagccaggccctgacatagccgccccctccagattcctggggggtcagtaaacaaacagggtgacccctgcctcctggcctggctcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggaaagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttaccagtgcccaggagagcaagcaatagactgtgtgcctgagggctcaagactagactttggcaggctccatggcttgtcctcttggccatcaactctggtcagagtcctctgctcatctttatgagcagttctcttgaagactgtgtccaggcttcctgactgtggtggacacatcaaagccaagtttcatatgggaagtaagacgtggaccactgatagttctctcttgccagtctactccctctataaatctttatggagaaactcctcagcttgcttttctagaaggttgggtaaactgtaggaccctgaagtatgagccaacagcttacctgcaatggtatggttgcccataatttgggcaattctgtgcagcttcttacctaatgcaggtacttccaagaccccatctgggcagtggtcctgaggagtgggggcccagcttgggaatgttaacctttccctaggtccaaaatttataatcatgagtaacaataatagtaggcagcagttctatgtaactgacctgtaccaagagaagacttggcaatgaacaggaccacagggtctttcttcatctcagtccctgaacacacagagaatagcatttctgaaccctggcagcaacccttctctccccttgttcacacttgtctcacccttggcttggtgcagaccagggtgtggcacaatccaaggatcacaggatgtttgtgtttctgtccaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccctgaatactttgtttgagttctcgaaatgttagcttccatttgttttttataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttggaaaaaaaaatgttttgccacttaaaaagaagactgaacatcactggttttactcattgtgtgcagcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggtaggttagaatcagagaagccgtggtgtgtagcctctcagctggggaggaatcccttcttcagtaccctgacagacacccagctctgctgagacacctaaatgaataggaggctgtatgcagtcctattagtctgtggctagcatgccacagcctaagtcaaatattttctttctacccctcccatcaaattctagcctcccttaaaatactgccatgatttttaatgggaacatggggaaatgaacataacataatgctaagtgaaaaaacacaggatacaaaactaagtgcaagtggatctcaattgtataaaaatgtatatagatgagtgtgatgtttacatacatataacagcataggaaggaactatatcaaaatgttaacaatggttaactctaggtaataaaattggagttcttaattttcttcatatctttctgaaatttctaatatttctgtgatatatattactgctgtagttaaaatacttcttaaaatgactacagaatgaaatataatacagcaataaaataaactataaccacgtgccacagcatgggtgaatcttacagacagacaatatgttgagtgaaaaaaagccggatacaaaaagagtatatactgtatgattccacttatacaaagtttaaaaataggcaaaactaatcagtgattttacaagtaaaaattgtggtcacctttgtgggaggggagggaggggtggggcatgaaggtgagatagtgactaggagggcccacctgggatgctgatagagttctgtttcttgatctcagtactggttacatcaagatgtacagttttagtttgtgtatcccgtatatatttcaaccaaaaatttaattataattttaatataaatcctgcctatcttggttttgatttccataagacccttacaggaagctttctgagtcttctggagaaccaagatccccacatttttctctatcctgtggcatagacagacaaatttcatactaaacagaccttccagtgtcagagttatttttctgtctatcaggaggattgcacgcctttttgtctaggtagttcaaagatacctgataatgccaaagaatcaagacacactgagaagaagaaaggttgtcaattgcaggatggaatgtaaagtgattgaaaaactttcctttcctgttgaccatattgctaaactttataggcctttatggaagaagtcaagtctcggggcccctacatctattctgtgctggagtcagctcaggccttcctgtcccagcacccatttgaggagttagaggagcctcattctgagagcaaaggtaggtggtcttctgtttttcccacttcttcttgagccatgtactgctgaatgctgaacaaacaccctcctgccttccccaaactcattttcttacctgttatctaggaggatagtttcccccaggagtccatccaaagttggggggaagcaagattcctactgcaggaaaaaaagcaaagagaatatagcctggagcaggggtcaacagttgtgtgacccaaagctgtatgtggctctttggagcagcatgtgtggccatttaatgagatgtggaaaagaaaaacaaaaaaccactcaaatgaattgaactgactcaatgaataaaagtaccagtatgtcctttaaaaacatagtgctggctgggcacagtggctcatgtctgtaattccagcactttgggaggctgaggcaagaagatcacttgtgcccagaaattcaagactagcctgggcaacatagtgagacccccatctctacaatttttttttgtgggggacggagtctcgctctgtcgcccaggctgaagtgcagtggtgtgatcttggcccactgcaagctccgcctcctgggttcatgccattctcctgcctcagcctcccgagtagctgggactataggcacctgccaccacgcctggctaattttttgtatttttaatagagacggggtttcactgtgttagccaggatggtctcaatctcctgacctcgtgatccacccacctcggcctcccaaagtgctgggattacaggcgtgagccaccacgcctggcccaaaatttttttttaaattagctaggttttgtggtgtgtgcctgtagtcccagctacttgagaggctgaaatgggaggatcacttgagcccagaagttcgaggctgcagtgagctatgattgctccactgcattccagcctgggcaacagagcaagaccctgactctaaaaataaataatatacaataaaataacaaactaaaataatcataatttaaaaatactgctttattccaacatcgagggacatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcatcctgagtagctgggactacaggcgcatgctaccacacccagctaatttttgtgttttttgaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaaaggacccttcatgaattgagccctttgtcaatgccatatgcccatctcagtttatttctggcccttcaatgggagggctagtacttaatttgatgcccgatgggcctcagataggacaagctctagaaagagcagcacaattctagttagcctggggctatggggctctggatcttctgaggagagatctgagggaggaagaagaaatctacagattaggagcctaggtggaaaagccagacacattataccaacttctcctgggctgagccttcataaaatgcctccctttggctggaagtgggcaacagaaactaatgcaaaatcacattccagggtcgtatgaatagggctctagatgacttgcctcactataccttttataatgtcttactttttcatttcctactgttttaaaatatgaggaaatcctcatgatatagtaagtggaaaaacacaatatggtctcttgactgtggtggcggatatataaaccaacgcatgtgataaaatcacatagaactaaacacacgtgtacacacacacacatacacacacgaatacaagtaaaactggggaaacttggacaaaattggcagattatgtcaatgtcaatatcctgattgtgatattatactgtagttttgcaagatgttgtcatttggggaaactgggtaaagggtacatgaaatctctgtgttattacttataactgcctatgactctacaatgatttaaaaataaacagtttttttttaaaaaaaacgtgactgtattaaagggctcaaccatggaaaaatatgtatttgtgtgtgtatgaatatatacacaaacatgcccacatgtgcacacacacatacacacacattttataaagggctgtttctgtctctttctttgagctgaccctgcctggttggcctaacctggcttcctgcctcctcttgcagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaaggtatgcaagccccctcccctgactacagtctaccctgagacctgacactctccccagacactgacaatgtttctgctgctgagactccattgttggcctggactacaactgagttgctgtcagtttatgtgctagatttggggctggtttggctggagtctcttctgttttcctactttcttctcttttcctggtgttttctgaggatgagaggaagaggataaggacagtggccgcccacaccttagtctggttgccctaataggcaagcactaggctgtgttattgaaacaaaacctctgggtgaagagggaagagtagaggtgaatgactaatgtttcttctttcccactctgtctgctgtggcacttgggtcctggttctccagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggtagaagagcagcctggagtgaaccatggggaggtgcctccatataactaggcttgggggaaacttcttcaggggtatggaaataggatctgcatgggaaaagaggagtggagaatgtggagctagggaatgggcttttcaacctctaagctgcagggaatgattaaaatgaataagaggggtctttctggatttgggcactcagggtagacaggggcaggggaagagtgactgtggcctggaattagggatgctctgctgtgacctttgggagttctgggggatggctaggagttgggtgacggtgggagaggctggaaccagagaaaagccagtccctgaggaagctcataaagattcccagaggcacctggggatcccactctaaatagctggaatgaatctactgacctcaccctgttctttccataggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcagtaaggataaaacagtgtggtatagtggttaaaagaacagtctctcggctgggcgtggtggctcacacctgtaatcccaacactttgggaggctgaggtgggcggatcacctgaggtcaggagttcgagaccagcctggccaacatgcaaaactccgtctctactaaaaatacaaaaattagctgggcatggtggcgggtgcctgtaatcccagctactcggaaggctgaggcaggagaattgcttgaacccaggaggtggaggttgcagcctgggcgataaggatgaaactccgtctcaaaaaaaaaaaaaaaaaaacacaatctctcaaatcggagagatctgggtctgaggcacagcacctcaacctaataactgtgcaggctcaaaaaaaaaaatagcttactctttctgaacctcaattttcccatctgtaaaaggaaggaaaaatattacctagctcatcaggttatgggaattaaatgactttattttttcaacaatatttattgagggccttctgtgggccagatactgctctaggcactggggctgcatcagtaaacaaaacacacagaaatccttagacagcttatattctagctggggaaaccagaccacaaacaaataagtaaaatatatataaggttacttggtgacaagggctatggacaaaaagcagggaaggcgtggatagggagtgctggacttaagcatggaggtgttgcaattttgaacagggtggttagcagaggcctcactgagaaggtggcaattgagcagaggtctaaagtagatgaagagatgaaccgtgtggatgatagctgagggaagagcataccaggcagagggaacagcatattccatacctttaaggtaaggatgtgtccaagaaacagtaaggagagcaaagtgtgggggagtaggggaggctggagcatgtaaggccttgtaggcaatgggaggaacttcagattttattctcagtacagtggagaaccatcggcagggtttgagccaagggatggcatgatctgccttatgtttcaacagagtcagggtgttgagaagagactactggggagcaagagtgggaacagggaggcctatttggaggtacattgcaataatccaggtgagggattatggtggcccagactagggggctggtagcagtggagatggtgagaatatacagacagaaaaatgagatatgcacacaaagcaatgagcataatatctggcacatagtaggagctcagtaaatgttaactgtggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagatctcaagattctacttgggtaaaggtgaacccttgggctttggcatcttgggtttaccctcgaaccctgcagcttcttgcatccaacctgtcacttgagtggtgtgcacatctgagtgtgggggtgggtgggtggtatagatgctggtactattgatgctattgtttgtagccaccaggctcagaccacatgctgggaccatcccaagatgacagagttataccaaaccctaggtaagaatgtgggcttcctgtatagggtgggcatatacacagctgcctttgtcctataatgtccatctacagatgaatggataaagaaaatgtggtatatccatgtaatggaatattcagcctttagaaagaaggaaatactgccatttgaaacaatgtggatgaacctggaggacattgtgctaagtgaaataataagccagaaacaaaaggcaaatactacatgatctcatgtatgtaaggaatctaaaatagacagactcatagaagcagagagtagaatggtggctgccagtggctgaggggaggggaaaatggggagatactggtcaagagtacaaagaagtttcaattatacaagatggataagtcctagagagatctacggtgcagcatattacctatagtgaacaatactggattgtatcgttaaaaatttgctaaaaaggtagatcttatgttaagtgttcttacagaaaaaaacaataaagagggtagttggaactttttggaagtgatggatgtactaatggcatagattggggtgatggattcatagatgcatacttgtctccaaactcatcaacttgtagacattgaatctgtaaagctttttatatgtcagctataactcaataaagtggttttaaaaagaatagaagagaatcgcagtcaataagcaggtgggagagggaatgagtgcctcatcgtttctccaacagcctgccttcctttatcctcgcacctttctcaactggaggctctacattcccctctggaccattttatcaccggattagtgcattattcttacagatgtgaagtctgatttgctttaaaagactgtccaggctgtgatgagcgtaactcttgtgtgccttatctttgcctactgtgagagactcatcattatgtttgttgcacattttatccatgctgatgcatgtgactacagttcattcttttttaccactatagaatgttccattgtatatagcacagtttctgctgttgacagacacgtgggtcatttcttgttttaagctaatgaggacagtgctgctgaggagtttcttatatgtgtcttccagtacatgtgtgcaaagatttctctggggcatgtttttcagtctgcaggtcataacatcatttcagtgtgttgtgacaaacatttaaaaagttgaaatagaccaggaaatattaatatgcaacagatccttagcaagagtcatagttgatattaattttgttgttttcactctatgcaatctagtaaggaattgcttcctgaaatgtttgatttagttatttttacatatatacatgtatactataaaatgaatttcatactgtaagtcttgatcaaaaagcatttgcaagtcactgctctgggatatatagctggctgggtggtgggatatgtgactgttccattttactaggtgataccaagttgttttcaaagatgattgtgtcagttcacactttcactggcagttctcattcatccccactcttgttgacacttgctattgtcagacatctattggttgccagtctggtgggtgtaaaatggtatcttgttgcggctttaacttgaatttttctgatctgagtgggtctctctccattctttgcagctgatctgaacaacattaagttctcagcttatcgcactgccatgaaactccgcagagtccagaaagccctgcgctgtacgtctcctgttgtacttccctatgacgttcaccacccctctcctgttcctcatctgtctgctgtttctcattttcctcccaccttggcaaaggttgttgattggcttggtggaaactctccaaagcctgcaatatgctagctgtcaacttctgctcttcccagttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagcatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggatgagggtcttagtaaaggacaagcttgtatcatatttgcaaatggttgatctggagattgagtcaaatttggtgatgctggtggctttatctccttatttaatccctggggttctacttttggctatattttttttctcttctcttctttccttaccagtggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgataggtaagggctttcagctctggaagcctccaggataaaattcaatgggatatctcaagtgggcctggtgggaaggtgttgctcccatagtagacttggacccagctcagcttggggcatggttggaacagggccctgctgggatcaactttgtgagggaaatgattgccaagatgttaaccctttacatacattcatattctcagtctcttctttttaaacctagtggtcgcagcggaaagatgcgggcattgtcttttaagactggcattgcatgcttgtgtggcacggaagtgaaggaaaaacttcagtgtgagtagaactccaaagtgtggagtggtgttgggtagagggaaaggtgttgcagggaggaggaagggtgtaagataagcagaaagtacatcttgtgactcagcagagggctacttgggctaccttatgatgcttcttggttcacactgttgcaaagaacacatgacagccaaaggacaagatgggcctaaggcctattactattcccagtgtcactccaacgggcttcattccttctgaattgatggaagtacttagtcaggatctatgttggcattttgaggtacccagggccctgatgttctagttgcattcccctgtggcctatcaggcttagccctcttccagtctgaagctcaagccatgtcactagagacttcttatatacacaggcagggcacaataatacccaatatctgggaggcggacactatgttcttctgtagtttttcacatctttggcttatagtacctttgtgttcccctctgtcctccatcttgtgttcagcattttgaacttctcagtagcagcatgattagttgttgagtcctaatatgtgactgctaaatggggtgagtgctaagttaaattagacgtggtccctgcttccaatgatttacagtccagaggaggagatggaagtacacagaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctctttttggattatgcatgccagtgtttccttccatttgtgtggacaattgagagattactgcagtgtcagactacataaacaggagagatggtatggcagcctgactgtgactcatgttcaggtgcccctgagcccgtaccccatcatcctgcttctggaagaatctgttttcccaacagtatcatatctgtgtctggcactgctcttacacacagtgcactcgacctctctctctcttgctttcactctctctcactctttctctctctgtctccccctccccctgatattctctctttgtgttggcctgatttttctctctgaactcagagaatgctctttttagaactcggctactagaaggtcagggatagacctctatgtagtccagtttgaaaagtcattagctcagtctgtgctctttccctattttccttttctgccctttctcctcaccattctccggccattcctgtgtcggggttggccattcttgacggtggggccagcagacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttgtgagtatggaactggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattcccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaatacatctgaggtctccttgattatattcctctccttccccaacaaaggtaaccactatcctggattggactttcatcataaaacactcaactttttacctttgtaaaacactaacccacaactctccctgtcatcaccctgcttttcgtaagatgagcaaatgaggcacacagctagttagtggtagatctagactagatattggatcatatgactcctctaagtctaggcatttcactgtcctatgctacaaggttgggcagttcagccaggctttggaagtagatctgaagggctattctttgttctgcaataataggtatattattatgaacaacctttggaaataacttttagccaacttagccaaggctggtagaaagaactgccttcatattggaagtgtaatttctccagggtaggtggtggtccctgggagcctggacctgtttgggccatccttgtttagaaggccatttgatatgatgagatatttacccctgcttccctcctgtctcccttaaacaaaggtggtgagacaatgctatttcccacacttcatgggaatctggccttgtgatttcatagagatttatggtctctagaataaagttattcatctattgagaattcagccactgctatgtatacgaggttgggcatgttatggctccatgcctcattcatccccttctactgtgtgtgtatattttaatgttaggggaacagcggggaggtcactgtggcacgttggactctctttcctactacatctcctctcccccaaggtaccggagtctgaagcaattcaacgttgacatctgccagacctgcttcttgacaggcagggccagcaaaggcaataagctgcactaccccatcatggagtattacacaccggtatgaagcctccaggctgggtgggagggttaggcagctctcaggtactaggccttgatccactttgcccagcattggctcattgttttctgctctcccgtggggagcattctccaaggagctctggtgattcactggtttgggaaattcaggcctctctattcttccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttcatttattatcattttaaagaaaacattagaaaagtcatacatggaaaactggctggatctggtagactgataatcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtactagctctctgccatctttccaagtcccttcctgttgcaagatcccatccttctatacacaactttgaggaacgaagaatatgccctccctcatctgaagttgcagaaaggagccattatcttgtgctcaagatgccaaagccctatctagtgctacactaaccctgggagacatcagggacttggctgaactatagccaagggaactccctggtatgacagcccagagaaggggccttgtgtctctagggaggtccccaccctgctcagaggtcctaggagcttctggctacatggatcaatctgccctgactgggacccagatccctctagaggaagaggaaacaaaggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacacccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctattataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtgctgggattacaggcatgagccactgtgcctggcctgaatccttttaatgtaacccaaatttttccaagaacacacaagatgcaagcagagagaatgcatagagaaaacaggagagggtatgacatgttcctgccctcagagacctttcaatgttggaagtggaaagaaatgtgtatcacctagtaaaagtattccagaggacaatgacactacatagagcgttggaggtctggaatagggatggtgaagaagaatacagggaagacatgactttccataaagtaaaggtggcagcaggtacctaaggagggtccaagcctcttatggggcatgaagtagaattcgtagtaccccttagagcagtgctttgcaaacagtagtgcataagatagtcacttgggaagcttggtaaaatacaaattctaagtcacaggtctgggtggggcctgagtttctgcgtttctcactagctcccagtggatgcccatactgctgttccacaggccacacttggagtagcaagtctttagaacagtgctactcagagtttggagagcagaccagggccagtttgtgaccagtttgtgaccagtccaaggcaagataaaaaaaaaaaaaaaaaaaaagagagagtaagcttttagaaacttttacagcaatttgacattgctatgatattcaagcaccaaattagtaggctcatctcgttgaatagggtagagaccagtttgagtgttgttgaacttgtgtgatgaattacgtggtgtgagctatgtactagtcatgtgcattgggaccacatactggtccacaacagagtgaaaaaaaaaaaaacctggatttttgccatgaatcatttgagaaacactgcctttgagcagcagtctgcaggccctgggaaacactgggctgagagtgactgttctgttgcaaataaagaaaaaacgaacaaagccaaaagtgatatccccaaaagtaggccacctgtttggaatttgtttttttgatgacccagcatgggtgttcaaagtgggccaaagaggaggattgtggagagaagaggcaagacaggtggtctcttgtttatgttatgttttcccttggaatctaaacatctaaaaatggagtaggtgagtcagtggccctaatgcctcctttatttgcagactgtgtttctgcctgattttaaggtcagaattaatccctaaagcagcacatcaaagccctgagacatttcttacgcaaaatgtcaactttctctgctctgaggtctcaggatggcagagtaaatgacatatgtgctggagaggaagtggatgtggccattcaagcaagagcacagctgggggtggggatgggggtgggggtgaggtagggtggaagagcacagggattgttcacacctaggcctgaggggacatctgaaacctggacagtcagagccctgttagagccataggtcttggtgtctctctccatggcaggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcaggtgaggatggagacaggaaaagagccagggtggcctctgagcccaggggaagggctggggagctgagggctgtggcaaagaagacacaagagagagctccttggcagtggctgtcaggtaacttcctgaagagaactgggcctgcggttggtgggggggcgggggaaagaagagactggtatggtcacatcttcagccaactctcttccacctaccttccatgccaccctgtgtgtcactctccagccactgtggggcctggggcagagagaagacttctgagggcttatttcttcacaacccattggaatcccatactaaaagaacaaacttcaaaaatcatctaaaacattgattttgctagtatggtatttgctagaaagaagtgggttgggacaagtttggcaagagaaagattagtgctatctaaaggtgtttcttgttactttttgcacctttcatctctgagaggcaatgtgtatgctgtggtaaagctctggagtcaggcagctctgggtttgcatgtggctctgccaattgactgtggggtgtttggacagttagttaacctctctaagccccagtttcctcatctgtacaacagagatggtaacagtaccaacttcatagaattgtggtgaacataaaaggagataatgcatttatggaatttagcatgatgccaggaatttagtacacacttcataaatgttacctattattgtcattatatgtaatggaaaataccactcttctgcctcttccccagatcctccaaggaatggcctctatggattcctggaggtttctaacatatgctatgtcatgaaccaaggatcaggtgtgaaactctacatttccagagagaattgtgttctaaatagcttaattatagctgaaatgacagcaagagacctttaggtacaatgccattctttatttaattaattaattaattaattaattttcaagacagagtttggctcttgttgcccaggctggagtgtaatggctcgatctcagctcactgcaacctccgcctcccaggttcaagcgattctcctgcctcagcctcccaagtagctgggattataggcatgggccaccatgcccggctaattttgtatttttagtggagacggggtttctccatgttggttaggctggtcttgaactcctgacctcaggtgatccgcctgcgtcagcctcccaaagtgctgggattacaggcgtgagccaccgcgcccagcctacaatgccattcttataagaactgggagcctttgacacatgttgttaaaggaagaaggtaatgggtaattcaatattctaagaagtttcctaaaagtggaagccactgttttaggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttt

SEQ ID NO: 3517 - DNA, 44728 bp, human
gcttctcaggctcttccgctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcggtctgcttgcatgtgcctttagtggaaaacttgcatttaaaaatgcccacaataaagtagtcaccatttagattcataaagaaaaaaaaaaagatgcccaagaatagaaactcaagccgatttgagcaactaaggtctaaaaatgaataagaaggaggtacacagtttgcttctttgagaaaagaggggcatttatttattttaggttctcaatagcatgctttttgtccaagggtatacttcttggcaggagggaagcaaaggtgtgtggaaagccttggctaacaagggaggagagaggaaacatgggaccttggagcaggttccctgaacaaatgagtattctggccagcagacaggacacaggagttctttgctgaagtaaaccaggctctgacctaagagcctggagctgaagggctcatctcatctctgtatttacttcctggctctgttgtttttcctgtgacatttttcccccttatcttctcccctggtttcctttctacaccctgtaatcaggaggcatctttccactcttgaaagcatagcttggagtggtttcaaatagggcttgcttctcttggagtccaacaccctatcaccttctgctctcaccacctttcccagcatcggaccaagtgccccagcctagtaagtgggcctgagactatatgggtagttaatgtttatccttcctttggtaggcaggtcgagccaggcctcacaggtgttgggtctaagcaggtggcaaggctgggctggggtggggtggagtggggtagaggagaacgtcagcagcagctgctgcctgcttccgttgaaagcatggtgcatgctgtctggaaaagaacatactttttaaaaatgttttctttttgattgtcaaaagaacaaaagccttaaaaaagctctatgtctagttcatcttaattcctgacttttccaaagaatccttgtttctagatgaaaggccctcaggtaaatcaccttttaaaaggcctgtgggaaccacaagcctcaggtgattttccttctaaggtttgcgtggggagatgatcccagagaatctcagggccttctaaggaaacctccgtgaaaaggcagtgttggaagtggcagtgttgtgtcctgtttctgaaagaagaccaagcccctctgtctctgggttggcaggcctctgtcctgtagtcttgctttctgtaaaccattgctgggggatgaaggcacatggaaagaactcctcttcctgtgagatttgtacttctaggcattcagcctcagctaagtagctctgtgctccaggtcagattacccttcaagtccaccataaaggaggggagcatagcttgaagcaatgaatttagcaaaggccctgagccagatgcggagagcacatctgcgattcagcccttctaactatggatgctcagaagtttctgatgttggatctgccaccatgccagctaggatggggtctcactaatgaaggccaagaagatagtcttctaaacttctcagggatacacactcagaggaaacccattcagtggaaattatactatgaaatgacattcctcccttatgaaggattctaaacatgcatcagcaacaaaaatagcaagtgagataaatccttctaggatagcatttaccaaaccaatgttctatagagccccatcctgagagaatgttaatagattctgttttaaaataagtgttgggggtgtgtgtgtgtgtgcatgcatgtgtgtgtattctgcagttcaatacttttttggaaatgcttcttaaccgaattctcattttggagagtcacagtgtatgtaacgcatattaaagactctgagaagtactgctgtaaatgaatgtttaattttgtttaacccagtacatcccagactggtttgaccagggaacacttttctgtatggaaaacactttttgcctcttgcagatacagtttggggaactgctgctaaaaaaaaataataaaataaaaaataaaaaaataaaaaactggaagaaatcgtcacatggataacacttgtaaaataatctagtccaacaatgcatttctaaacatgaaaaacccaagaggttaatcatattgttttccttcccatagctgatgagaatctgggattatctcctgattccccagcccactgtacccaactgctgcttctctagcaggtcccctcctgtgaaactagttccaggaaaatgaagcagatttaaggaataatccttaaattttgagtgcaatatttacatttaatacatttcttctagtattttgctatatgcaaaaattgtcaactttcttttcagcatgggctttgttgcattcttttaaacaatgtgttatgaaatatctttgttcattcaaaaaggtataaaaataatatggtgaaaatcaggttattcactgcccagcttaataaagaaacattaccagtagagttgaaaccttctgtctattctccatgattaaagttctctctttccttccaaagtaaccactatcctggatttggtgtttattattcccatgcattgatttatatacttttactacacatgtatatatttttaaacaacatatactactgctttatatgttttaaaagtttgtatcagtggtgtatcatacgtattcttctgcaacgtgatttctcttttcttttttctccccgccaagagacgagatcttgcactgttatccaggctgaagtgaagtggtgtgatcatagctcactgcagtctcgagctcctgggctggagcaatcctccagcctcaccaccccccaggtggcaccaccatgcccagctaattttttttccttcatagagacagggtcctgctatgttgtccaggctgatctcaaactcctggcctcatgtagtcctcctgcctcagcctcccaaagtgttgggattacagccatgagccactgcacctgccttgaaacttattttttctattcaatgttatatttgtgaaaagcatccatgttgtaacacgggtctctagtttactcatttttttcactattgtatactcctgtaatgactataccacactttatctattctgctgttgatggacatttaggctatttctagttttgagcaatcacagaggtactgtgatcattcttgtgtagctattcttaggtgacaatttctactgggtaaatatctgggtggaattgtccccttacagggtatgtgcattgtcacctttgggagatattgtcaaatcactgtgcaaaatagtttactaacttacactcccaccatcagtgtataaaggtttcaggtttattgcattaattggctcttagagttttctcccatggggatgcatctctgattttttaattggataataaattttatttctcaaaattgcttgacagctaaacttctcaggaatacgtttccttgttttcatttgtaaatgaggggattggcctagatgatctcaaaggtcctttctagcttgaaaatctgagtttctatgatttattcattaaatcaggtacatctgaagcagaaccttggttttttgggtgcattgcaggaattattttaggaactataacaaagtttgttaccagtgaaatgtgtatcttctctcttactgccatgctgtcaggtagaaagccagtggtatgagagaaaaggcagttacacagtgttaccttggattggggagaggattctgtagcccatgggaagggggtcgccttcccattgccctgttctttacagaacctctacatcttagaagtcttccctatctcttgaattttttctcccaagaataataaatgtttgctgggttttttttgttttttttttttttttttttttttttttttgagatggagtctcgctatgtcacccaggctagagtgcagtggcacaatctcggctgggaggctgaggcaagataatcacttgaacccaggaggcggaggttgcagtgagccgagatcatgccactgcactccagctgcactccagcctgggcgacagagcgagactccgtctcaaaaaaaaaaacaaaaaaaagcccaaaaaacccggatgtccaggcttcctttctgcgcatgcgcacagtagattttttaaaaatgtttttacaaaattggagttccactaagcatgctattctggcatttgttttctttggcctaaaatatataactttgaaatctgtccaaatcagtgcatatagatctacctctttctttttaacagctacataatattcgccgtgtgagtggctatcgtaatagataacatttgaatatctactaaatgccagaaactatgaattaactcctctcaacaaagctaagaggtaggtctttttgttatccctgtttcacagatgtggggactggagcacagtaaggttggggagcttgtccatatatgtgccgataagtggccaaggtgcaagccagagcatcctggttcagagcctatgtcccagacaataatgctgtgatatgtctcagacatagtctactcaccagtcccccgctggtggacatttgagtgaatgcagatttttgctattgcaaacaatactgcagcaaacatctttgtccacttctggaggtctttttgtaacataggctcttagatttctctggtttctaggtggaaagagcttatttattgaaaaaaaaatttattgagctctaggcattggggaggctctgagcttaaaataggagacttgaccagaatttcacttctcagatgtcctataaaggtcacttaagtgcttttcatgatttgccagcctggtgctgccccattagactcactgcatcttatctgtttttaattgcttgtgtctttgcctgggtagtggcataactgagtcaatgcttgggctcgcacctggtggtctatagccaaaaattgtctccattgtatccattgtatggatacactttccaggtatcagtgattacaatgcctcagagcctgggttctagaatttacagaggcagaatagcataatgataaataacttgtattctgagacacaactgcctgggtacaaatcccagctcttcacgatgtattcacaatatgactctgaacaagttacttaccatctctgtgcccccattttctcatccacacaatgaggatagcaatagtaactactttatagggttgttgtaaggattaaatgagttaatgtatgtagactgcttagttaatatatataaaacacagaatacagttattatttatttgattatggaaaagctggcacaccaatctttccataaaatagttgttgacctccttgtattttggtggggagcggagagggggcgaagaattagctgttattaaataggtaatgtgttcacatgggtcaaaattcaaaaagtacaaaatgatatttagtaaaaaattttatctcctattggcaacatggggcttatgtggtgtggggaataattctgtttctcaacctgagaagtgattatatgaatttactttataataatttaatatactttacatatatgctttatgtacttttataggtatatttctcattttgaaaagggcagaaatagtagaaatcccaaagacatggggagaatttttactgctcagttcccttctccaatggtaacaggctcttttgtatacttccaaagatatttttttgcatctataagcacatatttttagtatacaaatgtagactaaccaccaccttgatttttctcttgttttctttttacttaaggtatatcataagagatcattttgtattggcatataaagagttcttaattattttttaagtagctgtatagaattccattgtatggatacaccattatttaattagtcccctagtgatagacgtttaagtttttgcaattttttttgccatttcaagccttgtttcaaatgctgacattgtacttattattgtacttgtttcaaatgctaacattgtacattattccacacaaatttaagtagcatatgttcctatacatctccagtttatgggtgcctagcactgtgttaaaaatatgtgggatataaataaatatcaggtgtgggttttgtcccccatgagccaacaatcttgctttcatgctgaaatcctaatatctcccctgtgtttttaaagctttttatctctgctcaagagaaacaatgccttcccactgaatcctcctcaaacagcctgtgtatggcttttagaaccaggaagagtatttgtagtagcaaaaagccacagtttggtatccagcagggtccctaggggagggcagggaaggcttattgccacccaaaaagcatcctccacacctgcatatgtcaaaatcttctctttcaccttagctcgaaagcttcttttccataaatacatcccaaatccctccaactagaagtgaacacttcctcctctgtgacctcttataccataatttctgtgtcttgctgtctcagtccattttctgttgcttataacagaatacctgaaactgagtaatttataagaaaaggaatttatttcttacagttatggaagctgagaagtccaagtttgaggggctgcatctggtgagagtcttcttgctgtcataaactctctgaagcatcccaagatggcacggagtatcacatggctagagggcttagtgtgctagttcagatatctcttcctctttttataaagccatgaattctcctcccgtgataacttattaattcattaatccatgagtggattaatccattcatgagggcaaagccctcatcacctcttaaaggctccagctctcaatactgtcacattggggacagatattcaaaccacagcacccacgtatggtatgaataattttccccgctaaaattatccttttttttgtttgtttatatgtcttgtttcctacatttgaccagttggggaccaagtctgattcatcttcaatctctcatagcctttgcaaattaaaaagaggaataggaaaaaaatcagtatgtgcagatggtgatttgagataggatggagctagatagaggcagaagaatctttgtgtataacaaagagtactcgcccaggaatcaggaggccctggttcacttgtgtctcagcatcttcatctgtaaagtgggatcttaattctgactgggacaactttactaggttgtactgaggatcatgaaagacagcacagccgactacaaaggcatgctatatgaatacagagaatgatagtgtttggtgcttagcaacccttaaacattaacacttgatacattagcaaactaaggcctagagaggcaatatgacttgaggtcacagtcaggggcaaagtctaaaaagagcagaggatagtcattttaggaccagaagaaatctattccttttctgcctgtgttaggattagaaggtctgaattctctgactccttggtttatcttagttttgttttgtgaagccttaacctagcatcaggtcagtagaggaataagaaagaatcttataatctggagagaaatgaatctcaaaagagaagaaaagagatagttgatgaaagaagagatacaaacgaccactaaaagtgtggaggaaaagctaaatatctttagcaattaaggaaacgcaaagtaatcctcaaaatgccattttcacttacaaagttggcaaataaagtaagaatacatactgtggacaagtgtgctgggaaactggcactctcatacattgctagtagtagtgtaaaatgatataactttttctagggcaatttagacatatgtatcataaacgctttgatccaggaattctcccttataggcaattatcctatggaaagaatcacaaatatgcacaaggttgttcactgcactttgatttataaaaaagaagaactataaacatatgtctaattgttaaactatggtgtatccattcagtgggatactatacaatgacgatagctaacacttattgagttgtgtattgttgccagacactgtgctaagttatttaaattattaactttaatcattagaataattctgtgaggatgctatcattatttatccccattttgcagatgaggacactgaggctcagagaggttaacttgtcctggaccacactgctaataggttgaatagtgtggatttgactctaggtctgtctgatgccagtgcccatggcctcagtcacagtgctgtacttcctatgcagctgttaaaaatcatgttttaggctgggcgtggtggctcacacctgtaatataaacactttgcgaggctgaggcaggctgatcacttgagctcaggagtttgagaccagcctggcaacatgacaaaaccccgtctctaccaaaaatacaaaaaattatccaggcattgtggtgcacacctgtagtcccagctacctgggggtactgaggcaggaagatctcttgagcctgggaggttgcagtgagccaagatcacgccagtgcactccagcctgggtgacaaagtgagagaccctgtctcaaaaaaaaaaatcatgttttaagggaatagttaatgacattctaaaatgaccatgatataatggcaagtgaaaaaagcaggctacgaaatgatagcatgtgatggcgattttattttaaaagtgtatgtatatatttttcagagaaaaactaaagttcatagctgttagtaatgattatctctgggtggtaatattacagattatttttattttcatccttattattttttgtatttcccagtttttctatcaagaacatgtattacttctataatcagcaaaaataaaaatgttaacataaaaagaggtctgaaagcaagcctcttgtagcctttatgcttataacacatccatagcagtacttcattttttaatctaagtgactaatgcttttgtggtgtctgatcacagaggagccatattttcagtcattctttggggatgagtagctacatagctgtataatctatagggactttgactacaacaaagtaccctttagaccacaacctcttgtgcccttgtgatttgtaataatctccattctttggactatggtctcctgaggaggaggggtgggtacttaatgcaaggagtccacatatctttaaatgcataaatgtttttctcactcggtaagttctaaaagtacagctactattgtgggtgagagtgggtgaagtgagattttttttttttagtcttaagaagggcctcttatatctaaaacattgtgaaccactggaatagagtctaaaaatggtggttatttaattatctgcatcatgaataaaagatgctcagttccggccctttgaatcagggtttgtgtgtctttgccccacactaaaagagatcaccttattatttgcaagcatcatctttgccacccattctcatcacatttgtttacattctctaaaccatcaattggtttgtacatctaaactttgtccccatatttctcctttactaagcttagctctttacatctaaagctgaatatgtctcaagcatagcttattatgcaacactgcccctattccctacacagcaaatttactctttctcctgtcttccttctcttgctgttggcaacattatccactcagctcccaaattagaaacctttgactccttctcctcccttactgttcacatccaattgatcatcaagcccagtgtattttacctctccaatgtacctcagagtcatgctgtctgcttcatcctcacggcaactgcctgcctattctaacagcttctcaacaggttcttccttttggagaatcactctataaggaaggcagggggctctttctaaaatgcaaatctcggccaggcacagtggctcatgcctgtaatcccagcactttgggaggccgaggcgggtggatcacctgaggtcaggagttcaagaccagcctggccaacatgacgaaaccccatctctactaaaaatacgaaaaattagtggggcatggtggcaggcacctgtaatcccagctactcaggaggctgaggcaggagaatcgcttgaacctgggaggcagaggttgcagtgagctgagatcgcgccactgcactccggcctgggcaacaagagcgagactcccgtctaaaataaataaataaataaataaaataaaatgcaaatctcattatgtcactccctgcttaaaatcttcagtgcctccccattgtctacaagataaagcctacaatcctctgcttgtcattcaaggcatggcccaatgtggccacagcctcacctcctgctacacacaacaaggcacctaccttgtactctggtcacacggaacacaccatatatttaattttcatgtttgtattttttttaaccttcactgcctaatgacaaatctgtttctctttcatgactcacctcaagcacatttcctctagggagacttttcttgacatgaccagatagaactcacgattccctcatctgtctcttcacttcatcccataaacaattccattatgacctcaaataacactttatggccattattttctccacatttgttctctctgtatgtgatactcctcaggggaagcccccatgtctttttcatctctgtgcctcttaaactctaaccataccgatcccattgtcctctgaacatgctaggcctttttatgacatccacctttgcacaggtggatctgtctgctgggaatgccattctccctttctcctctgcacaagcaaatatctacttatcttttgagactcatctcaagtgtgctctttctgaaatacgtgcatattctcagagttagctgttccccactctgtgctcccttagccttttggtaaactcttgattttagcatttgctatgtaagcattttattataattatcagcatacatgactgcctcccctacccatcttgcccacctccacccttaggctttgagatctcagcagttatctttatgtctctagcacaaagcactataggtaaacaataaatgcttccttggtcaataattaaataaagtattttatggtacatggtggcctgggtaggtcagtaagttttgaatacttatttgtatatctggtcaaggcacctctgggtagatgcttgattcataggcttttctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggtaagagtctgatagtgaaagaaagacctgtggagaaagtggacacaggatctgtgtgtccttggggtacccacgcttcctaaggctcaggggcactctctgtatacatgcaaccccttggatagcatggggaatatattgggcccatcctttattactcattatgtcttttattggggggcataaggaaaggaagggtgttgggctgggcagctcagagggcccactgcagctgagcggggctggttccatgttaaccttctaagagttacaggtccaggaatgtcctagaagagtatgatccttcagggcatggtctaggactaggcaggtccttcctttggcttggcttctctgtggcatgccttccattttccacaggtgtctctctcctgccatcggcttttcctctcaagttcctagcctttttcatagctcctggctcatccccacttagaattccatgagctccatatctgcctgtcctctctgctcctgtagtagtgcgatggtggtggtgtatgtgtccgcctgtgtatgttggtaggcaggtagaggatgtgtgtgagacagtagagagggcagccccctttcccgacaatgagggaggtctagggaaagttgactggagaagggagacgcataagcatactttggttgccctacaatgctttggggtccagagactatgggggtgtgagaaagtgctatgtctcctggagcctcacagatgggctgcagtgctgagtcactgctgggaggcaggcagcggccgaatatacaggaaggaggaagggaggaagaaaggaagtggggatggagaatgtggatgctggggagcctgttttgggggcagtaatgaaggaaagtcaaggtccagagagacattagagtcaggtccccctgagctattttccccacatccagctagaaagaaattactgcctcgaacatattctcaaagcgagagtcaacatagactcccccattaacctaccccttccccggagtgggactttcacagggtcgagggattaagaaaactgagcccttccaaaggcttaccctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtataccgggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctccaccccagaaccccagaaagagtcaggcagctgttccaactattcctgtaggtggacctcagcatggaaacaatgtggaactgttggaaagcccagaagactctgtgggagataaataaggatgggaacagaaccctttttggtaaaaacgatgtgttttccctcagtgctgagggatgggggaccagcttgggaatgttaacctttccccagacaagtctgctggaaaaggagaagagtggccacttccaggaggggccctacccctcaggccagtggcttacaggaaagggccttcccctgcccccacccagggtagcacaggcaggacacaggagcctccctggcaatggctgcctacatggaactgctgggtcccagtgacccctttccctcccctgtgaaaattcaacgggatgcccactaactatccatttccctttggcctcagggtacagcgagaggtctgagggctatggctctccctccactcctctctgcctctcaaaggcagggcagagcacccctccattttcacagtagactctgacgaatctcctggcctctgcactcacccaaggataatcacatttagagggattctgctgcgcctgcttgccgatgctgccatcccatggctctgtccccagatgtgccacaaaccttcctcactgtctctgaggaggcttacttagttgaagacaaggcttattttccaagcccatcctcttatgtcttagggaaattgcttaccagaagcttgtcaccaaagtggtctgatcttatcctccacctcaggggaggggtgggcctagaggcagagtgagccctttgtgtcttccatggaaagggaaaataaatcaacagaagctgccctctgcatgcccctcctcagcaccatggaatgcccagtcccactcccgccatccttgccagcctgagagggccatcctggccctggtgtggcaggcccagttgggagtgaaccggaattctccagagacaaagctctgattcaccagccaggccctgacatagccgccccctccagattcctggggggtcagtaaacaaacagggtgacccctgcctcctggcctggctcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggaaagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttaccagtgcccaggagagcaagcaatagactgtgtgcctgagggctcaagactagactttggcaggctccatggcttgtcctcttggccatcaactctggtcagagtcctctgctcatctttatgagcagttctcttgaagactgtgtccaggcttcctgactgtggtggacacatcaaagccaagtttcatatgggaagtaagacgtggaccactgatagttctctcttgccagtctactccctctataaatctttatggagaaactcctcagcttgcttttctagaaggttgggtaaactgtaggaccctgaagtatgagccaacagcttacctgcaatggtatggttgcccataatttgggcaattctgtgcagcttcttacctaatgcaggtacttccaagaccccatctgggcagtggtcctgaggagtgggggcccagcttgggaatgttaacctttccctaggtccaaaatttataatcatgagtaacaataatagtaggcagcagttctatgtaactgacctgtaccaagagaagacttggcaatgaacaggaccacagggtctttcttcatctcagtccctgaacacacagagaatagcatttctgaaccctggcagcaacccttctctccccttgttcacacttgtctcacccttggcttggtgcagaccagggtgtggcacaatccaaggatcacaggatgtttgtgtttctgtccaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccctgaatactttgtttgagttctcgaaatgttagcttccatttgttttttataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttggaaaaaaaaatgttttgccacttaaaaagaagactgaacatcactggttttactcattgtgtgcagcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggtaggttagaatcagagaagccgtggtgtgtagcctctcagctggggaggaatcccttcttcagtaccctgacagacacccagctctgctgagacacctaaatgaataggaggctgtatgcagtcctattagtctgtggctagcatgccacagcctaagtcaaatattttctttctacccctcccatcaaattctagcctcccttaaaatactgccatgatttttaatgggaacatggggaaatgaacataacataatgctaagtgaaaaaacacaggatacaaaactaagtgcaagtggatctcaattgtataaaaatgtatatagatgagtgtgatgtttacatacatataacagcataggaaggaactatatcaaaatgttaacaatggttaactctaggtaataaaattggagttcttaattttcttcatatctttctgaaatttctaatatttctgtgatatatattactgctgtagttaaaatacttcttaaaatgactacagaatgaaatataatacagcaataaaataaactataaccacgtgccacagcatgggtgaatcttacagacagacaatatgttgagtgaaaaaaagccggatacaaaaagagtatatactgtatgattccacttatacaaagtttaaaaataggcaaaactaatcagtgattttacaagtaaaaattgtggtcacctttgtgggaggggagggaggggtggggcatgaaggtgagatagtgactaggagggcccacctgggatgctgatagagttctgtttcttgatctcagtactggttacatcaagatgtacagttttagtttgtgtatcccgtatatatttcaaccaaaaatttaattataattttaatataaatcctgcctatcttggttttgatttccataagacccttacaggaagctttctgagtcttctggagaaccaagatccccacatttttctctatcctgtggcatagacagacaaatttcatactaaacagaccttccagtgtcagagttatttttctgtctatcaggaggattgcacgcctttttgtctaggtagttcaaagatacctgataatgccaaagaatcaagacacactgagaagaagaaaggttgtcaattgcaggatggaatgtaaagtgattgaaaaactttcctttcctgttgaccatattgctaaactttataggcctttatggaagaagtcaagtctcggggcccctacatctattctgtgctggagtcagctcaggccttcctgtcccagcacccatttgaggagttagaggagcctcattctgagagcaaaggtaggtggtcttctgtttttcccacttcttcttgagccatgtactgctgaatgctgaacaaacaccctcctgccttccccaaactcattttcttacctgttatctaggaggatagtttcccccaggagtccatccaaagttggggggaagcaagattcctactgcaggaaaaaaagcaaagagaatatagcctggagcaggggtcaacagttgtgtgacccaaagctgtatgtggctctttggagcagcatgtgtggccatttaatgagatgtggaaaagaaaaacaaaaaaccactcaaatgaattgaactgactcaatgaataaaagtaccagtatgtcctttaaaaacatagtgctggctgggcacagtggctcatgtctgtaattccagcactttgggaggctgaggcaagaagatcacttgtgcccagaaattcaagactagcctgggcaacatagtgagacccccatctctacaatttttttttgtgggggacggagtctcgctctgtcgcccaggctgaagtgcagtggtgtgatcttggcccactgcaagctccgcctcctgggttcatgccattctcctgcctcagcctcccgagtagctgggactataggcacctgccaccacgcctggctaattttttgtatttttaatagagacggggtttcactgtgttagccaggatggtctcaatctcctgacctcgtgatccacccacctcggcctcccaaagtgctgggattacaggcgtgagccaccacgcctggcccaaaatttttttttaaattagctaggttttgtggtgtgtgcctgtagtcccagctacttgagaggctgaaatgggaggatcacttgagcccagaagttcgaggctgcagtgagctatgattgctccactgcattccagcctgggcaacagagcaagaccctgactctaaaaataaataatatacaataaaataacaaactaaaataatcataatttaaaaatactgctttattccaacatcgagggacatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcatcctgagtagctgggactacaggcgcatgctaccacacccagctaatttttgtgttttttgaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaaaggacccttcatgaattgagccctttgtcaatgccatatgcccatctcagtttatttctggcccttcaatgggagggctagtacttaatttgatgcccgatgggcctcagataggacaagctctagaaagagcagcacaattctagttagcctggggctatggggctctggatcttctgaggagagatctgagggaggaagaagaaatctacagattaggagcctaggtggaaaagccagacacattataccaacttctcctgggctgagccttcataaaatgcctccctttggctggaagtgggcaacagaaactaatgcaaaatcacattccagggtcgtatgaatagggctctagatgacttgcctcactataccttttataatgtcttactttttcatttcctactgttttaaaatatgaggaaatcctcatgatatagtaagtggaaaaacacaatatggtctcttgactgtggtggcggatatataaaccaacgcatgtgataaaatcacatagaactaaacacacgtgtacacacacacacatacacacacgaatacaagtaaaactggggaaacttggacaaaattggcagattatgtcaatgtcaatatcctgattgtgatattatactgtagttttgcaagatgttgtcatttggggaaactgggtaaagggtacatgaaatctctgtgttattacttataactgcctatgactctacaatgatttaaaaataaacagtttttttttaaaaaaaacgtgactgtattaaagggctcaaccatggaaaaatatgtatttgtgtgtgtatgaatatatacacaaacatgcccacatgtgcacacacacatacacacacattttataaagggctgtttctgtctctttctttgagctgaccctgcctggttggcctaacctggcttcctgcctcctcttgcagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaaggtatgcaagccccctcccctgactacagtctaccctgagacctgacactctccccagacactgacaatgtttctgctgctgagactccattgttggcctggactacaactgagttgctgtcagtttatgtgctagatttggggctggtttggctggagtctcttctgttttcctactttcttctcttttcctggtgttttctgaggatgagaggaagaggataaggacagtggccgcccacaccttagtctggttgccctaataggcaagcactaggctgtgttattgaaacaaaacctctgggtgaagagggaagagtagaggtgaatgactaatgtttcttctttcccactctgtctgctgtggcacttgggtcctggttctccagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggtagaagagcagcctggagtgaaccatggggaggtgcctccatataactaggcttgggggaaacttcttcaggggtatggaaataggatctgcatgggaaaagaggagtggagaatgtggagctagggaatgggcttttcaacctctaagctgcagggaatgattaaaatgaataagaggggtctttctggatttgggcactcagggtagacaggggcaggggaagagtgactgtggcctggaattagggatgctctgctgtgacctttgggagttctgggggatggctaggagttgggtgacggtgggagaggctggaaccagagaaaagccagtccctgaggaagctcataaagattcccagaggcacctggggatcccactctaaatagctggaatgaatctactgacctcaccctgttctttccataggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcagtaaggataaaacagtgtggtatagtggttaaaagaacagtctctcggctgggcgtggtggctcacacctgtaatcccaacactttgggaggctgaggtgggcggatcacctgaggtcaggagttcgagaccagcctggccaacatgcaaaactccgtctctactaaaaatacaaaaattagctgggcatggtggcgggtgcctgtaatcccagctactcggaaggctgaggcaggagaattgcttgaacccaggaggtggaggttgcagcctgggcgataaggatgaaactccgtctcaaaaaaaaaaaaaaaaaaacacaatctctcaaatcggagagatctgggtctgaggcacagcacctcaacctaataactgtgcaggctcaaaaaaaaaaatagcttactctttctgaacctcaattttcccatctgtaaaaggaaggaaaaatattacctagctcatcaggttatgggaattaaatgactttattttttcaacaatatttattgagggccttctgtgggccagatactgctctaggcactggggctgcatcagtaaacaaaacacacagaaatccttagacagcttatattctagctggggaaaccagaccacaaacaaataagtaaaatatatataaggttacttggtgacaagggctatggacaaaaagcagggaaggcgtggatagggagtgctggacttaagcatggaggtgttgcaattttgaacagggtggttagcagaggcctcactgagaaggtggcaattgagcagaggtctaaagtagatgaagagatgaaccgtgtggatgatagctgagggaagagcataccaggcagagggaacagcatattccatacctttaaggtaaggatgtgtccaagaaacagtaaggagagcaaagtgtgggggagtaggggaggctggagcatgtaaggccttgtaggcaatgggaggaacttcagattttattctcagtacagtggagaaccatcggcagggtttgagccaagggatggcatgatctgccttatgtttcaacagagtcagggtgttgagaagagactactggggagcaagagtgggaacagggaggcctatttggaggtacattgcaataatccaggtgagggattatggtggcccagactagggggctggtagcagtggagatggtgagaatatacagacagaaaaatgagatatgcacacaaagcaatgagcataatatctggcacatagtaggagctcagtaaatgttaactgtggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagatctcaagattctacttgggtaaaggtgaacccttgggctttggcatcttgggtttaccctcgaaccctgcagcttcttgcatccaacctgtcacttgagtggtgtgcacatctgagtgtgggggtgggtgggtggtatagatgctggtactattgatgctattgtttgtagccaccaggctcagaccacatgctgggaccatcccaagatgacagagttataccaaaccctaggtaagaatgtgggcttcctgtatagggtgggcatatacacagctgcctttgtcctataatgtccatctacagatgaatggataaagaaaatgtggtatatccatgtaatggaatattcagcctttagaaagaaggaaatactgccatttgaaacaatgtggatgaacctggaggacattgtgctaagtgaaataataagccagaaacaaaaggcaaatactacatgatctcatgtatgtaaggaatctaaaatagacagactcatagaagcagagagtagaatggtggctgccagtggctgaggggaggggaaaatggggagatactggtcaagagtacaaagaagtttcaattatacaagatggataagtcctagagagatctacggtgcagcatattacctatagtgaacaatactggattgtatcgttaaaaatttgctaaaaaggtagatcttatgttaagtgttcttacagaaaaaaacaataaagagggtagttggaactttttggaagtgatggatgtactaatggcatagattggggtgatggattcatagatgcatacttgtctccaaactcatcaacttgtagacattgaatctgtaaagctttttatatgtcagctataactcaataaagtggttttaaaaagaatagaagagaatcgcagtcaataagcaggtgggagagggaatgagtgcctcatcgtttctccaacagcctgccttcctttatcctcgcacctttctcaactggaggctctacattcccctctggaccattttatcaccggattagtgcattattcttacagatgtgaagtctgatttgctttaaaagactgtccaggctgtgatgagcgtaactcttgtgtgccttatctttgcctactgtgagagactcatcattatgtttgttgcacattttatccatgctgatgcatgtgactacagttcattcttttttaccactatagaatgttccattgtatatagcacagtttctgctgttgacagacacgtgggtcatttcttgttttaagctaatgaggacagtgctgctgaggagtttcttatatgtgtcttccagtacatgtgtgcaaagatttctctggggcatgtttttcagtctgcaggtcataacatcatttcagtgtgttgtgacaaacatttaaaaagttgaaatagaccaggaaatattaatatgcaacagatccttagcaagagtcatagttgatattaattttgttgttttcactctatgcaatctagtaaggaattgcttcctgaaatgtttgatttagttatttttacatatatacatgtatactataaaatgaatttcatactgtaagtcttgatcaaaaagcatttgcaagtcactgctctgggatatatagctggctgggtggtgggatatgtgactgttccattttactaggtgataccaagttgttttcaaagatgattgtgtcagttcacactttcactggcagttctcattcatccccactcttgttgacacttgctattgtcagacatctattggttgccagtctggtgggtgtaaaatggtatcttgttgcggctttaacttgaatttttctgatctgagtgggtctctctccattctttgcagctgatctgaacaacattaagttctcagcttatcgcactgccatgaaactccgcagagtccagaaagccctgcgctgtacgtctcctgttgtacttccctatgacgttcaccacccctctcctgttcctcatctgtctgctgtttctcattttcctcccaccttggcaaaggttgttgattggcttggtggaaactctccaaagcctgcaatatgctagctgtcaacttctgctcttcccagttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagcatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggatgagggtcttagtaaaggacaagcttgtatcatatttgcaaatggttgatctggagattgagtcaaatttggtgatgctggtggctttatctccttatttaatccctggggttctacttttggctatattttttttctcttctcttctttccttaccagtggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgataggtaagggctttcagctctggaagcctccaggataaaattcaatgggatatctcaagtgggcctggtgggaaggtgttgctcccatagtagacttggacccagctcagcttggggcatggttggaacagggccctgctgggatcaactttgtgagggaaatgattgccaagatgttaaccctttacatacattcatattctcagtctcttctttttaaacctagtggtcgcagcggaaagatgcgggcattgtcttttaagactggcattgcatgcttgtgtggcacggaagtgaaggaaaaacttcagtgtgagtagaactccaaagtgtggagtggtgttgggtagagggaaaggtgttgcagggaggaggaagggtgtaagataagcagaaagtacatcttgtgactcagcagagggctacttgggctaccttatgatgcttcttggttcacactgttgcaaagaacacatgacagccaaaggacaagatgggcctaaggcctattactattcccagtgtcactccaacgggcttcattccttctgaattgatggaagtacttagtcaggatctatgttggcattttgaggtacccagggccctgatgttctagttgcattcccctgtggcctatcaggcttagccctcttccagtctgaagctcaagccatgtcactagagacttcttatatacacaggcagggcacaataatacccaatatctgggaggcggacactatgttcttctgtagtttttcacatctttggcttatagtacctttgtgttcccctctgtcctccatcttgtgttcagcattttgaacttctcagtagcagcatgattagttgttgagtcctaatatgtgactgctaaatggggtgagtgctaagttaaattagacgtggtccctgcttccaatgatttacagtccagaggaggagatggaagtacacagaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctctttttggattatgcatgccagtgtttccttccatttgtgtggacaattgagagattactgcagtgtcagactacataaacaggagagatggtatggcagcctgactgtgactcatgttcaggtgcccctgagcccgtaccccatcatcctgcttctggaagaatctgttttcccaacagtatcatatctgtgtctggcactgctcttacacacagtgcactcgacctctctctctcttgctttcactctctctcactctttctctctctgtctccccctccccctgatattctctctttgtgttggcctgatttttctctctgaactcagagaatgctctttttagaactcggctactagaaggtcagggatagacctctatgtagtccagtttgaaaagtcattagctcagtctgtgctctttccctattttccttttctgccctttctcctcaccattctccggccattcctgtgtcggggttggccattcttgacggtggggccagcagacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttgtgagtatggaactggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattcccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaatacatctgaggtctccttgattatattcctctccttccccaacaaaggtaaccactatcctggattggactttcatcataaaacactcaactttttacctttgtaaaacactaacccacaactctccctgtcatcaccctgcttttcgtaagatgagcaaatgaggcacacagctagttagtggtagatctagactagatattggatcatatgactcctctaagtctaggcatttcactgtcctatgctacaaggttgggcagttcagccaggctttggaagtagatctgaagggctattctttgttctgcaataataggtatattattatgaacaacctttggaaataacttttagccaacttagccaaggctggtagaaagaactgccttcatattggaagtgtaatttctccagggtaggtggtggtccctgggagcctggacctgtttgggccatccttgtttagaaggccatttgatatgatgagatatttacccctgcttccctcctgtctcccttaaacaaaggtggtgagacaatgctatttcccacacttcatgggaatctggccttgtgatttcatagagatttatggtctctagaataaagttattcatctattgagaattcagccactgctatgtatacgaggttgggcatgttatggctccatgcctcattcatccccttctactgtgtgtgtatattttaatgttaggggaacagcggggaggtcactgtggcacgttggactctctttcctactacatctcctctcccccaaggtaccggagtctgaagcaattcaacgttgacatctgccagacctgcttcttgacaggcagggccagcaaaggcaataagctgcactaccccatcatggagtattacacaccggtatgaagcctccaggctgggtgggagggttaggcagctctcaggtactaggccttgatccactttgcccagcattggctcattgttttctgctctcccgtggggagcattctccaaggagctctggtgattcactggtttgggaaattcaggcctctctattcttccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttcatttattatcattttaaagaaaacattagaaaagtcatacatggaaaactggctggatctggtagactgataatcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtactagctctctgccatctttccaagtcccttcctgttgcaagatcccatccttctatacacaactttgaggaacgaagaatatgccctccctcatctgaagttgcagaaaggagccattatcttgtgctcaagatgccaaagccctatctagtgctacactaaccctgggagacatcagggacttggctgaactatagccaagggaactccctggtatgacagcccagagaaggggccttgtgtctctagggaggtccccaccctgctcagaggtcctaggagcttctggctacatggatcaatctgccctgactgggacccagatccctctagaggaagaggaaacaaaggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacacccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctattataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtgctgggattacaggcatgagccactgtgcctggcctgaatccttttaatgtaacccaaatttttccaagaacacacaagatgcaagcagagagaatgcatagagaaaacaggagagggtatgacatgttcctgccctcagagacctttcaatgttggaagtggaaagaaatgtgtatcacctagtaaaagtattccagaggacaatgacactacatagagcgttggaggtctggaatagggatggtgaagaagaatacagggaagacatgactttccataaagtaaaggtggcagcaggtacctaaggagggtccaagcctcttatggggcatgaagtagaattcgtagtaccccttagagcagtgctttgcaaacagtagtgcataagatagtcacttgggaagcttggtaaaatacaaattctaagtcacaggtctgggtggggcctgagtttctgcgtttctcactagctcccagtggatgcccatactgctgttccacaggccacacttggagtagcaagtctttagaacagtgctactcagagtttggagagcagaccagggccagtttgtgaccagtttgtgaccagtccaaggcaagataaaaaaaaaaaaaaaaaaaaagagagagtaagcttttagaaacttttacagcaatttgacattgctatgatattcaagcaccaaattagtaggctcatctcgttgaatagggtagagaccagtttgagtgttgttgaacttgtgtgatgaattacgtggtgtgagctatgtactagtcatgtgcattgggaccacatactggtccacaacagagtgaaaaaaaaaaaaacctggatttttgccatgaatcatttgagaaacactgcctttgagcagcagtctgcaggccctgggaaacactgggctgagagtgactgttctgttgcaaataaagaaaaaacgaacaaagccaaaagtgatatccccaaaagtaggccacctgtttggaatttgtttttttgatgacccagcatgggtgttcaaagtgggccaaagaggaggattgtggagagaagaggcaagacaggtggtctcttgtttatgttatgttttcccttggaatctaaacatctaaaaatggagtaggtgagtcagtggccctaatgcctcctttatttgcagactgtgtttctgcctgattttaaggtcagaattaatccctaaagcagcacatcaaagccctgagacatttcttacgcaaaatgtcaactttctctgctctgaggtctcaggatggcagagtaaatgacatatgtgctggagaggaagtggatgtggccattcaagcaagagcacagctgggggtggggatgggggtgggggtgaggtagggtggaagagcacagggattgttcacacctaggcctgaggggacatctgaaacctggacagtcagagccctgttagagccataggtcttggtgtctctctccatggcaggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcaggtgaggatggagacaggaaaagagccagggtggcctctgagcccaggggaagggctggggagctgagggctgtggcaaagaagacacaagagagagctccttggcagtggctgtcaggtaacttcctgaagagaactgggcctgcggttggtgggggggcgggggaaagaagagactggtatggtcacatcttcagccaactctcttccacctaccttccatgccaccctgtgtgtcactctccagccactgtggggcctggggcagagagaagacttctgagggcttatttcttcacaacccattggaatcccatactaaaagaacaaacttcaaaaatcatctaaaacattgattttgctagtatggtatttgctagaaagaagtgggttgggacaagtttggcaagagaaagattagtgctatctaaaggtgtttcttgttactttttgcacctttcatctctgagaggcaatgtgtatgctgtggtaaagctctggagtcaggcagctctgggtttgcatgtggctctgccaattgactgtggggtgtttggacagttagttaacctctctaagccccagtttcctcatctgtacaacagagatggtaacagtaccaacttcatagaattgtggtgaacataaaaggagataatgcatttatggaatttagcatgatgccaggaatttagtacacacttcataaatgttacctattattgtcattatatgtaatggaaaataccactcttctgcctcttccccagatcctccaaggaatggcctctatggattcctggaggtttctaacatatgctatgtcatgaaccaaggatcaggtgtgaaactctacatttccagagagaattgtgttctaaatagcttaattatagctgaaatgacagcaagagacctttaggtacaatgccattctttatttaattaattaattaattaattaattttcaagacagagtttggctcttgttgcccaggctggagtgtaatggctcgatctcagctcactgcaacctccgcctcccaggttcaagcgattctcctgcctcagcctcccaagtagctgggattataggcatgggccaccatgcccggctaattttgtatttttagtggagacggggtttctccatgttggttaggctggtcttgaactcctgacctcaggtgatccgcctgcgtcagcctcccaaagtgctgggattacaggcgtgagccaccgcgcccagcctacaatgccattcttataagaactgggagcctttgacacatgttgttaaaggaagaaggtaatgggtaattcaatattctaagaagtttcctaaaagtggaagccactgttttaggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttta

SEQ ID NO: 3518 - DNA, 44711 bp, human
gctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcggtctgcttgcatgtgcctttagtggaaaacttgcatttaaaaatgcccacaataaagtagtcaccatttagattcataaagaaaaaaaaaaagatgcccaagaatagaaactcaagccgatttgagcaactaaggtctaaaaatgaataagaaggaggtacacagtttgcttctttgagaaaagaggggcatttatttattttaggttctcaatagcatgctttttgtccaagggtatacttcttggcaggagggaagcaaaggtgtgtggaaagccttggctaacaagggaggagagaggaaacatgggaccttggagcaggttccctgaacaaatgagtattctggccagcagacaggacacaggagttctttgctgaagtaaaccaggctctgacctaagagcctggagctgaagggctcatctcatctctgtatttacttcctggctctgttgtttttcctgtgacatttttcccccttatcttctcccctggtttcctttctacaccctgtaatcaggaggcatctttccactcttgaaagcatagcttggagtggtttcaaatagggcttgcttctcttggagtccaacaccctatcaccttctgctctcaccacctttcccagcatcggaccaagtgccccagcctagtaagtgggcctgagactatatgggtagttaatgtttatccttcctttggtaggcaggtcgagccaggcctcacaggtgttgggtctaagcaggtggcaaggctgggctggggtggggtggagtggggtagaggagaacgtcagcagcagctgctgcctgcttccgttgaaagcatggtgcatgctgtctggaaaagaacatactttttaaaaatgttttctttttgattgtcaaaagaacaaaagccttaaaaaagctctatgtctagttcatcttaattcctgacttttccaaagaatccttgtttctagatgaaaggccctcaggtaaatcaccttttaaaaggcctgtgggaaccacaagcctcaggtgattttccttctaaggtttgcgtggggagatgatcccagagaatctcagggccttctaaggaaacctccgtgaaaaggcagtgttggaagtggcagtgttgtgtcctgtttctgaaagaagaccaagcccctctgtctctgggttggcaggcctctgtcctgtagtcttgctttctgtaaaccattgctgggggatgaaggcacatggaaagaactcctcttcctgtgagatttgtacttctaggcattcagcctcagctaagtagctctgtgctccaggtcagattacccttcaagtccaccataaaggaggggagcatagcttgaagcaatgaatttagcaaaggccctgagccagatgcggagagcacatctgcgattcagcccttctaactatggatgctcagaagtttctgatgttggatctgccaccatgccagctaggatggggtctcactaatgaaggccaagaagatagtcttctaaacttctcagggatacacactcagaggaaacccattcagtggaaattatactatgaaatgacattcctcccttatgaaggattctaaacatgcatcagcaacaaaaatagcaagtgagataaatccttctaggatagcatttaccaaaccaatgttctatagagccccatcctgagagaatgttaatagattctgttttaaaataagtgttgggggtgtgtgtgtgtgtgcatgcatgtgtgtgtattctgcagttcaatacttttttggaaatgcttcttaaccgaattctcattttggagagtcacagtgtatgtaacgcatattaaagactctgagaagtactgctgtaaatgaatgtttaattttgtttaacccagtacatcccagactggtttgaccagggaacacttttctgtatggaaaacactttttgcctcttgcagatacagtttggggaactgctgctaaaaaaaaataataaaataaaaaataaaaaaataaaaaactggaagaaatcgtcacatggataacacttgtaaaataatctagtccaacaatgcatttctaaacatgaaaaacccaagaggttaatcatattgttttccttcccatagctgatgagaatctgggattatctcctgattccccagcccactgtacccaactgctgcttctctagcaggtcccctcctgtgaaactagttccaggaaaatgaagcagatttaaggaataatccttaaattttgagtgcaatatttacatttaatacatttcttctagtattttgctatatgcaaaaattgtcaactttcttttcagcatgggctttgttgcattcttttaaacaatgtgttatgaaatatctttgttcattcaaaaaggtataaaaataatatggtgaaaatcaggttattcactgcccagcttaataaagaaacattaccagtagagttgaaaccttctgtctattctccatgattaaagttctctctttccttccaaagtaaccactatcctggatttggtgtttattattcccatgcattgatttatatacttttactacacatgtatatatttttaaacaacatatactactgctttatatgttttaaaagtttgtatcagtggtgtatcatacgtattcttctgcaacgtgatttctcttttcttttttctccccgccaagagacgagatcttgcactgttatccaggctgaagtgaagtggtgtgatcatagctcactgcagtctcgagctcctgggctggagcaatcctccagcctcaccaccccccaggtggcaccaccatgcccagctaattttttttccttcatagagacagggtcctgctatgttgtccaggctgatctcaaactcctggcctcatgtagtcctcctgcctcagcctcccaaagtgttgggattacagccatgagccactgcacctgccttgaaacttattttttctattcaatgttatatttgtgaaaagcatccatgttgtaacacgggtctctagtttactcatttttttcactattgtatactcctgtaatgactataccacactttatctattctgctgttgatggacatttaggctatttctagttttgagcaatcacagaggtactgtgatcattcttgtgtagctattcttaggtgacaatttctactgggtaaatatctgggtggaattgtccccttacagggtatgtgcattgtcacctttgggagatattgtcaaatcactgtgcaaaatagtttactaacttacactcccaccatcagtgtataaaggtttcaggtttattgcattaattggctcttagagttttctcccatggggatgcatctctgattttttaattggataataaattttatttctcaaaattgcttgacagctaaacttctcaggaatacgtttccttgttttcatttgtaaatgaggggattggcctagatgatctcaaaggtcctttctagcttgaaaatctgagtttctatgatttattcattaaatcaggtacatctgaagcagaaccttggttttttgggtgcattgcaggaattattttaggaactataacaaagtttgttaccagtgaaatgtgtatcttctctcttactgccatgctgtcaggtagaaagccagtggtatgagagaaaaggcagttacacagtgttaccttggattggggagaggattctgtagcccatgggaagggggtcgccttcccattgccctgttctttacagaacctctacatcttagaagtcttccctatctcttgaattttttctcccaagaataataaatgtttgctgggttttttttgttttttttttttttttttttttttttttttgagatggagtctcgctatgtcacccaggctagagtgcagtggcacaatctcggctgggaggctgaggcaagataatcacttgaacccaggaggcggaggttgcagtgagccgagatcatgccactgcactccagctgcactccagcctgggcgacagagcgagactccgtctcaaaaaaaaaaacaaaaaaaagcccaaaaaacccggatgtccaggcttcctttctgcgcatgcgcacagtagattttttaaaaatgtttttacaaaattggagttccactaagcatgctattctggcatttgttttctttggcctaaaatatataactttgaaatctgtccaaatcagtgcatatagatctacctctttctttttaacagctacataatattcgccgtgtgagtggctatcgtaatagataacatttgaatatctactaaatgccagaaactatgaattaactcctctcaacaaagctaagaggtaggtctttttgttatccctgtttcacagatgtggggactggagcacagtaaggttggggagcttgtccatatatgtgccgataagtggccaaggtgcaagccagagcatcctggttcagagcctatgtcccagacaataatgctgtgatatgtctcagacatagtctactcaccagtcccccgctggtggacatttgagtgaatgcagatttttgctattgcaaacaatactgcagcaaacatctttgtccacttctggaggtctttttgtaacataggctcttagatttctctggtttctaggtggaaagagcttatttattgaaaaaaaaatttattgagctctaggcattggggaggctctgagcttaaaataggagacttgaccagaatttcacttctcagatgtcctataaaggtcacttaagtgcttttcatgatttgccagcctggtgctgccccattagactcactgcatcttatctgtttttaattgcttgtgtctttgcctgggtagtggcataactgagtcaatgcttgggctcgcacctggtggtctatagccaaaaattgtctccattgtatccattgtatggatacactttccaggtatcagtgattacaatgcctcagagcctgggttctagaatttacagaggcagaatagcataatgataaataacttgtattctgagacacaactgcctgggtacaaatcccagctcttcacgatgtattcacaatatgactctgaacaagttacttaccatctctgtgcccccattttctcatccacacaatgaggatagcaatagtaactactttatagggttgttgtaaggattaaatgagttaatgtatgtagactgcttagttaatatatataaaacacagaatacagttattatttatttgattatggaaaagctggcacaccaatctttccataaaatagttgttgacctccttgtattttggtggggagcggagagggggcgaagaattagctgttattaaataggtaatgtgttcacatgggtcaaaattcaaaaagtacaaaatgatatttagtaaaaaattttatctcctattggcaacatggggcttatgtggtgtggggaataattctgtttctcaacctgagaagtgattatatgaatttactttataataatttaatatactttacatatatgctttatgtacttttataggtatatttctcattttgaaaagggcagaaatagtagaaatcccaaagacatggggagaatttttactgctcagttcccttctccaatggtaacaggctcttttgtatacttccaaagatatttttttgcatctataagcacatatttttagtatacaaatgtagactaaccaccaccttgatttttctcttgttttctttttacttaaggtatatcataagagatcattttgtattggcatataaagagttcttaattattttttaagtagctgtatagaattccattgtatggatacaccattatttaattagtcccctagtgatagacgtttaagtttttgcaattttttttgccatttcaagccttgtttcaaatgctgacattgtacttattattgtacttgtttcaaatgctaacattgtacattattccacacaaatttaagtagcatatgttcctatacatctccagtttatgggtgcctagcactgtgttaaaaatatgtgggatataaataaatatcaggtgtgggttttgtcccccatgagccaacaatcttgctttcatgctgaaatcctaatatctcccctgtgtttttaaagctttttatctctgctcaagagaaacaatgccttcccactgaatcctcctcaaacagcctgtgtatggcttttagaaccaggaagagtatttgtagtagcaaaaagccacagtttggtatccagcagggtccctaggggagggcagggaaggcttattgccacccaaaaagcatcctccacacctgcatatgtcaaaatcttctctttcaccttagctcgaaagcttcttttccataaatacatcccaaatccctccaactagaagtgaacacttcctcctctgtgacctcttataccataatttctgtgtcttgctgtctcagtccattttctgttgcttataacagaatacctgaaactgagtaatttataagaaaaggaatttatttcttacagttatggaagctgagaagtccaagtttgaggggctgcatctggtgagagtcttcttgctgtcataaactctctgaagcatcccaagatggcacggagtatcacatggctagagggcttagtgtgctagttcagatatctcttcctctttttataaagccatgaattctcctcccgtgataacttattaattcattaatccatgagtggattaatccattcatgagggcaaagccctcatcacctcttaaaggctccagctctcaatactgtcacattggggacagatattcaaaccacagcacccacgtatggtatgaataattttccccgctaaaattatccttttttttgtttgtttatatgtcttgtttcctacatttgaccagttggggaccaagtctgattcatcttcaatctctcatagcctttgcaaattaaaaagaggaataggaaaaaaatcagtatgtgcagatggtgatttgagataggatggagctagatagaggcagaagaatctttgtgtataacaaagagtactcgcccaggaatcaggaggccctggttcacttgtgtctcagcatcttcatctgtaaagtgggatcttaattctgactgggacaactttactaggttgtactgaggatcatgaaagacagcacagccgactacaaaggcatgctatatgaatacagagaatgatagtgtttggtgcttagcaacccttaaacattaacacttgatacattagcaaactaaggcctagagaggcaatatgacttgaggtcacagtcaggggcaaagtctaaaaagagcagaggatagtcattttaggaccagaagaaatctattccttttctgcctgtgttaggattagaaggtctgaattctctgactccttggtttatcttagttttgttttgtgaagccttaacctagcatcaggtcagtagaggaataagaaagaatcttataatctggagagaaatgaatctcaaaagagaagaaaagagatagttgatgaaagaagagatacaaacgaccactaaaagtgtggaggaaaagctaaatatctttagcaattaaggaaacgcaaagtaatcctcaaaatgccattttcacttacaaagttggcaaataaagtaagaatacatactgtggacaagtgtgctgggaaactggcactctcatacattgctagtagtagtgtaaaatgatataactttttctagggcaatttagacatatgtatcataaacgctttgatccaggaattctcccttataggcaattatcctatggaaagaatcacaaatatgcacaaggttgttcactgcactttgatttataaaaaagaagaactataaacatatgtctaattgttaaactatggtgtatccattcagtgggatactatacaatgacgatagctaacacttattgagttgtgtattgttgccagacactgtgctaagttatttaaattattaactttaatcattagaataattctgtgaggatgctatcattatttatccccattttgcagatgaggacactgaggctcagagaggttaacttgtcctggaccacactgctaataggttgaatagtgtggatttgactctaggtctgtctgatgccagtgcccatggcctcagtcacagtgctgtacttcctatgcagctgttaaaaatcatgttttaggctgggcgtggtggctcacacctgtaatataaacactttgcgaggctgaggcaggctgatcacttgagctcaggagtttgagaccagcctggcaacatgacaaaaccccgtctctaccaaaaatacaaaaaattatccaggcattgtggtgcacacctgtagtcccagctacctgggggtactgaggcaggaagatctcttgagcctgggaggttgcagtgagccaagatcacgccagtgcactccagcctgggtgacaaagtgagagaccctgtctcaaaaaaaaaaatcatgttttaagggaatagttaatgacattctaaaatgaccatgatataatggcaagtgaaaaaagcaggctacgaaatgatagcatgtgatggcgattttattttaaaagtgtatgtatatatttttcagagaaaaactaaagttcatagctgttagtaatgattatctctgggtggtaatattacagattatttttattttcatccttattattttttgtatttcccagtttttctatcaagaacatgtattacttctataatcagcaaaaataaaaatgttaacataaaaagaggtctgaaagcaagcctcttgtagcctttatgcttataacacatccatagcagtacttcattttttaatctaagtgactaatgcttttgtggtgtctgatcacagaggagccatattttcagtcattctttggggatgagtagctacatagctgtataatctatagggactttgactacaacaaagtaccctttagaccacaacctcttgtgcccttgtgatttgtaataatctccattctttggactatggtctcctgaggaggaggggtgggtacttaatgcaaggagtccacatatctttaaatgcataaatgtttttctcactcggtaagttctaaaagtacagctactattgtgggtgagagtgggtgaagtgagattttttttttttagtcttaagaagggcctcttatatctaaaacattgtgaaccactggaatagagtctaaaaatggtggttatttaattatctgcatcatgaataaaagatgctcagttccggccctttgaatcagggtttgtgtgtctttgccccacactaaaagagatcaccttattatttgcaagcatcatctttgccacccattctcatcacatttgtttacattctctaaaccatcaattggtttgtacatctaaactttgtccccatatttctcctttactaagcttagctctttacatctaaagctgaatatgtctcaagcatagcttattatgcaacactgcccctattccctacacagcaaatttactctttctcctgtcttccttctcttgctgttggcaacattatccactcagctcccaaattagaaacctttgactccttctcctcccttactgttcacatccaattgatcatcaagcccagtgtattttacctctccaatgtacctcagagtcatgctgtctgcttcatcctcacggcaactgcctgcctattctaacagcttctcaacaggttcttccttttggagaatcactctataaggaaggcagggggctctttctaaaatgcaaatctcggccaggcacagtggctcatgcctgtaatcccagcactttgggaggccgaggcgggtggatcacctgaggtcaggagttcaagaccagcctggccaacatgacgaaaccccatctctactaaaaatacgaaaaattagtggggcatggtggcaggcacctgtaatcccagctactcaggaggctgaggcaggagaatcgcttgaacctgggaggcagaggttgcagtgagctgagatcgcgccactgcactccggcctgggcaacaagagcgagactcccgtctaaaataaataaataaataaataaaataaaatgcaaatctcattatgtcactccctgcttaaaatcttcagtgcctccccattgtctacaagataaagcctacaatcctctgcttgtcattcaaggcatggcccaatgtggccacagcctcacctcctgctacacacaacaaggcacctaccttgtactctggtcacacggaacacaccatatatttaattttcatgtttgtattttttttaaccttcactgcctaatgacaaatctgtttctctttcatgactcacctcaagcacatttcctctagggagacttttcttgacatgaccagatagaactcacgattccctcatctgtctcttcacttcatcccataaacaattccattatgacctcaaataacactttatggccattattttctccacatttgttctctctgtatgtgatactcctcaggggaagcccccatgtctttttcatctctgtgcctcttaaactctaaccataccgatcccattgtcctctgaacatgctaggcctttttatgacatccacctttgcacaggtggatctgtctgctgggaatgccattctccctttctcctctgcacaagcaaatatctacttatcttttgagactcatctcaagtgtgctctttctgaaatacgtgcatattctcagagttagctgttccccactctgtgctcccttagccttttggtaaactcttgattttagcatttgctatgtaagcattttattataattatcagcatacatgactgcctcccctacccatcttgcccacctccacccttaggctttgagatctcagcagttatctttatgtctctagcacaaagcactataggtaaacaataaatgcttccttggtcaataattaaataaagtattttatggtacatggtggcctgggtaggtcagtaagttttgaatacttatttgtatatctggtcaaggcacctctgggtagatgcttgattcataggcttttctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggtaagagtctgatagtgaaagaaagacctgtggagaaagtggacacaggatctgtgtgtccttggggtacccacgcttcctaaggctcaggggcactctctgtatacatgcaaccccttggatagcatggggaatatattgggcccatcctttattactcattatgtcttttattggggggcataaggaaaggaagggtgttgggctgggcagctcagagggcccactgcagctgagcggggctggttccatgttaaccttctaagagttacaggtccaggaatgtcctagaagagtatgatccttcagggcatggtctaggactaggcaggtccttcctttggcttggcttctctgtggcatgccttccattttccacaggtgtctctctcctgccatcggcttttcctctcaagttcctagcctttttcatagctcctggctcatccccacttagaattccatgagctccatatctgcctgtcctctctgctcctgtagtagtgcgatggtggtggtgtatgtgtccgcctgtgtatgttggtaggcaggtagaggatgtgtgtgagacagtagagagggcagccccctttcccgacaatgagggaggtctagggaaagttgactggagaagggagacgcataagcatactttggttgccctacaatgctttggggtccagagactatgggggtgtgagaaagtgctatgtctcctggagcctcacagatgggctgcagtgctgagtcactgctgggaggcaggcagcggccgaatatacaggaaggaggaagggaggaagaaaggaagtggggatggagaatgtggatgctggggagcctgttttgggggcagtaatgaaggaaagtcaaggtccagagagacattagagtcaggtccccctgagctattttccccacatccagctagaaagaaattactgcctcgaacatattctcaaagcgagagtcaacatagactcccccattaacctaccccttccccggagtgggactttcacagggtcgagggattaagaaaactgagcccttccaaaggcttaccctgttcattgtctaccccctccaaacaccaccatgtaggcagggaaacctgagggcttcattttgtgattgccaatagcatgggcaacttctctcttctgccacgatccagtttctcttcctttcctgcaacctttttctcaaagattcaggggatggatagagagccttgaggggagtggggtgcaagaagcaaatatcctggctacaaaagccagaagtagaaggtaattgatagggaaggagaaagaaatgtgcctattgtgtgcctggctctgctaggtgtgacttgagagtataccgggaagtaggagagggagagcagggtgatggagaatagtatggcagctgggtggggatttgggaaaccaagaagtctgcagggaatgcaaagctaacatgggtagagcccagctcatcgtgggtgctcccctcagagccaggacagcttggttgtggctgggtcacaaggggctttttctaactctggacattcccagtgcagaggacccagcatgagtgaagatatggcccagagctagaacgactccctgctcttggcctgccatcccctgccatcccccagccaccctgggtggctccaccccagaaccccagaaagagtcaggcagctgttccaactattcctgtaggtggacctcagcatggaaacaatgtggaactgttggaaagcccagaagactctgtgggagataaataaggatgggaacagaaccctttttggtaaaaacgatgtgttttccctcagtgctgagggatgggggaccagcttgggaatgttaacctttccccagacaagtctgctggaaaaggagaagagtggccacttccaggaggggccctacccctcaggccagtggcttacaggaaagggccttcccctgcccccacccagggtagcacaggcaggacacaggagcctccctggcaatggctgcctacatggaactgctgggtcccagtgacccctttccctcccctgtgaaaattcaacgggatgcccactaactatccatttccctttggcctcagggtacagcgagaggtctgagggctatggctctccctccactcctctctgcctctcaaaggcagggcagagcacccctccattttcacagtagactctgacgaatctcctggcctctgcactcacccaaggataatcacatttagagggattctgctgcgcctgcttgccgatgctgccatcccatggctctgtccccagatgtgccacaaaccttcctcactgtctctgaggaggcttacttagttgaagacaaggcttattttccaagcccatcctcttatgtcttagggaaattgcttaccagaagcttgtcaccaaagtggtctgatcttatcctccacctcaggggaggggtgggcctagaggcagagtgagccctttgtgtcttccatggaaagggaaaataaatcaacagaagctgccctctgcatgcccctcctcagcaccatggaatgcccagtcccactcccgccatccttgccagcctgagagggccatcctggccctggtgtggcaggcccagttgggagtgaaccggaattctccagagacaaagctctgattcaccagccaggccctgacatagccgccccctccagattcctggggggtcagtaaacaaacagggtgacccctgcctcctggcctggctcagcccctcctgcctccctgagagggcttgctcagagcctgtcaggattctgcctgtttgtggctcaccagacactaggtctggattcctggtgagggatgatcatggagctgccggatcctgctatggactccccaggcagcacaggtaggatcagctcctggggctgcaggctggctgagtgctgagcttttcccatagcttgactgcttcctcacttccctttctcggtgtggctgtgagctatggttttaatgggatgattggtttcctaaattgcctggagagtcttgtgtgggaaagaagtatggttgggggcaaggggagactacaagagtcttggccactgactagcagggccattttctttgcaaatgaaggcaagcatgtagacaagcaggtaggcaggtgtgggtctccctagtctggggtagagcagcccaggctgatttcctcctccaattccccttccctctgcctgctcctgccccctggctgggcagttctgacactgttctataggtagctaccttccttagggctatccgggataaccaccattcccccaaaccccacaattacccccatagggccttaccagtgcccaggagagcaagcaatagactgtgtgcctgagggctcaagactagactttggcaggctccatggcttgtcctcttggccatcaactctggtcagagtcctctgctcatctttatgagcagttctcttgaagactgtgtccaggcttcctgactgtggtggacacatcaaagccaagtttcatatgggaagtaagacgtggaccactgatagttctctcttgccagtctactccctctataaatctttatggagaaactcctcagcttgcttttctagaaggttgggtaaactgtaggaccctgaagtatgagccaacagcttacctgcaatggtatggttgcccataatttgggcaattctgtgcagcttcttacctaatgcaggtacttccaagaccccatctgggcagtggtcctgaggagtgggggcccagcttgggaatgttaacctttccctaggtccaaaatttataatcatgagtaacaataatagtaggcagcagttctatgtaactgacctgtaccaagagaagacttggcaatgaacaggaccacagggtctttcttcatctcagtccctgaacacacagagaatagcatttctgaaccctggcagcaacccttctctccccttgttcacacttgtctcacccttggcttggtgcagaccagggtgtggcacaatccaaggatcacaggatgtttgtgtttctgtccaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccctgaatactttgtttgagttctcgaaatgttagcttccatttgttttttataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttggaaaaaaaaatgttttgccacttaaaaagaagactgaacatcactggttttactcattgtgtgcagcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggtaggttagaatcagagaagccgtggtgtgtagcctctcagctggggaggaatcccttcttcagtaccctgacagacacccagctctgctgagacacctaaatgaataggaggctgtatgcagtcctattagtctgtggctagcatgccacagcctaagtcaaatattttctttctacccctcccatcaaattctagcctcccttaaaatactgccatgatttttaatgggaacatggggaaatgaacataacataatgctaagtgaaaaaacacaggatacaaaactaagtgcaagtggatctcaattgtataaaaatgtatatagatgagtgtgatgtttacatacatataacagcataggaaggaactatatcaaaatgttaacaatggttaactctaggtaataaaattggagttcttaattttcttcatatctttctgaaatttctaatatttctgtgatatatattactgctgtagttaaaatacttcttaaaatgactacagaatgaaatataatacagcaataaaataaactataaccacgtgccacagcatgggtgaatcttacagacagacaatatgttgagtgaaaaaaagccggatacaaaaagagtatatactgtatgattccacttatacaaagtttaaaaataggcaaaactaatcagtgattttacaagtaaaaattgtggtcacctttgtgggaggggagggaggggtggggcatgaaggtgagatagtgactaggagggcccacctgggatgctgatagagttctgtttcttgatctcagtactggttacatcaagatgtacagttttagtttgtgtatcccgtatatatttcaaccaaaaatttaattataattttaatataaatcctgcctatcttggttttgatttccataagacccttacaggaagctttctgagtcttctggagaaccaagatccccacatttttctctatcctgtggcatagacagacaaatttcatactaaacagaccttccagtgtcagagttatttttctgtctatcaggaggattgcacgcctttttgtctaggtagttcaaagatacctgataatgccaaagaatcaagacacactgagaagaagaaaggttgtcaattgcaggatggaatgtaaagtgattgaaaaactttcctttcctgttgaccatattgctaaactttataggcctttatggaagaagtcaagtctcggggcccctacatctattctgtgctggagtcagctcaggccttcctgtcccagcacccatttgaggagttagaggagcctcattctgagagcaaaggtaggtggtcttctgtttttcccacttcttcttgagccatgtactgctgaatgctgaacaaacaccctcctgccttccccaaactcattttcttacctgttatctaggaggatagtttcccccaggagtccatccaaagttggggggaagcaagattcctactgcaggaaaaaaagcaaagagaatatagcctggagcaggggtcaacagttgtgtgacccaaagctgtatgtggctctttggagcagcatgtgtggccatttaatgagatgtggaaaagaaaaacaaaaaaccactcaaatgaattgaactgactcaatgaataaaagtaccagtatgtcctttaaaaacatagtgctggctgggcacagtggctcatgtctgtaattccagcactttgggaggctgaggcaagaagatcacttgtgcccagaaattcaagactagcctgggcaacatagtgagacccccatctctacaatttttttttgtgggggacggagtctcgctctgtcgcccaggctgaagtgcagtggtgtgatcttggcccactgcaagctccgcctcctgggttcatgccattctcctgcctcagcctcccgagtagctgggactataggcacctgccaccacgcctggctaattttttgtatttttaatagagacggggtttcactgtgttagccaggatggtctcaatctcctgacctcgtgatccacccacctcggcctcccaaagtgctgggattacaggcgtgagccaccacgcctggcccaaaatttttttttaaattagctaggttttgtggtgtgtgcctgtagtcccagctacttgagaggctgaaatgggaggatcacttgagcccagaagttcgaggctgcagtgagctatgattgctccactgcattccagcctgggcaacagagcaagaccctgactctaaaaataaataatatacaataaaataacaaactaaaataatcataatttaaaaatactgctttattccaacatcgagggacatgcaaaccagcaaataataaacctttataaaatctaaaaagttaggtgatgattgcctttgaaaggcaaattgactatgactctttggaatttttttgtgtttagtctttgtttttgagacagcctctcacttcataacccaggctggagtgcagtggtgtgatcacagcttattgcagccttgacctcccaggcccaagctatcctccagcctcagcctcagcctcagcatcctgagtagctgggactacaggcgcatgctaccacacccagctaatttttgtgttttttgaagagaccaggtctcgccatgttggccaggctggtcttgaactcttgggctcaagtgatcggcctgcttggcctcctgaagtgttgggattacaggtgtaagccactgcccccagccgactgtgactctttgatactgactccaataacttctagccccttcccttgatagagagggccactctggtctataaggcagtgggatgggactcatggtgactagatctgagtggtggtccagcaagccctcttctccaaaaagaatcctcaaccctctgagatggattgtgaatagcctgaaaggacccttcatgaattgagccctttgtcaatgccatatgcccatctcagtttatttctggcccttcaatgggagggctagtacttaatttgatgcccgatgggcctcagataggacaagctctagaaagagcagcacaattctagttagcctggggctatggggctctggatcttctgaggagagatctgagggaggaagaagaaatctacagattaggagcctaggtggaaaagccagacacattataccaacttctcctgggctgagccttcataaaatgcctccctttggctggaagtgggcaacagaaactaatgcaaaatcacattccagggtcgtatgaatagggctctagatgacttgcctcactataccttttataatgtcttactttttcatttcctactgttttaaaatatgaggaaatcctcatgatatagtaagtggaaaaacacaatatggtctcttgactgtggtggcggatatataaaccaacgcatgtgataaaatcacatagaactaaacacacgtgtacacacacacacatacacacacgaatacaagtaaaactggggaaacttggacaaaattggcagattatgtcaatgtcaatatcctgattgtgatattatactgtagttttgcaagatgttgtcatttggggaaactgggtaaagggtacatgaaatctctgtgttattacttataactgcctatgactctacaatgatttaaaaataaacagtttttttttaaaaaaaacgtgactgtattaaagggctcaaccatggaaaaatatgtatttgtgtgtgtatgaatatatacacaaacatgcccacatgtgcacacacacatacacacacattttataaagggctgtttctgtctctttctttgagctgaccctgcctggttggcctaacctggcttcctgcctcctcttgcagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaaggtatgcaagccccctcccctgactacagtctaccctgagacctgacactctccccagacactgacaatgtttctgctgctgagactccattgttggcctggactacaactgagttgctgtcagtttatgtgctagatttggggctggtttggctggagtctcttctgttttcctactttcttctcttttcctggtgttttctgaggatgagaggaagaggataaggacagtggccgcccacaccttagtctggttgccctaataggcaagcactaggctgtgttattgaaacaaaacctctgggtgaagagggaagagtagaggtgaatgactaatgtttcttctttcccactctgtctgctgtggcacttgggtcctggttctccagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggtagaagagcagcctggagtgaaccatggggaggtgcctccatataactaggcttgggggaaacttcttcaggggtatggaaataggatctgcatgggaaaagaggagtggagaatgtggagctagggaatgggcttttcaacctctaagctgcagggaatgattaaaatgaataagaggggtctttctggatttgggcactcagggtagacaggggcaggggaagagtgactgtggcctggaattagggatgctctgctgtgacctttgggagttctgggggatggctaggagttgggtgacggtgggagaggctggaaccagagaaaagccagtccctgaggaagctcataaagattcccagaggcacctggggatcccactctaaatagctggaatgaatctactgacctcaccctgttctttccataggcgtcagttagtgagaggcttaagcagctccaggatgcccaccgggactttgggcctgggtcacagcactttctctcctgtacgtgaaccaaactggactccacttagcagaacctcagccatcttcctggagagtctattgttatcccctggggccctggtgggagcccagtataccttgacatccgagaagcagtaaggataaaacagtgtggtatagtggttaaaagaacagtctctcggctgggcgtggtggctcacacctgtaatcccaacactttgggaggctgaggtgggcggatcacctgaggtcaggagttcgagaccagcctggccaacatgcaaaactccgtctctactaaaaatacaaaaattagctgggcatggtggcgggtgcctgtaatcccagctactcggaaggctgaggcaggagaattgcttgaacccaggaggtggaggttgcagcctgggcgataaggatgaaactccgtctcaaaaaaaaaaaaaaaaaaacacaatctctcaaatcggagagatctgggtctgaggcacagcacctcaacctaataactgtgcaggctcaaaaaaaaaaatagcttactctttctgaacctcaattttcccatctgtaaaaggaaggaaaaatattacctagctcatcaggttatgggaattaaatgactttattttttcaacaatatttattgagggccttctgtgggccagatactgctctaggcactggggctgcatcagtaaacaaaacacacagaaatccttagacagcttatattctagctggggaaaccagaccacaaacaaataagtaaaatatatataaggttacttggtgacaagggctatggacaaaaagcagggaaggcgtggatagggagtgctggacttaagcatggaggtgttgcaattttgaacagggtggttagcagaggcctcactgagaaggtggcaattgagcagaggtctaaagtagatgaagagatgaaccgtgtggatgatagctgagggaagagcataccaggcagagggaacagcatattccatacctttaaggtaaggatgtgtccaagaaacagtaaggagagcaaagtgtgggggagtaggggaggctggagcatgtaaggccttgtaggcaatgggaggaacttcagattttattctcagtacagtggagaaccatcggcagggtttgagccaagggatggcatgatctgccttatgtttcaacagagtcagggtgttgagaagagactactggggagcaagagtgggaacagggaggcctatttggaggtacattgcaataatccaggtgagggattatggtggcccagactagggggctggtagcagtggagatggtgagaatatacagacagaaaaatgagatatgcacacaaagcaatgagcataatatctggcacatagtaggagctcagtaaatgttaactgtggttaaaattgttgctattataatcattggcatacagctatacctgcaggcggaggactcttgtaccgaggaaaactgcagtgagcaagctggccatgtaaactgagccattcgtggaaggtccaaaagatagacacaggcagagagaggcatgagtttccagagttcctcatgagagagagagaaatgggcagtaccattacccacagtcccacaggactgagaagcttgaccttctaggggaagagctttgagccctaaggggaaagtggagtctacttcatatccgcaagagtaatccagctgcctgcagctgatgggtagaaatggcagtctgctcagggagaagattgtcagggtggccaaggccaagtattcctgttcatgcccttgccacatctctggtatgttaggatatcggtgacaacctcttctccttgccttgccctaacatcagggagagaagcgtgttcattagaactctttgtcccaccctcagaggctgttaagagctggcaatgaaattcagacatccccttttgggcttgacaacctctttgggagaatagagcaagggagtagctgggggccttaagagcattagtggccagctttttttctctttctcttctcctttaccagcctctgtccaggttccctgggaaagagcaatttcacccaataaagttccctactacatcaagtgagtgaccatctgaatcagaagcgggtcagtcacctgcccaccccctccctctcctgcctttttgctacctgtccttgtcactctgtctgttgggattcctccatccagttcggtttttctcctactcatctcaagatctcaagattctacttgggtaaaggtgaacccttgggctttggcatcttgggtttaccctcgaaccctgcagcttcttgcatccaacctgtcacttgagtggtgtgcacatctgagtgtgggggtgggtgggtggtatagatgctggtactattgatgctattgtttgtagccaccaggctcagaccacatgctgggaccatcccaagatgacagagttataccaaaccctaggtaagaatgtgggcttcctgtatagggtgggcatatacacagctgcctttgtcctataatgtccatctacagatgaatggataaagaaaatgtggtatatccatgtaatggaatattcagcctttagaaagaaggaaatactgccatttgaaacaatgtggatgaacctggaggacattgtgctaagtgaaataataagccagaaacaaaaggcaaatactacatgatctcatgtatgtaaggaatctaaaatagacagactcatagaagcagagagtagaatggtggctgccagtggctgaggggaggggaaaatggggagatactggtcaagagtacaaagaagtttcaattatacaagatggataagtcctagagagatctacggtgcagcatattacctatagtgaacaatactggattgtatcgttaaaaatttgctaaaaaggtagatcttatgttaagtgttcttacagaaaaaaacaataaagagggtagttggaactttttggaagtgatggatgtactaatggcatagattggggtgatggattcatagatgcatacttgtctccaaactcatcaacttgtagacattgaatctgtaaagctttttatatgtcagctataactcaataaagtggttttaaaaagaatagaagagaatcgcagtcaataagcaggtgggagagggaatgagtgcctcatcgtttctccaacagcctgccttcctttatcctcgcacctttctcaactggaggctctacattcccctctggaccattttatcaccggattagtgcattattcttacagatgtgaagtctgatttgctttaaaagactgtccaggctgtgatgagcgtaactcttgtgtgccttatctttgcctactgtgagagactcatcattatgtttgttgcacattttatccatgctgatgcatgtgactacagttcattcttttttaccactatagaatgttccattgtatatagcacagtttctgctgttgacagacacgtgggtcatttcttgttttaagctaatgaggacagtgctgctgaggagtttcttatatgtgtcttccagtacatgtgtgcaaagatttctctggggcatgtttttcagtctgcaggtcataacatcatttcagtgtgttgtgacaaacatttaaaaagttgaaatagaccaggaaatattaatatgcaacagatccttagcaagagtcatagttgatattaattttgttgttttcactctatgcaatctagtaaggaattgcttcctgaaatgtttgatttagttatttttacatatatacatgtatactataaaatgaatttcatactgtaagtcttgatcaaaaagcatttgcaagtcactgctctgggatatatagctggctgggtggtgggatatgtgactgttccattttactaggtgataccaagttgttttcaaagatgattgtgtcagttcacactttcactggcagttctcattcatccccactcttgttgacacttgctattgtcagacatctattggttgccagtctggtgggtgtaaaatggtatcttgttgcggctttaacttgaatttttctgatctgagtgggtctctctccattctttgcagctgatctgaacaacattaagttctcagcttatcgcactgccatgaaactccgcagagtccagaaagccctgcgctgtacgtctcctgttgtacttccctatgacgttcaccacccctctcctgttcctcatctgtctgctgtttctcattttcctcccaccttggcaaaggttgttgattggcttggtggaaactctccaaagcctgcaatatgctagctgtcaacttctgctcttcccagttcccttccactctcgctaggccccagacgtgtttccaaattaaccccactgttatgctcctccttgacccttttcccatgctcagtatgtataatcaagcaactgctttgtgacaggaagtactgcaacccatgatttgccatcttggggttattggatgtagcagcaaaactgttgaagcaaataccagtggttagggaacagtgtggctgaggatataatatgccttctggcctttctcggagacactgttcattcagacttcctggctcaggcatgtctggctaggctgagccagcatttgggggtaattaagatgtcctcttgatgtatgtcacatttccccaaccatacctgagccttcattgctggtgtctaggttctcagaacaaaacttacagacgaacctatttgcaattgaaactcatgcaaagacagaaacttaaaatgggatttgatcccttgagagttagtataacataggagttgagtttactcatgtcccatcatctttttgaaactgatgtcaaagaacattggatataaaaacatgttgggttaatttgaggaacattttgctgccttctgcctccttggatgagggtcttagtaaaggacaagcttgtatcatatttgcaaatggttgatctggagattgagtcaaatttggtgatgctggtggctttatctccttatttaatccctggggttctacttttggctatattttttttctcttctcttctttccttaccagtggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgataggtaagggctttcagctctggaagcctccaggataaaattcaatgggatatctcaagtgggcctggtgggaaggtgttgctcccatagtagacttggacccagctcagcttggggcatggttggaacagggccctgctgggatcaactttgtgagggaaatgattgccaagatgttaaccctttacatacattcatattctcagtctcttctttttaaacctagtggtcgcagcggaaagatgcgggcattgtcttttaagactggcattgcatgcttgtgtggcacggaagtgaaggaaaaacttcagtgtgagtagaactccaaagtgtggagtggtgttgggtagagggaaaggtgttgcagggaggaggaagggtgtaagataagcagaaagtacatcttgtgactcagcagagggctacttgggctaccttatgatgcttcttggttcacactgttgcaaagaacacatgacagccaaaggacaagatgggcctaaggcctattactattcccagtgtcactccaacgggcttcattccttctgaattgatggaagtacttagtcaggatctatgttggcattttgaggtacccagggccctgatgttctagttgcattcccctgtggcctatcaggcttagccctcttccagtctgaagctcaagccatgtcactagagacttcttatatacacaggcagggcacaataatacccaatatctgggaggcggacactatgttcttctgtagtttttcacatctttggcttatagtacctttgtgttcccctctgtcctccatcttgtgttcagcattttgaacttctcagtagcagcatgattagttgttgagtcctaatatgtgactgctaaatggggtgagtgctaagttaaattagacgtggtccctgcttccaatgatttacagtccagaggaggagatggaagtacacagaaagcattttttagaaagtactgatgagaataatccaaatggccaaaaatatatcctatatcatatgacagaaaagagacagatgacagcagtctggaaaaactttacagggaagagaacgtttccaaacatgttcgtggctatgatattatgtatttctctcaacatttccttgcaatgggatgaacagtgattatttatcatcaatttaaaagtaaggaaactgggctgggcatggtggctcatgcatgtaatcccagcactttgggaggccgaggtgggaggatcacttgagcccagaagttcaagtccagcctagacaatatagtgagactccatttctaattttaaaaagtaaggaaatggcagcatagagaggttcatgacttacctatgattctacaactaggcagtaatggacccaaaactcgaacctaggctctctgccttctatttctgtgtattttctaagccttaatcaaggtatgaagcagacagagaataacctctggaggaggtttgctaaggctgaattgggatgtggaagggaacagtcctagaagggcttaaataacccatatacaaagataagtatcatagtagattccacagagacttagagataatttttagatgatcagatgttttgaattagcttctctttttggattatgcatgccagtgtttccttccatttgtgtggacaattgagagattactgcagtgtcagactacataaacaggagagatggtatggcagcctgactgtgactcatgttcaggtgcccctgagcccgtaccccatcatcctgcttctggaagaatctgttttcccaacagtatcatatctgtgtctggcactgctcttacacacagtgcactcgacctctctctctcttgctttcactctctctcactctttctctctctgtctccccctccccctgatattctctctttgtgttggcctgatttttctctctgaactcagagaatgctctttttagaactcggctactagaaggtcagggatagacctctatgtagtccagtttgaaaagtcattagctcagtctgtgctctttccctattttccttttctgccctttctcctcaccattctccggccattcctgtgtcggggttggccattcttgacggtggggccagcagacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttgtgagtatggaactggggagtgggggagggaagggaggttgcaggaagggtgggaagaagggaaggaggactacgagctaggcttttgatctgaagtacgcagatgcaagggagtttattgggatggaacaacagggcagagggttctctgggctctagaatcatagtcctgttagggagggtgtcagctcaactagcacagggcagaacgtgaacatctctggagaacaggccaacccagcccctgctggttctcctgcccctctgagggctgccattctagggataagacactttgggcctcagtcattcccattggtcttcttgtttccgtagagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtagggaaaacaatacctgctgggatgataataataaatatgtcatgtgacatataactcagatattaaaaaataaagtgtcacctaattattatataattacagctagtctattgtacattattatatactgttataatcctttatattgcagaatgtttaattgtttttaaatgggaagtgaggaaatattttgttttagttgtattataaagtattacagacctacaaaaatgtatagaagaacataggtgtaagagcacctatgtactaaatggtatgccagcaaatggttcacaacctactctctagaaagaaaaaaggaaagctgatctgtagcatttgctaatttctgtgatgtatatactcccactgtgaatgacatcaggctatttacaagaggtctctgagcagagtcagaaacagatcctcagttgcacaccatttatatagtatgtcaaccatgcagatacaatagatgttaagtaacctcaagaacatagagagtagcaaagtaattaggaagtaatgagttttgagtatttattacctttgtttgtaatataatttatttaattgtgagtttatataatttaataatggctagatttaacaactggcttagaaaacccctgaaattttaacagccaactgtcgtgagctggtatgagctggcatcagcacaccacagtatatacctgtgaccaacttaaggaataaaacattactgcaatacatctgaggtctccttgattatattcctctccttccccaacaaaggtaaccactatcctggattggactttcatcataaaacactcaactttttacctttgtaaaacactaacccacaactctccctgtcatcaccctgcttttcgtaagatgagcaaatgaggcacacagctagttagtggtagatctagactagatattggatcatatgactcctctaagtctaggcatttcactgtcctatgctacaaggttgggcagttcagccaggctttggaagtagatctgaagggctattctttgttctgcaataataggtatattattatgaacaacctttggaaataacttttagccaacttagccaaggctggtagaaagaactgccttcatattggaagtgtaatttctccagggtaggtggtggtccctgggagcctggacctgtttgggccatccttgtttagaaggccatttgatatgatgagatatttacccctgcttccctcctgtctcccttaaacaaaggtggtgagacaatgctatttcccacacttcatgggaatctggccttgtgatttcatagagatttatggtctctagaataaagttattcatctattgagaattcagccactgctatgtatacgaggttgggcatgttatggctccatgcctcattcatccccttctactgtgtgtgtatattttaatgttaggggaacagcggggaggtcactgtggcacgttggactctctttcctactacatctcctctcccccaaggtaccggagtctgaagcaattcaacgttgacatctgccagacctgcttcttgacaggcagggccagcaaaggcaataagctgcactaccccatcatggagtattacacaccggtatgaagcctccaggctgggtgggagggttaggcagctctcaggtactaggccttgatccactttgcccagcattggctcattgttttctgctctcccgtggggagcattctccaaggagctctggtgattcactggtttgggaaattcaggcctctctattcttccagcagagcttctccctcaccaggcctggccacagctggcccaggacactctcagccatttaaagggcactcactgttttactgcagagaaaagtctcaggaaaaacaaaacaaagcaaaacaaacaaacaaacaaactaaaacagagagagcaaggcagttccaggtgattcgccttccattgctcacttgagtttttcctggctagcttcctatattgcttctgtactgggtcactcagtctttccctgatgctttgtcattatttctaccccttctagtcagtaccaaagcttatgctcaaattaattattcatcccttggagggaaaaaagaaaggtatgtcctttacctggacccccaaactccacttggttttccctggtaaccatgtcctccatacttgccttagcccagttcagtcagcatccctgaactccagccacagagttgctcctgtgctgtgtctaaaacccacagctccatgcttagcttccagcactgactctgctccctactcatctttatccttttctgtccccgcagatgctcccaaagccctgatcatatccccagctcccaccactgctctctctcccctattctgtctatttttcttttttttttttagaatttttttttaattttactttcacctttttttttttttttttttttttttgagacagagtctcactcttacccaggctggagtgcaatggtgcgatcttggctcactgcaacctctgcctctgaggttcaagcgattctcctgcctcagcctcccaagtagctagtgtctcctatttttcaacctgtttccccacaatccatctgtccaagctttcatctcttcaaatcctgttgacacagaaacgtgtggcctggtgggaacagggaccatgccctttacttttcatttattatcattttaaagaaaacattagaaaagtcatacatggaaaactggctggatctggtagactgataatcctctaccacctgctcgtcctctacatccttagaattcatagaaaagctattttaaaaattaacaaacatatgctcattataaaatattggaatcatataaaagcgtttaaagtataaaaaaaaggctgggtgccatggctcacacctgtaatcccaacactttgagaggccgaggtaggaggatttcttgagcccaggagttcaagaccggccttggtaacacagtgagacccctgtctctacaaaattaattattattattattagttttgcttttagaggaactgagacaattaaatttttaagtataaaatgaaagtcctcctgtctcctcaccctggcccccacccctccagttcaacttcccagaggcaaccagtgttgagtttggcatatatcctcccagaccttcttctaggagcagggtatggtgggcatgagcaagagtggattacccagcaggctgtctgctctagcagagcagccacacctgcccagtatatctggaagccattagggtaagttcctctgccctgtctcctcctcagaccacatccagtgagaacatgagggactttgccacaaccttaaagaacaaattccgctccaagcattatttcagcaaacaccctcagcgaggttatctgcctgtgcaatcagtgctggaggctgactacagtgagacgtgagtactggtggctgagcaggggctgtgggcagcctcactgagcccgatcgtatgctgtgaaggggctgagtcccgagtgggctaggagaatgttccaaggtaaatcccactagtgatagggccgttcagcttgggcctgacctgcactctggcctgagaagtagactggaatccagtctttgtattttgttcccatcagctcttgcccatgtccataatgtagggagcaggagagggaggaggaaacaggctgcccagtctttggtcctccgagtctttgctgctttcttctaggccggcttcttccccgatgtggccacacgccgacacacactcccgaattgagcattttgccagcaggtaccaccaggtttgcgggaggtgggtaggagctgttgtaggaagtccgaggggaaaggatcttcagtcggggcaaggagaatggagtcagggccaggggatgtgcacagtggggtgtgcagcagccagcaagacccaacacttaggagtagttggggcagctctcaaagccaatgatcctgctgtgagattaaagtccttgagatggaagcaggccccacatcctgttttctctcctgcctctgctctttattcctaggcttgctgagatggaaagtcaaaattgctccttctttaatgacagcttgtccccagatgacagcatgtgagtttccacagctgcttatttgccagaaatagttctccttgagatctttgtgccactgtttgggaagggtatatcctccagggaatgggggtgtgtggtggttaggatccttagctccctaaggaaggaaggctgctttctgggcacggtgttcagtaagaaaggcagtcttccctctatcaatcaacctaggaaatgagtgatgtactagctctctgccatctttccaagtcccttcctgttgcaagatcccatccttctatacacaactttgaggaacgaagaatatgccctccctcatctgaagttgcagaaaggagccattatcttgtgctcaagatgccaaagccctatctagtgctacactaaccctgggagacatcagggacttggctgaactatagccaagggaactccctggtatgacagcccagagaaggggccttgtgtctctagggaggtccccaccctgctcagaggtcctaggagcttctggctacatggatcaatctgccctgactgggacccagatccctctagaggaagaggaaacaaaggagggtagagtaggggaacagcacagaaagggaaatgatttgctcattgtttcccggggaggggggtgggctgtaagtagaacccagatacctgcatcctgaaaacactctctcaatacccccaaccacagcctctgcctcctttgaacactttcatccctctcaagcctcagtatatgtcctttccctctcgatgtgacttagaagtgaatcctccagcatgcatttcctggggcctgagctgagagctgagttgtttctctgttcaacaactggtcacctactctgctttccccacacccatgcagagacgaggaccagtacctgctgcggcactccagccccatcacagaccgggagccagcctttggacagcaggctccatgcagtgtggccacagaaagcaaaggggagctacagaagatcctggcccacttggaagatgagaaccggtgggtgtgatgatagcagaaatctgtgtgggttcttgaggcagacagattgaatttaagtccaggcacttctacatcctagctgtctgaccttgagcaagttacttatattctgtaatcctctatttccttatctgtaaaacggggatgatgatcatcaaacctgcctcctagggtcacttgtgaagaccaaatgagatcaggcatataatgtgtttggctcagtgcctggcttatagtaagggttcaataaatgctagctattataataattatttgaaaacttttaaattttttttttttttgagacagagtctcactctgttgcccaggctggagtgcagtgtcgtgatctcggctcactgcaacctctggctcctgagttcaaacgattctcatgccttagcgtcccgagtagctgggactacaggcatgcaccaccatgcctggctaattttttttttttttggtatttttagtagagacggggtttcaccatgttggccaggctggtcttgaactcctgacctcaagtgatctgctcaccccggcttcccaaagtgctgggattacaggcatgagccactgtgcctggcctgaatccttttaatgtaacccaaatttttccaagaacacacaagatgcaagcagagagaatgcatagagaaaacaggagagggtatgacatgttcctgccctcagagacctttcaatgttggaagtggaaagaaatgtgtatcacctagtaaaagtattccagaggacaatgacactacatagagcgttggaggtctggaatagggatggtgaagaagaatacagggaagacatgactttccataaagtaaaggtggcagcaggtacctaaggagggtccaagcctcttatggggcatgaagtagaattcgtagtaccccttagagcagtgctttgcaaacagtagtgcataagatagtcacttgggaagcttggtaaaatacaaattctaagtcacaggtctgggtggggcctgagtttctgcgtttctcactagctcccagtggatgcccatactgctgttccacaggccacacttggagtagcaagtctttagaacagtgctactcagagtttggagagcagaccagggccagtttgtgaccagtttgtgaccagtccaaggcaagataaaaaaaaaaaaaaaaaaaaagagagagtaagcttttagaaacttttacagcaatttgacattgctatgatattcaagcaccaaattagtaggctcatctcgttgaatagggtagagaccagtttgagtgttgttgaacttgtgtgatgaattacgtggtgtgagctatgtactagtcatgtgcattgggaccacatactggtccacaacagagtgaaaaaaaaaaaaacctggatttttgccatgaatcatttgagaaacactgcctttgagcagcagtctgcaggccctgggaaacactgggctgagagtgactgttctgttgcaaataaagaaaaaacgaacaaagccaaaagtgatatccccaaaagtaggccacctgtttggaatttgtttttttgatgacccagcatgggtgttcaaagtgggccaaagaggaggattgtggagagaagaggcaagacaggtggtctcttgtttatgttatgttttcccttggaatctaaacatctaaaaatggagtaggtgagtcagtggccctaatgcctcctttatttgcagactgtgtttctgcctgattttaaggtcagaattaatccctaaagcagcacatcaaagccctgagacatttcttacgcaaaatgtcaactttctctgctctgaggtctcaggatggcagagtaaatgacatatgtgctggagaggaagtggatgtggccattcaagcaagagcacagctgggggtggggatgggggtgggggtgaggtagggtggaagagcacagggattgttcacacctaggcctgaggggacatctgaaacctggacagtcagagccctgttagagccataggtcttggtgtctctctccatggcaggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcaggtgaggatggagacaggaaaagagccagggtggcctctgagcccaggggaagggctggggagctgagggctgtggcaaagaagacacaagagagagctccttggcagtggctgtcaggtaacttcctgaagagaactgggcctgcggttggtgggggggcgggggaaagaagagactggtatggtcacatcttcagccaactctcttccacctaccttccatgccaccctgtgtgtcactctccagccactgtggggcctggggcagagagaagacttctgagggcttatttcttcacaacccattggaatcccatactaaaagaacaaacttcaaaaatcatctaaaacattgattttgctagtatggtatttgctagaaagaagtgggttgggacaagtttggcaagagaaagattagtgctatctaaaggtgtttcttgttactttttgcacctttcatctctgagaggcaatgtgtatgctgtggtaaagctctggagtcaggcagctctgggtttgcatgtggctctgccaattgactgtggggtgtttggacagttagttaacctctctaagccccagtttcctcatctgtacaacagagatggtaacagtaccaacttcatagaattgtggtgaacataaaaggagataatgcatttatggaatttagcatgatgccaggaatttagtacacacttcataaatgttacctattattgtcattatatgtaatggaaaataccactcttctgcctcttccccagatcctccaaggaatggcctctatggattcctggaggtttctaacatatgctatgtcatgaaccaaggatcaggtgtgaaactctacatttccagagagaattgtgttctaaatagcttaattatagctgaaatgacagcaagagacctttaggtacaatgccattctttatttaattaattaattaattaattaattttcaagacagagtttggctcttgttgcccaggctggagtgtaatggctcgatctcagctcactgcaacctccgcctcccaggttcaagcgattctcctgcctcagcctcccaagtagctgggattataggcatgggccaccatgcccggctaattttgtatttttagtggagacggggtttctccatgttggttaggctggtcttgaactcctgacctcaggtgatccgcctgcgtcagcctcccaaagtgctgggattacaggcgtgagccaccgcgcccagcctacaatgccattcttataagaactgggagcctttgacacatgttgttaaaggaagaaggtaatgggtaattcaatattctaagaagtttcctaaaagtggaagccactgttttaggtaataccaaaagcttcttaaagtctaagggtaaagggatggtatgaagtctctcaggtcccttctaagctcaggagtctgtcagagtaaggtcaggaaggcaaatccacttaagtcatgccttacctcttgctagccacccaccgaatcagatggcagtggctctgcaggctcgtccctagcttcctctccacagcagtcagaaggcagtcacccccgggagaagggacagactactccagataccgaggctgcaggtgagttcccctggcctttcccagcccctttctccatggctttgtcctgccctcgatttcctgcccaaggctttgcggggctgggactggtttctcctcttggctttgtgcttagggtcagggatgattggtttactgattgattaattcatatgcttattccacaaataaatatacattgagcacaacctatgtattaggcattgtgctgggaagatgcaaatgctgcgggcaggtctgcccttcagctggcagaattctatctgaccccttggcctcataaaggagtctctagttctcttctcaaatctctgttttttaacccagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttta

SEQ ID NO: 3519 - DNA, 19548 bp, human
atttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggtaagaacttgtatctcagaacaaatatcttcataattatagtttaattataattatagttctacttggattctgacatttctatttcaggtaggctataaaaactcagaacatttgtttcccaggaatcatgttctgttaagcagtcctatcatagcgtgtacttttttggcagcattttttcctcctgtacaataccacctatcatgcaggttgatttcctggcaaaacagctgtgacaatgatggacccattcacttaccaccaatactaacagcctgttccctggacagccaagatacggctcctctgaaatcctttctgtcacctcaaaaggggcagtgagaagggccagcattattcaccaccatgcaagacttttaaagctcatctcaacaagtatttggctctcttcccccacactgatacctgtattcaagcaattacttagtctaggcagctatattaaggatggggttcagaaacctatttccctaattagggttacttaatataccaagcaaactgcaactaggtaagcctttctttagcaactacaacagaagggtagcagtgagaggcaggattgtagagctaggagaaagcattaactgtagctactaagagacaattatgagtttagagtcagcttcatcctaacttgacttatacagtgcacagtatctcatggtacatggtcttgttagtaacatttgggaggtgtaaagttttatttaagggagggctttctttgatatatctattctgttagctgccaagtagatgtttagttcttctgatttttcaatttacctcctttttaggaacatgcttgtactgtcaggaacctagcacgttctcaaagtgtcaagatgaaggataaactaaaaattgacttattgcgtaagtagttaatatccattcactatacattgaacaataatttattaagggattgctatgtgccatacactgtacttggtactaaggatgtgaaaaatgatagaatatggtctctgacttgatggactcatgctttagagaggcttaagtcctcttcttttaagaggaaaggaagtaggaatattgcaccttgagttgagtgattatcatagtgtgtttaaggaaacttgggggtcaactgtggggtttttatactgctggtagcctcccatatataaactttatgatttctgaacatccaagggaatgacaaatggatatgccattctttgtttataaaggtgacatgtatttctttctttctttctttctttctttctttttttttttttttgagatggagtctcgctctgtcgcccaggctggagtgcagtggcgcaatcttggttcactgcaacctctacctcctgggttcaagtgattcttctgcctcagcctcccaagtagctgggattacaggcacatgccaccatgcccggctaagttttgtatttttagtagagacgtggtttcaccatgttggtcaggctagtctcaaactcctgaccttgtgatccgcctgccttggcctcccaaagtgctgggattacaggcgtgagccaccgtgcctggccagtgacatatatttttcttttaaataatatttgttatattggcaaattgtacatccaataaagtggttaatatccaaatatataaggaactcaaacaactcaatagcaagaaaacaaataacctgattttaaaatgggcaaaggatctgaacagatatttctcaaaagaagacatacaagtagccaaaaggttcatgaaaaaatgctcagcatcactaatcattaggggaatgcaaattaaaacaacagcgagatatcacctcatacctgttagaatggcttttattaaaaaaaaaaaaagaacaataacaactgttaatgaggatgaggagaaaagggaaactttgtaccctattggtggtaatgtaaattaatacagccttttttttttttttttttttttgagatggagtcttgctgtgtcacccaggctggagtgcagtggcgcgatcttggctcactggaacctccacctcctgggttcaagcaattctcctgcctcagccttccgagtagctgggactacaggcatgcgccaccacacctggctaatttttttgtatttttggtagagatggggtttcaccatgttgaccaggctggtcttgaactcctgacctcgagtgatccacccacctcagcctcccaaagtgctgggattacaggcgtgagctactgtgcctggcctacagccattattttttttaaatggtatggaggttcctcagaaaactaaaaatagaacaaccatgtgatccagcaaccccacttctgtgaatatattcacagaaggaattgatatcaacatgttgaaggcatatctctctgcactcccatattcattgtagcattattcacaatagccaagatatggaatcaacctaagtgtaaatgtgatacgtatacacaatgctatactactcagccttttaaaaagaacaaaattctgtcatttgggacaccatggatgaatctagaggccatttgcaccaagagcatgtgtaaataaataagtaaataagtaaataaataaataaatgtttccacacaagtttatctgcctaaaaaacacacaaccaaaaataaataaattttgctagtttttttttttaatacagagaagcatataaaggagaaaacaaaaagtggctcataatctcaccagttagttaacacttactgacattttttaaaaaagataatataagttcatagttagaaaattcaaataaaacaggctgggtgtgatggctcatgcctgtaatcccagctctttgggaggctgaggcgggcggatcacttgaggtcaggagttccagaccagcctggccaacatggcgaaaccccgtctctactaaaaatgcaaaaattagccgggcatggtggtgcacacctgtaatcctagctatttgggaggctgaggcatgataattgcttgaacccagggggcggagattgcagtgagcagagattatgccactgcactccagcctgggtgacagagtgagactccttctcaaagaaaaataaaaaaatcaaatgaaaaagaaaagttcgaaaggagaaataaaactcttcttccttatggtgccccaacctcaataccacagataactgatactgtttcttgttacttccttattgacaaaactcttatgcataatactagaattgaagcaatctctctatttttagagttaattcacacaaaatgataaacattgttttgtatctttcttttttcacataatactagaagattatacctgaatcctcttgtgtcaaaagacatttatgtttgggacatctgagcagcaatattcagagtttagtatatggctgttgtatagaattttatctttatgaagctaattagagatttaacttgagatttattagcaccattctagggtcagtcaacccttccctcacccagccctttgaaaacacacatgtacaatgacacgattgaatgcttctaaaaaaaaaaaaaaaggaattggttttaatgaatggaatttgcttttcaggatgagaatgaaacatttattacttcacctatatttagttcacatccattaacaagaaacttagctacttttgcacaagtgacgtaaactaggaaaaaagagctccatatactttccatttcttttctttaggaagctattaattgtgtacacaattctagcattatgagagatagtaggtttcttggaaagactaatctgtcccacataagtcttcattattcaaaccttaggaagtttaagagttcactgggaagatatcaactttaatctttacttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaaggttagttacatgctatttgtgtgtctgccgggccgattagaagaggatcatgggccagaagaaaagagaaaaagtcagttgggaattaatttttaattcatttatatgttcaataaacatttattgaatgtgaactaaatgccaggcactgtatgctagcagtagggaatatagcagtgaataaaaagacctgatccttgaggttataggctagtcatttggggtctggaagaatcatacatttgaaacttctgttaatgctttcagttttctattgcaagatctagttttaaagtgaacccatccagaacctgaaaattgggaattgtggttatattcctaatgttatttcaggcttgtagaatcttgggcaaactacaggagtattgtggcttggcttcttcttttgtttaaaattaaacatgttattttgaaataattgtaaattcatatacagttgtaagaaataaaagagagatatcgtgtaccctttcgccattttccccattttgcaaaactatagtacaataccacaaacaggtaattgacatgattagaattctgcaatcttattccaatttctccagttttacttgtactcgtgtatttttgtgcatgtgtttagttctatgcagttttatcccatgtgtaagttcatgtatctgtctacacagtcaaaatacaaaacagtttcatcacaaggatccctcattttgcttttatataaccatgcccacttcccttccacctcacaccccagtctctgacacttggtaatcactaatctgatctctatctctgtaattttgtcatttcaaaaatttaatattaatggaattatatagtatataacatcagagactagcttattttttcattcagcataattcacttaagatccatataagtttttgtagcatcaatagtttattttttattgctgagtagtattccatggtatgaatgtaccacattacataactgttctccctttgaaggacatctgggttgtttacaggttttgactattataaataaagctgtgaacaggtttttgtgtgaatataagtattcatttctttggaataaatgtccaggagtataattgctgggtcatatggtagtcacatgtttagttttgtaagaaatgacctgttttccagagtgactgtaccattttatattcctgccaataatgtatgaatgatccagtttctccacctcctcaccagcattaggtgttgtcactatttttcattttagccattctgataggtgcatagtgatcccattgtagtattaatttacatttccctgatggttaacggggttgagcatctcatgtgccatctattccacttcagcgaaatgtctgctcatgccttttgcctattttctaaattgattttttattattgaattttgagagttctttttatattttaaatactaccagtgttttatcagatatgtagtttgcaaatatattctcccagtctgtagcttgtctttccatcctcttcgtagggtctttcagagagcaaaagtttttagttttgatgaagtacaatatattgatttttttgaaaacgatcttgctttttatagtaaatctaagaactctttgcctagcccagatcctgaagattttctcctgctttttttttttttttacatctttttaagcctgatgcccattttcgacttaatttttgtaaaagctatgaggtttagttcaaggttttttttttgttgttgttgttgttttgtttttgtttgtttgtttgtttttgcttttcttgccaaaggatgtctaattgctctcgcactatttgttgaaaaggctattcttcctctgttgtattgcttttgcacctttgtgaaatatcagttgggcttggttttatgggtctgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacgatctctgctcactgcagtctctgcctcccgggttcaagcgactctcatgcctcagcctcccaagtagccaggattacaggcatgggccaccatgcccggctaatttttgtatttttagtagagacgggtttcaccatgttggccaggctggtctcgaactcctgacctcacgtgatccgcccgccttggcctcccaaagtgctgagattacaggcatgagccaccacgcctggccaaaagcctgtatcttttaatataaattttagaataagcttgtctatagctatagaaaaccttgctagaattttggcaggaattacattaaacttgtagatcaatttggggagaactgacatttttactatattgagtcttccaatccatgaacacagttgccttggcttttatactctgtaaatcaacatttattgagtgcctactaaatgtaaaactaagttaaggatagttgtagagctctttaagctttactgaaatataggtatcataatataacttgtttattgtgttttatttcataggtccctgatgtcaaagaaatggaaaaaagcagctttactgaggtagagcaatcataatataacttcatttttacccttaatgtgttttatttaatagctcattagtttcaaatgaatcaaataaaccacagaagctacttttgagccttccttctcacctctaaccctcatcctaaacacatacactgggtttgattcactaaaaaatgaattcattgtttgatgtttgataactgctagaggaaaagatacaatttggccagtgaccccgtgtattctaatctgctctttttattctgatatttatttcaaaagccattccttgggagccagagctcacttttaacagcagttgtttgcaattgcttattccccatcaaaatcctaatttctatttgtggcacaacaaattggttgctgtggagataattatgtaaaactggattcaagggagaacatgcagctaagatccagtttttataggaacgtctctaataataaagatgtggggaagtgaaatctgggaatttggatctttaaaccaaattatttctaaataactaataaggaattatagttctttgccaatataaatcaggagaaataatttataactgagacctaagggttgcacctctgagagagggctttaccatagagctgcagattgaaaagattaaatgtctcaagtaatttgtttaattaggaaaaaagtaagtttactgtacaaaattctagaccctggctaaagattcctttataaatagcactacttaaagtagaaatttggttggatcagaatttaaagaggcctaacatttgaattcgttggtacgtaggagggcactcctgcaacacacagggtgttaaatgacagtattggtatccccctctaatccccaactttgcttcagtacattgaatctccagacgtggaaaatgaagtaaagagactgctgcgttcggatgctgaagccgtaagtacccgtatcctttatacaaatattttctgcatagtctgttctgccccatttgtacatgctgacgaagcctcacctctggtgtttgtgtgccagtcttgatgtgtggaacttaagattctttgaaatgttctagctaggaacagtaaattcatgtaatagaaaattatttattgtgtaattcaatatgaggcacttctccaaactaggaattccaatacaaatggcctaaagttggactaaattaaatagcactgttagccaaagagccccttccctttcagctgtgcctttttgtttccttctgtgttttccttgactacccactcctttcaggttgggaagtcattgctgaagatggaaccaaggaaatagaaagtcaaggctccatcccaggatttttgatatcctcgggaatgagcagccacaagcagggtcatacctcgtcaggtactttagtaaaggcaaagcaggagtttcagatagggcaggtattgactgggtatcagatcattttccataaattcataggccaatccaaaaaaaaaaaaacccagaaaaaaaggatggtttcgtccttccctctttttttttttttttttttgagatggagtcttgctctgtcgcccaggctggagtgcagtggcgtgatctcggctcactacaacctctgcctcatgagttcaagtgattctcctgcctcggcctcccaggtagctgggattacaggtgttcaccaccatgcccagctaattttttactagcgtcggggtttcaccatgttggccaggctggtcttgaattccagacctcaagtgatctgcctgcctcggcctcccaaagtgcttgaattacaggcatgagccactgtgcctggcctttttttttttttttttttttttttgagacagagtctcgctctgtcgcccaaactggagtgtagtggtgcgatctcggctcactgcaacctctgcctcccaggttcaagtagttcttgtgcctcagcctcccaagtagctgggattacaggcatgtaccaccacaccaagctaatttttcttttttcttttcttttttttttttttgtaagtagagatggggttttgccatgttggccaggctggtctccaactcctggcttcaagtgttctgcccgcgttggcctcccaaagtgctgggattacaggcatgagccaccacacccagcccttcttccctcttattggtctcttggcagtttaggggttttagattagtgttctaatctcccatccacccctggtattttaacttcctatgacccttagagtctctaaatatcttgatcattcactacatgaatgaatgttacagtgttttgcatttgctgtccttgttttataaagggaataatcttcctgcatgaaaaaatgatttataaaattcactggttgcctggggaatgtgaaaggagtataattatatctggagtatgagtcatttgcagagttttagatagttcaccttcttcttgcttaaaactagtagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaataggtaagtcagaaaaaacaaagggatgggaccagggtgggtggcagtgctaacagttgactctaagcatacattagactcaaagctaagctcaagaagttatcgcttcgatgtgtagtagagttttacttgatttggatcttggtccattcatttaggctatatttaatatataaagttctatgtttctctattagtcatggaaattcagaagcagattgagaaaaaggagaaaaagctccataagattcagaataaagcacaaagacagaaggatctcatcatgaaagtggaaaacctgacactcaaggtaaattcttggctggcataaagaaatcctgatatcttactttcagtatcttgcctttgtgtttccacttatgttatctctgtgcagggttcttgttcattcatgaacctaaacagcctcttagaaactcctaataaaagataaccctgtttccttttacctgagtaattttgatcatctaatataagcattttggggaagggactaggtgatatgagataaaaattgccaatattgagcatttgctatgtaaaaggcacataaagggctaagaattgtgtacacatattatcacattttatcctcacatccttgaaacgtaaatactgtcaccactcccattttatagataaagaatggaaactcaaagaggttaagtaacttgccagggatcacagtaaatgatccctgagtaagggatcttttagtagagatgaaacctcatctctactaaaaatacaaaaattagccaggcctggtggcatgctcctgtaatcccagctacccaggaggctgagacatgagaatcacttgagcctgggaggcggaggttgcatgagccaagattgcgccactgcactccagcctgggtgacagaggaagattccgcctcaaaaacaaaaacaaaaacaattatttgccaaactccttgcctcccttggtttttttttttttctttgagactcagtgttcatcatttatacaatttatttttcagaatcattttcagtctgtgctggagcagcttgagttacaggaaaaacaaaaaaatgagaaggtaagaagtatgttttcaaattaaccagaaaacatttgatacagagaatcccccacttcaattccaatatcattgctggctgttcctctcataggaatagtggtagccaaatcttctaaatgaaggtagcagggtggaacaaggtctttgtgaaaattcactcattcaacagatattgaatgcctatgaagtgaaaagcactggatgtacggtgttgaataagacaaatgcaatacagtaaatcctcagtgtcattgataggttcttggaaactgtaactttaagcaaaataatgtatatataatgaaaccaattttactataggctaattgatataaagaagaattaagttcctatagcatatttctggtcacaaaaacatcaccaaacttctaaataaaaaccaaaacgcttctaataattaaacgttgaaataaatgtgagctatacatacatttgagaaagactgataaaaacaagtaagacaattatgtacccagtgattccagttcagggtctcagatggccagagcctatcccagcagctcagggcacaaggtaggaaccagccttggataggatggcatcccattgcagggcacactcacacccacactcacacccacactcactcagactgggacaattcagacaaaccaattcacctaatgtgtacagggaagtgattttatttttctcatcaacattataatgaggccaggagtggtggctcatgcatgtaaccccagtattttgggaggccgacgcgagaggattgctttagctcaggagtttgagaccaatctgagcaacatggtgaaacgctgactgtacaaaaaattagccggttgtggtggcataagcctgtagtctcagctactcaggacgctaaggtgggaggattgcttgagcccaggaggttgaggctgcagtgagccatgatcacaccactgcactccagcttgggcaacaaagtgagcccctgtctcaaaaaaaaaaaaaattataatgaaatgacattgaactaacaatgttatttggagaccttttgcatgtcattttgcttaaagttgcagtttctaagaacctattgatgacattaagtgaggacttactgtaacaaaacgacattggacaaaacgatgttattcaaggacctgctgtacttatcctcgtggagctgtctagcaggggagattgacaataaacaaattatacaaatataaagttacaaattgtgaagaagtgctatgaaggaaaaaagtcagtggtgctattagaataaagggtcttgaattaattgggggatcatgatagacctctcctaggaggtgctattgaagctgagaccggaaggattaagtccaggcaaagagtgggatgaggagcctcttaggtggagcgtatgcaaggtctcatgctcagaaagaacttggcttctttgaggacctttggagtatttaaagccaggaagagaatggcttaagataaggttggagaagtaggcagagaccatagtgtatggttccttgaaggccatgataaggaggatgggtttggccttaagtgtaatgtgaagtccttgaagaattgtagataggaaaatcacatctaatttaaacttttttttttttaaatggagtcttgctctgtcgcccaggctggagtgcagtggcacaatctaggctcactgcaacatccgcctctcgggttcaagagattgtcctccctcagcctcccaagtaactgggactacaggcacgtgccaccatgcccggctaattttttgtatttttagtagagacagggtttcaccgtgttagcgaggatggtcttgatctcctgacctcgtgatccacctgccttggcctcccaaagtgctgggattacaggcgtgagccaccacgtctggcctaatttaaacttttaaaaggttactctgattattatctggagaatgggttggaagaaggtgagagtagaagcaaagaggctggttggggggctttgtggtactctaataacagaggatggtaacttggactaagttagtagcaatggagattgaaagaatatagatttttaaactgcaataaaaatgtttttataacagatgtaattcataaaccatacaatatcacccatttaggctgggtgcggtggtgcgtgcctgtaatcctagcgctttgggaggccaaagtgggcagatggcttcagcccaggagttcgagaccagcctgggcaacatggtgaaaccccgtctctccaaaaattagccaggcatggtggtgtatgcctgtagtcccagctgctcgggaggctgaggtgggaggattgcttgagcctgggaggcagaggttgcagtgagcagagatcccaccactgcactccagcctgggtgacagagtgagactgcctcaaaccccgtcctccccacccccgacaagtcacccatttaaactatacaattcagtggcttttagcatattcagagttgtacaaccaccactgcagtcaattttagaatagtttcatcactccaaaaagaaaccctgtatccattagtagtcactccccacttctccagaacctctcccctgcccagcactaggcaaccactcatctagtttctactaatctactgcctattctagttatttcatacaagtgaaatcatataatacatggtgttttgagtcgggctcctctcatttagcatattttcagggttcatccatgttatggcatgtatcagtacttttttccatttaaaactgactaatactccattggatcaatataccacattttgtttattcattcatctgctgatggacatttgggttgctttcacttttggctattatgaataatgctgcaatgaatattgatatattagagaatatactttaaaggtagaattgacaggagttgggtcaattactgggtgttgaaggagaaggaatcattaaggatgtatgtatttctaacttgaacgacaactgtatttttcaaagccacaagagagtgtacagggcgaagagagaagaaggcaatataggctaaatgagggtcaagcagctgtatagaaaatgtgtgctgactctaaccttatactgttgagggttacaattttaaagagactggagttggtattatgaggatgggcttagcatggtgctcttgaagtacaggcactactccccacccccatccccacaaggctagcggaatttttatgttctatatattcccttcctctcagcaaatcacttatccaagtactgcttaatactgctttaaaacaatcagatgaacagttaatgccaggattgttttagtacccaccaaacatctttgttttcatcaatgtaagtacagttgtatgctgcataacaacattttggccaatgacagactgcatatatgatggtagtcccataagattataatggagctaagaaattcctgtcacctggtgacactgtggccatcataacatagcagcagaattacttaatttttaaattattttactatagcctaagtatatagtgtttatatagtcttcagtagtgcatagtaatgtcctaggccttcacattcactcaccactcactcactgactcacccacagcaacttctagtcctgcaagctctattcatagtaagtgccctatataagtgtaccatttttaattttttatattgtatttttagtttaccttttctatgtttagatacacaaatacttaacattgtgctacaattgcctacagtattcagtacagtaatatgctgtacaggtttgtaacctaggaacgatagactatactatgtagcctaggtgtgtagtaagctatactatctaggttggtgtaagtatgttctatcatgttcgcgtcatgacaaaattgcctaaggatgcatttcttagaacatatccccattgttaagtaacacatgactatatttagtattgaggagcagcatagaaatgtagctgtaaactttatttactcagagtcccttatgttagttcatttatccaaattagatttagtaggtgtctactttaagctaggctctacagggagctatgatatgcttatgatgtagtctctgtcttcatttggggagaaattggcaagaggggtagggacttaaaggaatgacagattgtccatggatattaaagaagacttcatggagaagatggtgtttgactggggccttaaaatataggtagggttttaataaggagatagggaaaggagtgcattccatgagaaagcagcatgcacactggctcagaggtggtgatgccagggtgaacagtttagatttttggtgtaggtcataatgaaccttcaaagcctttttacctggggaataactcaggaagatttttctgccagaagtatataggagaaattggagtggggacagcctggagcttcaaaggtgcaagtggtagaagcaaacagagcttaacaattgattggatttacagggcaaaaaggggaacaaagatgagtccaaagcctgggaaactgggaaatgatgtgccattaactgaaaataggataacaaaaagtggatttggaggggtatgtggagaagtgcttttgaaaatgggaaattggagagaggcccatacacagaaatgatcattgaagctgtggggctagttgagttagcctggttgattgttcagcaagaagtctgaacctaaggaaaaacctatctatagggggtggtgggaagagaaagagcctgcaaaggagaaagaactggatcagtcagtggttgtaatcatggtcaatcaggggtcactcagcaactgagtgagaagagcctctaagttactgcggacagcaattattgtggcttggtaggtgatgtgcagcataggattgttttataatgttcctttcatttcacagactaaaaattcattctggtatggagtgtcctgaaatgaataatattcaaaaacaacctttgttgtaaagatggcatacatctctgaatgttattggtcactttaccatttcaagttaaaaaaaagtaaatcctataccacaaaatgttcagggcttctaacttagaaagcattaagtagaacatcatcaggctcctgattggtcagggctctggctcagtttctaagtatctcctaatgtggtaagaagcagctggtaagactcagtctaagacccattgtgttcattgggacaagagagtgtcccaactgttttatcatctgactcttagaatatggctacagagatcccatctcctttgcccctacagtgagctgtgacctctgtatattcttcacagaagcacaaattcttaacagcaaaaatattgtttttttttaaagcctattcaattttaaagcttgatatggtttgtctgtgtccccacccaaatctcatctttaattcccacgtgttgtgggaggcacctggtgggaggtaattgaatcatgggggcaggtctttcccatgctgttctcgtgatagtgaataagtctcacgagatctgatggttttaaaaaggggagtttccctgcataagttctcctctctttgcctgctgccatccatgtaagatatgacttgctcctccttgccttccaccatgattgtgaggcctccagctatgtggaactgtaagtccattaaacctctttttcttcccaaactcaggtatatctttatcagcagtgtgaaaactgactaatacaaagcttctcttcataaattgggcataataaaggacatcatcatggccacagcagtatgcatgcattcttgactgtggccagtattctctggaacattgcaagactaagataaccttataaatgccaaataacagtagttctttttggttcatttaagtaaattctagatcaagtaatgggacctcaaatttcaaatgaatttttcatgtctttctacctctccctacagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaa

SEQ ID NO: 3520 - DNA, 24804 bp, human
acgaggtgggccatggagtgccccgagggacagctccccatttcttcagaaaatgattcaacaccaacagtttcaacatcggaagtaactagccaacaagaaccccaaattcttgtcgaccgtgggtctgaaaccacctatgaaagcagcgccgacattgctggcgacgaaggcacccagattcctgccgacgaggacactcaaacggatgcggacagcagcgcccaggctgctgcccaggccccagaaaacttccaggaagggaaaggtaggtggttttttaagcttgttcccccagccgaggaccttctttcggagaaacaaactgcttttagttcgattcaaaatttgtttgaattgcggcccccttgaggagcaatgggcgacgtaacctgtgtccctctccagaggatgtaaaatgttgactctgttgaggagaggggagcaaccgatcgtgttagagggctttgggcacagattctagttgttcagtgggtttgcacggtggcgtgtttgtcactaggcgaggtcaccgtgcctagggacaaaccgtccgacctaatggagtcgaggagcaaccaaaagcgagcaactcgctttttttttttttttttttttttgacggagtttcgctcttgttgcccaggctggagtgcagtggcacgatctcggctcactataacctccacctcctgggttcaagagattctcctgcctcagctgcccaagtagctgagattacaggcgcctgccatcatgcctggctaattattattattattatttttatttattttttttatttatttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaacatgttggccaggctgatctcgaactcctgacctcaggtgatccacccgactcggcctcccaaagtgctgggattacaggcgtgagccaccgcgcccggcccaactcgcctcttaggagtatcactgtcccctggtaaaaatcttctggcgccctgaaggttgcccctgtgtaaaggtaattttttttttttcggacagagtctcactctgtcgccaggctggagtgcagtggcgcaatctcggctcactgcaatctccacctcccgggttcaagcgattctcctgcctcagcctactgagcagctgggactacaggcgcgcgcaaccacgcccagctaatttttgtatttttagtagagacgggggtttcatcatgttggccaggatggtctcgatcttttgaccttgagatctgcccgccttggcctcccaaagtactgggattacagtcgtgagccaccgcgcctggccaaggtaacttgttttgaagcctcggtcttgcttcgcgaggtccctgagcagtcgcgtccccctcagccctcccctcggcgctcccctcggcgctccgcgcctttcgagccttcccgcccagcacgcggtgagcgggccactgcctcgaagtcgtgctccagtccgctgggcagcgcggccgcggaggcgtggcgaggcggggaggggccggcgcgcgccgcttttactgtccaggcgccggcagcccagcgttcgcctctacgttccgcgcgggagcccacgcgcggttcgtccggaacccacagaccagagacgcaggtcccagccttttcggtgtcggcgccagttcccggaggagcgggtgagtcgggcggccgaccgggcggccgggaccgggtcagcgccccgccagtgtgcaccccgccgcggtgcaccccgcagccctccccagccagcctgcacagcgaggcgcgaaggctgggacccgttgcgacctgttgggcctcgcgagaagttttcaagggaaagtggatcaaagcctaggggtcaaactttctctttgaaagcttagtgccccggggataaggatggaggtcagtctcttaaactgcagccggagactgcgaacttgaaaaaacacccatttaggcgtgtactgacttgcatggcctggagcatgctgccaggcgccctccagccaattataattccaattgtaattctgctaaagcgagatggaactagaggtgaatggtagtaaggggtcctgttaatttaatcaggcatcaaagagtgcttgctggaaaaaagtggatgctttttcttaaagtgaataccgtacaactagtcttttaggtaaatgcaagtaaatttaaaaaataattaaaacccagttcaaccaggattgtctaacttttctcccaccagactttttattaggtctgtttatcaaacaaatacattgaaatagtttcagttcttacattctttcttccataaaagaggaattaccaaaaaggcttggaaatgaacaaaatgccccagttttagttctgctgagaaatctaaaagttactactgatctgataaaatcttgcttagcagctagttcttcaaataatctgttcctgctcccagccttaattgttactatgttctgttagggaatgtgctcagcccccagattttttatttatttcgatcaactctcttcttgcatttacatttctcttttgtatttatatatgcatatatatacatatatatctgtatgaaacaagaagagaagaaattacaatcacaaataatgcatctttccctctcccatcctgggtgtctgcttttctactgctgactttttttgttttgttttgttttgttttgtttttgagaaggagtctcactctgtcacccaagctggagtgcagtggcgccatctcggctcattgcagcctccatctcctgggttcaagcaattctcctgcctcagcctcccaactagctgtaaagatacagctaatttttgtatctttagtagagatggggtttcactatgttggccaggctggtctggaactcctgacctcaggtgatccacctgcctcagcctcccaaagtgctgagattacaggtgtgagccacagcgcccagctgtctttccacctttgagaaaaatcttcctcagaagtgtgggcctggctgggcacagtggctcatgcccacaatcccaacactttgggaggccaaggcgggtggatcacctgaggtcaggagctcgagaccagcctggccaacatggtgaaaccctgtctctactaaatatacaaaaaaaaaatttagccgggtgtggtggcaggtacctgtaatgccagctactcaggaggctgagatgggagaatcacttgaacccgggcagcagaggttgcagtgagctgagatgcgtgccattgcactccagcctggggtcaacaagagcaaaactctgtctcaaaacaaaacaaaacaaaagtgtgggccctaatacccaaaatgcagggctctacaaatacatcccaaatacatggaaaataagattagaaataaagtcttggttcattgtaagaacataaaattgaaaaacaaataatgaaaacaataaaaaataataaaataaaaacttgggatccagcaatcccacgtctagatgtatatcctaaaaacttgagatcagtgtgtcaaagaaatatccgcacacacatgttcactgcagcattacaatagctaagttatgaaatcaatctaggtatccaacaagtgaatggataaatatgtggtatgtgtacccagctgaatactattcagcctttaaaaagaaggaaattctgtcatttgcaacaacgtggatgaatctggaggatattatattaagtgaaataagccaggcagaaaaagacaaaaatcacatattctcacttatatgtggaatctaaaataattgaactcatagaagcagagagtagtgttggttattacaggctggagtagcgggaggggcattgaggagatgttgatcaaagaacagaaaatttcagttaggctggtccaatagtagtgggatattatcacaacttattaacattaatgccactaaagttggtatacaatctcccacttccaaatttggcttttaaaattaaaaaaaatgaaagttgcagttagggggaataactgataagtatttaaggtgatggatgtgctcattagattgattcagtcatttcacactatatcataacatcattgtgtaccccataattatatatgattataatttgtcaaaaaaagattaacttggaagaaagtattcacttcaccaaaggtatatatatatattttaaataaaaagatccatcttaggagttcttttaaatagcttttgggggcattcgaagtaagtggtgattgtgaggattatatgaaatgatagacctaatgcactcaatgtagtactgggcatacagaatgcacacaataaagggtagtaatgaatgaaagggtagtaacgaataaatcaaatcagattttatgttctccataaaactccatctcaaaaagaaaaaaaaaagagactccgtctcaaaaaaaaaaaaagaactggattccatgctgggcgcggtggctcaggcctgtaatcccagcactttgggaggctgaggtgggcggatcacttggggtcaggagcttaagaccagcctagccgacatggtgaaatcctgtctctactaaaaaatacaaaaattagccaggtgtggtggtgcatgcctgtagtcccaactacttgggagactgaggcaggagaatggcttgaacctgggaggcggaggttgcagtgagccgagatcgcaccactgcactccagcctgggcgacagagcgagactctgtcttgaaaaaaaaaaaaaagaactggactcctaacttttccccagggtagctcaaagctgttgttgctggctctagagtcataaaaaactgcctggtctcccatggactgcttaatttctactaatccattaatgtaggtgaaatattgaaaatcaagcccttgtttacttcaaatcatcacagaacatttatgcaagtggtttctaggcgaatttcagcttttggtttgcattcttccctacagaggttagtttgcttaggtagccaccaacgtgttgttgaattgtagtcttttacctgagagtctaagaatatgattaagaagacgaaatcatgtttcataacagctcttatttcatttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggtaagaacttgtatctcagaacaaatatcttcataattatagtttaattataattatagttctacttggattctgacatttctatttcaggtaggctataaaaactcagaacatttgtttcccaggaatcatgttctgttaagcagtcctatcatagcgtgtacttttttggcagcattttttcctcctgtacaataccacctatcatgcaggttgatttcctggcaaaacagctgtgacaatgatggacccattcacttaccaccaatactaacagcctgttccctggacagccaagatacggctcctctgaaatcctttctgtcacctcaaaaggggcagtgagaagggccagcattattcaccaccatgcaagacttttaaagctcatctcaacaagtatttggctctcttcccccacactgatacctgtattcaagcaattacttagtctaggcagctatattaaggatggggttcagaaacctatttccctaattagggttacttaatataccaagcaaactgcaactaggtaagcctttctttagcaactacaacagaagggtagcagtgagaggcaggattgtagagctaggagaaagcattaactgtagctactaagagacaattatgagtttagagtcagcttcatcctaacttgacttatacagtgcacagtatctcatggtacatggtcttgttagtaacatttgggaggtgtaaagttttatttaagggagggctttctttgatatatctattctgttagctgccaagtagatgtttagttcttctgatttttcaatttacctcctttttaggaacatgcttgtactgtcaggaacctagcacgttctcaaagtgtcaagatgaaggataaactaaaaattgacttattgcgtaagtagttaatatccattcactatacattgaacaataatttattaagggattgctatgtgccatacactgtacttggtactaaggatgtgaaaaatgatagaatatggtctctgacttgatggactcatgctttagagaggcttaagtcctcttcttttaagaggaaaggaagtaggaatattgcaccttgagttgagtgattatcatagtgtgtttaaggaaacttgggggtcaactgtggggtttttatactgctggtagcctcccatatataaactttatgatttctgaacatccaagggaatgacaaatggatatgccattctttgtttataaaggtgacatgtatttctttctttctttctttctttctttctttttttttttttttgagatggagtctcgctctgtcgcccaggctggagtgcagtggcgcaatcttggttcactgcaacctctacctcctgggttcaagtgattcttctgcctcagcctcccaagtagctgggattacaggcacatgccaccatgcccggctaagttttgtatttttagtagagacgtggtttcaccatgttggtcaggctagtctcaaactcctgaccttgtgatccgcctgccttggcctcccaaagtgctgggattacaggcgtgagccaccgtgcctggccagtgacatatatttttcttttaaataatatttgttatattggcaaattgtacatccaataaagtggttaatatccaaatatataaggaactcaaacaactcaatagcaagaaaacaaataacctgattttaaaatgggcaaaggatctgaacagatatttctcaaaagaagacatacaagtagccaaaaggttcatgaaaaaatgctcagcatcactaatcattaggggaatgcaaattaaaacaacagcgagatatcacctcatacctgttagaatggcttttattaaaaaaaaaaaaagaacaataacaactgttaatgaggatgaggagaaaagggaaactttgtaccctattggtggtaatgtaaattaatacagccttttttttttttttttttttttgagatggagtcttgctgtgtcacccaggctggagtgcagtggcgcgatcttggctcactggaacctccacctcctgggttcaagcaattctcctgcctcagccttccgagtagctgggactacaggcatgcgccaccacacctggctaatttttttgtatttttggtagagatggggtttcaccatgttgaccaggctggtcttgaactcctgacctcgagtgatccacccacctcagcctcccaaagtgctgggattacaggcgtgagctactgtgcctggcctacagccattattttttttaaatggtatggaggttcctcagaaaactaaaaatagaacaaccatgtgatccagcaaccccacttctgtgaatatattcacagaaggaattgatatcaacatgttgaaggcatatctctctgcactcccatattcattgtagcattattcacaatagccaagatatggaatcaacctaagtgtaaatgtgatacgtatacacaatgctatactactcagccttttaaaaagaacaaaattctgtcatttgggacaccatggatgaatctagaggccatttgcaccaagagcatgtgtaaataaataagtaaataagtaaataaataaataaatgtttccacacaagtttatctgcctaaaaaacacacaaccaaaaataaataaattttgctagtttttttttttaatacagagaagcatataaaggagaaaacaaaaagtggctcataatctcaccagttagttaacacttactgacattttttaaaaaagataatataagttcatagttagaaaattcaaataaaacaggctgggtgtgatggctcatgcctgtaatcccagctctttgggaggctgaggcgggcggatcacttgaggtcaggagttccagaccagcctggccaacatggcgaaaccccgtctctactaaaaatgcaaaaattagccgggcatggtggtgcacacctgtaatcctagctatttgggaggctgaggcatgataattgcttgaacccagggggcggagattgcagtgagcagagattatgccactgcactccagcctgggtgacagagtgagactccttctcaaagaaaaataaaaaaatcaaatgaaaaagaaaagttcgaaaggagaaataaaactcttcttccttatggtgccccaacctcaataccacagataactgatactgtttcttgttacttccttattgacaaaactcttatgcataatactagaattgaagcaatctctctatttttagagttaattcacacaaaatgataaacattgttttgtatctttcttttttcacataatactagaagattatacctgaatcctcttgtgtcaaaagacatttatgtttgggacatctgagcagcaatattcagagtttagtatatggctgttgtatagaattttatctttatgaagctaattagagatttaacttgagatttattagcaccattctagggtcagtcaacccttccctcacccagccctttgaaaacacacatgtacaatgacacgattgaatgcttctaaaaaaaaaaaaaaaggaattggttttaatgaatggaatttgcttttcaggatgagaatgaaacatttattacttcacctatatttagttcacatccattaacaagaaacttagctacttttgcacaagtgacgtaaactaggaaaaaagagctccatatactttccatttcttttctttaggaagctattaattgtgtacacaattctagcattatgagagatagtaggtttcttggaaagactaatctgtcccacataagtcttcattattcaaaccttaggaagtttaagagttcactgggaagatatcaactttaatctttacttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaaggttagttacatgctatttgtgtgtctgccgggccgattagaagaggatcatgggccagaagaaaagagaaaaagtcagttgggaattaatttttaattcatttatatgttcaataaacatttattgaatgtgaactaaatgccaggcactgtatgctagcagtagggaatatagcagtgaataaaaagacctgatccttgaggttataggctagtcatttggggtctggaagaatcatacatttgaaacttctgttaatgctttcagttttctattgcaagatctagttttaaagtgaacccatccagaacctgaaaattgggaattgtggttatattcctaatgttatttcaggcttgtagaatcttgggcaaactacaggagtattgtggcttggcttcttcttttgtttaaaattaaacatgttattttgaaataattgtaaattcatatacagttgtaagaaataaaagagagatatcgtgtaccctttcgccattttccccattttgcaaaactatagtacaataccacaaacaggtaattgacatgattagaattctgcaatcttattccaatttctccagttttacttgtactcgtgtatttttgtgcatgtgtttagttctatgcagttttatcccatgtgtaagttcatgtatctgtctacacagtcaaaatacaaaacagtttcatcacaaggatccctcattttgcttttatataaccatgcccacttcccttccacctcacaccccagtctctgacacttggtaatcactaatctgatctctatctctgtaattttgtcatttcaaaaatttaatattaatggaattatatagtatataacatcagagactagcttattttttcattcagcataattcacttaagatccatataagtttttgtagcatcaatagtttattttttattgctgagtagtattccatggtatgaatgtaccacattacataactgttctccctttgaaggacatctgggttgtttacaggttttgactattataaataaagctgtgaacaggtttttgtgtgaatataagtattcatttctttggaataaatgtccaggagtataattgctgggtcatatggtagtcacatgtttagttttgtaagaaatgacctgttttccagagtgactgtaccattttatattcctgccaataatgtatgaatgatccagtttctccacctcctcaccagcattaggtgttgtcactatttttcattttagccattctgataggtgcatagtgatcccattgtagtattaatttacatttccctgatggttaacggggttgagcatctcatgtgccatctattccacttcagcgaaatgtctgctcatgccttttgcctattttctaaattgattttttattattgaattttgagagttctttttatattttaaatactaccagtgttttatcagatatgtagtttgcaaatatattctcccagtctgtagcttgtctttccatcctcttcgtagggtctttcagagagcaaaagtttttagttttgatgaagtacaatatattgatttttttgaaaacgatcttgctttttatagtaaatctaagaactctttgcctagcccagatcctgaagattttctcctgctttttttttttttttacatctttttaagcctgatgcccattttcgacttaatttttgtaaaagctatgaggtttagttcaaggttttttttttgttgttgttgttgttttgtttttgtttgtttgtttgtttttgcttttcttgccaaaggatgtctaattgctctcgcactatttgttgaaaaggctattcttcctctgttgtattgcttttgcacctttgtgaaatatcagttgggcttggttttatgggtctgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacgatctctgctcactgcagtctctgcctcccgggttcaagcgactctcatgcctcagcctcccaagtagccaggattacaggcatgggccaccatgcccggctaatttttgtatttttagtagagacgggtttcaccatgttggccaggctggtctcgaactcctgacctcacgtgatccgcccgccttggcctcccaaagtgctgagattacaggcatgagccaccacgcctggccaaaagcctgtatcttttaatataaattttagaataagcttgtctatagctatagaaaaccttgctagaattttggcaggaattacattaaacttgtagatcaatttggggagaactgacatttttactatattgagtcttccaatccatgaacacagttgccttggcttttatactctgtaaatcaacatttattgagtgcctactaaatgtaaaactaagttaaggatagttgtagagctctttaagctttactgaaatataggtatcataatataacttgtttattgtgttttatttcataggtccctgatgtcaaagaaatggaaaaaagcagctttactgaggtagagcaatcataatataacttcatttttacccttaatgtgttttatttaatagctcattagtttcaaatgaatcaaataaaccacagaagctacttttgagccttccttctcacctctaaccctcatcctaaacacatacactgggtttgattcactaaaaaatgaattcattgtttgatgtttgataactgctagaggaaaagatacaatttggccagtgaccccgtgtattctaatctgctctttttattctgatatttatttcaaaagccattccttgggagccagagctcacttttaacagcagttgtttgcaattgcttattccccatcaaaatcctaatttctatttgtggcacaacaaattggttgctgtggagataattatgtaaaactggattcaagggagaacatgcagctaagatccagtttttataggaacgtctctaataataaagatgtggggaagtgaaatctgggaatttggatctttaaaccaaattatttctaaataactaataaggaattatagttctttgccaatataaatcaggagaaataatttataactgagacctaagggttgcacctctgagagagggctttaccatagagctgcagattgaaaagattaaatgtctcaagtaatttgtttaattaggaaaaaagtaagtttactgtacaaaattctagaccctggctaaagattcctttataaatagcactacttaaagtagaaatttggttggatcagaatttaaagaggcctaacatttgaattcgttggtacgtaggagggcactcctgcaacacacagggtgttaaatgacagtattggtatccccctctaatccccaactttgcttcagtacattgaatctccagacgtggaaaatgaagtaaagagactgctgcgttcggatgctgaagccgtaagtacccgtatcctttatacaaatattttctgcatagtctgttctgccccatttgtacatgctgacgaagcctcacctctggtgtttgtgtgccagtcttgatgtgtggaacttaagattctttgaaatgttctagctaggaacagtaaattcatgtaatagaaaattatttattgtgtaattcaatatgaggcacttctccaaactaggaattccaatacaaatggcctaaagttggactaaattaaatagcactgttagccaaagagccccttccctttcagctgtgcctttttgtttccttctgtgttttccttgactacccactcctttcaggttgggaagtcattgctgaagatggaaccaaggaaatagaaagtcaaggctccatcccaggatttttgatatcctcgggaatgagcagccacaagcagggtcatacctcgtcaggtactttagtaaaggcaaagcaggagtttcagatagggcaggtattgactgggtatcagatcattttccataaattcataggccaatccaaaaaaaaaaaaacccagaaaaaaaggatggtttcgtccttccctctttttttttttttttttttgagatggagtcttgctctgtcgcccaggctggagtgcagtggcgtgatctcggctcactacaacctctgcctcatgagttcaagtgattctcctgcctcggcctcccaggtagctgggattacaggtgttcaccaccatgcccagctaattttttactagcgtcggggtttcaccatgttggccaggctggtcttgaattccagacctcaagtgatctgcctgcctcggcctcccaaagtgcttgaattacaggcatgagccactgtgcctggcctttttttttttttttttttttttttgagacagagtctcgctctgtcgcccaaactggagtgtagtggtgcgatctcggctcactgcaacctctgcctcccaggttcaagtagttcttgtgcctcagcctcccaagtagctgggattacaggcatgtaccaccacaccaagctaatttttcttttttcttttcttttttttttttttgtaagtagagatggggttttgccatgttggccaggctggtctccaactcctggcttcaagtgttctgcccgcgttggcctcccaaagtgctgggattacaggcatgagccaccacacccagcccttcttccctcttattggtctcttggcagtttaggggttttagattagtgttctaatctcccatccacccctggtattttaacttcctatgacccttagagtctctaaatatcttgatcattcactacatgaatgaatgttacagtgttttgcatttgctgtccttgttttataaagggaataatcttcctgcatgaaaaaatgatttataaaattcactggttgcctggggaatgtgaaaggagtataattatatctggagtatgagtcatttgcagagttttagatagttcaccttcttcttgcttaaaactagtagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaataggtaagtcagaaaaaacaaagggatgggaccagggtgggtggcagtgctaacagttgactctaagcatacattagactcaaagctaagctcaagaagttatcgcttcgatgtgtagtagagttttacttgatttggatcttggtccattcatttaggctatatttaatatataaagttctatgtttctctattagtcatggaaattcagaagcagattgagaaaaaggagaaaaagctccataagattcagaataaagcacaaagacagaaggatctcatcatgaaagtggaaaacctgacactcaaggtaaattcttggctggcataaagaaatcctgatatcttactttcagtatcttgcctttgtgtttccacttatgttatctctgtgcagggttcttgttcattcatgaacctaaacagcctcttagaaactcctaataaaagataaccctgtttccttttacctgagtaattttgatcatctaatataagcattttggggaagggactaggtgatatgagataaaaattgccaatattgagcatttgctatgtaaaaggcacataaagggctaagaattgtgtacacatattatcacattttatcctcacatccttgaaacgtaaatactgtcaccactcccattttatagataaagaatggaaactcaaagaggttaagtaacttgccagggatcacagtaaatgatccctgagtaagggatcttttagtagagatgaaacctcatctctactaaaaatacaaaaattagccaggcctggtggcatgctcctgtaatcccagctacccaggaggctgagacatgagaatcacttgagcctgggaggcggaggttgcatgagccaagattgcgccactgcactccagcctgggtgacagaggaagattccgcctcaaaaacaaaaacaaaaacaattatttgccaaactccttgcctcccttggtttttttttttttctttgagactcagtgttcatcatttatacaatttatttttcagaatcattttcagtctgtgctggagcagcttgagttacaggaaaaacaaaaaaatgagaaggtaagaagtatgttttcaaattaaccagaaaacatttgatacagagaatcccccacttcaattccaatatcattgctggctgttcctctcataggaatagtggtagccaaatcttctaaatgaaggtagcagggtggaacaaggtctttgtgaaaattcactcattcaacagatattgaatgcctatgaagtgaaaagcactggatgtacggtgttgaataagacaaatgcaatacagtaaatcctcagtgtcattgataggttcttggaaactgtaactttaagcaaaataatgtatatataatgaaaccaattttactataggctaattgatataaagaagaattaagttcctatagcatatttctggtcacaaaaacatcaccaaacttctaaataaaaaccaaaacgcttctaataattaaacgttgaaataaatgtgagctatacatacatttgagaaagactgataaaaacaagtaagacaattatgtacccagtgattccagttcagggtctcagatggccagagcctatcccagcagctcagggcacaaggtaggaaccagccttggataggatggcatcccattgcagggcacactcacacccacactcacacccacactcactcagactgggacaattcagacaaaccaattcacctaatgtgtacagggaagtgattttatttttctcatcaacattataatgaggccaggagtggtggctcatgcatgtaaccccagtattttgggaggccgacgcgagaggattgctttagctcaggagtttgagaccaatctgagcaacatggtgaaacgctgactgtacaaaaaattagccggttgtggtggcataagcctgtagtctcagctactcaggacgctaaggtgggaggattgcttgagcccaggaggttgaggctgcagtgagccatgatcacaccactgcactccagcttgggcaacaaagtgagcccctgtctcaaaaaaaaaaaaaattataatgaaatgacattgaactaacaatgttatttggagaccttttgcatgtcattttgcttaaagttgcagtttctaagaacctattgatgacattaagtgaggacttactgtaacaaaacgacattggacaaaacgatgttattcaaggacctgctgtacttatcctcgtggagctgtctagcaggggagattgacaataaacaaattatacaaatataaagttacaaattgtgaagaagtgctatgaaggaaaaaagtcagtggtgctattagaataaagggtcttgaattaattgggggatcatgatagacctctcctaggaggtgctattgaagctgagaccggaaggattaagtccaggcaaagagtgggatgaggagcctcttaggtggagcgtatgcaaggtctcatgctcagaaagaacttggcttctttgaggacctttggagtatttaaagccaggaagagaatggcttaagataaggttggagaagtaggcagagaccatagtgtatggttccttgaaggccatgataaggaggatgggtttggccttaagtgtaatgtgaagtccttgaagaattgtagataggaaaatcacatctaatttaaacttttttttttttaaatggagtcttgctctgtcgcccaggctggagtgcagtggcacaatctaggctcactgcaacatccgcctctcgggttcaagagattgtcctccctcagcctcccaagtaactgggactacaggcacgtgccaccatgcccggctaattttttgtatttttagtagagacagggtttcaccgtgttagcgaggatggtcttgatctcctgacctcgtgatccacctgccttggcctcccaaagtgctgggattacaggcgtgagccaccacgtctggcctaatttaaacttttaaaaggttactctgattattatctggagaatgggttggaagaaggtgagagtagaagcaaagaggctggttggggggctttgtggtactctaataacagaggatggtaacttggactaagttagtagcaatggagattgaaagaatatagatttttaaactgcaataaaaatgtttttataacagatgtaattcataaaccatacaatatcacccatttaggctgggtgcggtggtgcgtgcctgtaatcctagcgctttgggaggccaaagtgggcagatggcttcagcccaggagttcgagaccagcctgggcaacatggtgaaaccccgtctctccaaaaattagccaggcatggtggtgtatgcctgtagtcccagctgctcgggaggctgaggtgggaggattgcttgagcctgggaggcagaggttgcagtgagcagagatcccaccactgcactccagcctgggtgacagagtgagactgcctcaaaccccgtcctccccacccccgacaagtcacccatttaaactatacaattcagtggcttttagcatattcagagttgtacaaccaccactgcagtcaattttagaatagtttcatcactccaaaaagaaaccctgtatccattagtagtcactccccacttctccagaacctctcccctgcccagcactaggcaaccactcatctagtttctactaatctactgcctattctagttatttcatacaagtgaaatcatataatacatggtgttttgagtcgggctcctctcatttagcatattttcagggttcatccatgttatggcatgtatcagtacttttttccatttaaaactgactaatactccattggatcaatataccacattttgtttattcattcatctgctgatggacatttgggttgctttcacttttggctattatgaataatgctgcaatgaatattgatatattagagaatatactttaaaggtagaattgacaggagttgggtcaattactgggtgttgaaggagaaggaatcattaaggatgtatgtatttctaacttgaacgacaactgtatttttcaaagccacaagagagtgtacagggcgaagagagaagaaggcaatataggctaaatgagggtcaagcagctgtatagaaaatgtgtgctgactctaaccttatactgttgagggttacaattttaaagagactggagttggtattatgaggatgggcttagcatggtgctcttgaagtacaggcactactccccacccccatccccacaaggctagcggaatttttatgttctatatattcccttcctctcagcaaatcacttatccaagtactgcttaatactgctttaaaacaatcagatgaacagttaatgccaggattgttttagtacccaccaaacatctttgttttcatcaatgtaagtacagttgtatgctgcataacaacattttggccaatgacagactgcatatatgatggtagtcccataagattataatggagctaagaaattcctgtcacctggtgacactgtggccatcataacatagcagcagaattacttaatttttaaattattttactatagcctaagtatatagtgtttatatagtcttcagtagtgcatagtaatgtcctaggccttcacattcactcaccactcactcactgactcacccacagcaacttctagtcctgcaagctctattcatagtaagtgccctatataagtgtaccatttttaattttttatattgtatttttagtttaccttttctatgtttagatacacaaatacttaacattgtgctacaattgcctacagtattcagtacagtaatatgctgtacaggtttgtaacctaggaacgatagactatactatgtagcctaggtgtgtagtaagctatactatctaggttggtgtaagtatgttctatcatgttcgcgtcatgacaaaattgcctaaggatgcatttcttagaacatatccccattgttaagtaacacatgactatatttagtattgaggagcagcatagaaatgtagctgtaaactttatttactcagagtcccttatgttagttcatttatccaaattagatttagtaggtgtctactttaagctaggctctacagggagctatgatatgcttatgatgtagtctctgtcttcatttggggagaaattggcaagaggggtagggacttaaaggaatgacagattgtccatggatattaaagaagacttcatggagaagatggtgtttgactggggccttaaaatataggtagggttttaataaggagatagggaaaggagtgcattccatgagaaagcagcatgcacactggctcagaggtggtgatgccagggtgaacagtttagatttttggtgtaggtcataatgaaccttcaaagcctttttacctggggaataactcaggaagatttttctgccagaagtatataggagaaattggagtggggacagcctggagcttcaaaggtgcaagtggtagaagcaaacagagcttaacaattgattggatttacagggcaaaaaggggaacaaagatgagtccaaagcctgggaaactgggaaatgatgtgccattaactgaaaataggataacaaaaagtggatttggaggggtatgtggagaagtgcttttgaaaatgggaaattggagagaggcccatacacagaaatgatcattgaagctgtggggctagttgagttagcctggttgattgttcagcaagaagtctgaacctaaggaaaaacctatctatagggggtggtgggaagagaaagagcctgcaaaggagaaagaactggatcagtcagtggttgtaatcatggtcaatcaggggtcactcagcaactgagtgagaagagcctctaagttactgcggacagcaattattgtggcttggtaggtgatgtgcagcataggattgttttataatgttcctttcatttcacagactaaaaattcattctggtatggagtgtcctgaaatgaataatattcaaaaacaacctttgttgtaaagatggcatacatctctgaatgttattggtcactttaccatttcaagttaaaaaaaagtaaatcctataccacaaaatgttcagggcttctaacttagaaagcattaagtagaacatcatcaggctcctgattggtcagggctctggctcagtttctaagtatctcctaatgtggtaagaagcagctggtaagactcagtctaagacccattgtgttcattgggacaagagagtgtcccaactgttttatcatctgactcttagaatatggctacagagatcccatctcctttgcccctacagtgagctgtgacctctgtatattcttcacagaagcacaaattcttaacagcaaaaatattgtttttttttaaagcctattcaattttaaagcttgatatggtttgtctgtgtccccacccaaatctcatctttaattcccacgtgttgtgggaggcacctggtgggaggtaattgaatcatgggggcaggtctttcccatgctgttctcgtgatagtgaataagtctcacgagatctgatggttttaaaaaggggagtttccctgcataagttctcctctctttgcctgctgccatccatgtaagatatgacttgctcctccttgccttccaccatgattgtgaggcctccagctatgtggaactgtaagtccattaaacctctttttcttcccaaactcaggtatatctttatcagcagtgtgaaaactgactaatacaaagcttctcttcataaattgggcataataaaggacatcatcatggccacagcagtatgcatgcattcttgactgtggccagtattctctggaacattgcaagactaagataaccttataaatgccaaataacagtagttctttttggttcatttaagtaaattctagatcaagtaatgggacctcaaatttcaaatgaatttttcatgtctttctacctctccctacagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatgg

SEQ ID NO: 3521 - DNA, 22476 bp, human
gcgttcgcctctacgttccgcgcgggagcccacgcgcggttcgtccggaacccacagaccagagacgcaggtcccagccttttcggtgtcggcgccagttcccggaggagcgggtgagtcgggcggccgaccgggcggccgggaccgggtcagcgccccgccagtgtgcaccccgccgcggtgcaccccgcagccctccccagccagcctgcacagcgaggcgcgaaggctgggacccgttgcgacctgttgggcctcgcgagaagttttcaagggaaagtggatcaaagcctaggggtcaaactttctctttgaaagcttagtgccccggggataaggatggaggtcagtctcttaaactgcagccggagactgcgaacttgaaaaaacacccatttaggcgtgtactgacttgcatggcctggagcatgctgccaggcgccctccagccaattataattccaattgtaattctgctaaagcgagatggaactagaggtgaatggtagtaaggggtcctgttaatttaatcaggcatcaaagagtgcttgctggaaaaaagtggatgctttttcttaaagtgaataccgtacaactagtcttttaggtaaatgcaagtaaatttaaaaaataattaaaacccagttcaaccaggattgtctaacttttctcccaccagactttttattaggtctgtttatcaaacaaatacattgaaatagtttcagttcttacattctttcttccataaaagaggaattaccaaaaaggcttggaaatgaacaaaatgccccagttttagttctgctgagaaatctaaaagttactactgatctgataaaatcttgcttagcagctagttcttcaaataatctgttcctgctcccagccttaattgttactatgttctgttagggaatgtgctcagcccccagattttttatttatttcgatcaactctcttcttgcatttacatttctcttttgtatttatatatgcatatatatacatatatatctgtatgaaacaagaagagaagaaattacaatcacaaataatgcatctttccctctcccatcctgggtgtctgcttttctactgctgactttttttgttttgttttgttttgttttgtttttgagaaggagtctcactctgtcacccaagctggagtgcagtggcgccatctcggctcattgcagcctccatctcctgggttcaagcaattctcctgcctcagcctcccaactagctgtaaagatacagctaatttttgtatctttagtagagatggggtttcactatgttggccaggctggtctggaactcctgacctcaggtgatccacctgcctcagcctcccaaagtgctgagattacaggtgtgagccacagcgcccagctgtctttccacctttgagaaaaatcttcctcagaagtgtgggcctggctgggcacagtggctcatgcccacaatcccaacactttgggaggccaaggcgggtggatcacctgaggtcaggagctcgagaccagcctggccaacatggtgaaaccctgtctctactaaatatacaaaaaaaaaatttagccgggtgtggtggcaggtacctgtaatgccagctactcaggaggctgagatgggagaatcacttgaacccgggcagcagaggttgcagtgagctgagatgcgtgccattgcactccagcctggggtcaacaagagcaaaactctgtctcaaaacaaaacaaaacaaaagtgtgggccctaatacccaaaatgcagggctctacaaatacatcccaaatacatggaaaataagattagaaataaagtcttggttcattgtaagaacataaaattgaaaaacaaataatgaaaacaataaaaaataataaaataaaaacttgggatccagcaatcccacgtctagatgtatatcctaaaaacttgagatcagtgtgtcaaagaaatatccgcacacacatgttcactgcagcattacaatagctaagttatgaaatcaatctaggtatccaacaagtgaatggataaatatgtggtatgtgtacccagctgaatactattcagcctttaaaaagaaggaaattctgtcatttgcaacaacgtggatgaatctggaggatattatattaagtgaaataagccaggcagaaaaagacaaaaatcacatattctcacttatatgtggaatctaaaataattgaactcatagaagcagagagtagtgttggttattacaggctggagtagcgggaggggcattgaggagatgttgatcaaagaacagaaaatttcagttaggctggtccaatagtagtgggatattatcacaacttattaacattaatgccactaaagttggtatacaatctcccacttccaaatttggcttttaaaattaaaaaaaatgaaagttgcagttagggggaataactgataagtatttaaggtgatggatgtgctcattagattgattcagtcatttcacactatatcataacatcattgtgtaccccataattatatatgattataatttgtcaaaaaaagattaacttggaagaaagtattcacttcaccaaaggtatatatatatattttaaataaaaagatccatcttaggagttcttttaaatagcttttgggggcattcgaagtaagtggtgattgtgaggattatatgaaatgatagacctaatgcactcaatgtagtactgggcatacagaatgcacacaataaagggtagtaatgaatgaaagggtagtaacgaataaatcaaatcagattttatgttctccataaaactccatctcaaaaagaaaaaaaaaagagactccgtctcaaaaaaaaaaaaagaactggattccatgctgggcgcggtggctcaggcctgtaatcccagcactttgggaggctgaggtgggcggatcacttggggtcaggagcttaagaccagcctagccgacatggtgaaatcctgtctctactaaaaaatacaaaaattagccaggtgtggtggtgcatgcctgtagtcccaactacttgggagactgaggcaggagaatggcttgaacctgggaggcggaggttgcagtgagccgagatcgcaccactgcactccagcctgggcgacagagcgagactctgtcttgaaaaaaaaaaaaaagaactggactcctaacttttccccagggtagctcaaagctgttgttgctggctctagagtcataaaaaactgcctggtctcccatggactgcttaatttctactaatccattaatgtaggtgaaatattgaaaatcaagcccttgtttacttcaaatcatcacagaacatttatgcaagtggtttctaggcgaatttcagcttttggtttgcattcttccctacagaggttagtttgcttaggtagccaccaacgtgttgttgaattgtagtcttttacctgagagtctaagaatatgattaagaagacgaaatcatgtttcataacagctcttatttcatttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggtaagaacttgtatctcagaacaaatatcttcataattatagtttaattataattatagttctacttggattctgacatttctatttcaggtaggctataaaaactcagaacatttgtttcccaggaatcatgttctgttaagcagtcctatcatagcgtgtacttttttggcagcattttttcctcctgtacaataccacctatcatgcaggttgatttcctggcaaaacagctgtgacaatgatggacccattcacttaccaccaatactaacagcctgttccctggacagccaagatacggctcctctgaaatcctttctgtcacctcaaaaggggcagtgagaagggccagcattattcaccaccatgcaagacttttaaagctcatctcaacaagtatttggctctcttcccccacactgatacctgtattcaagcaattacttagtctaggcagctatattaaggatggggttcagaaacctatttccctaattagggttacttaatataccaagcaaactgcaactaggtaagcctttctttagcaactacaacagaagggtagcagtgagaggcaggattgtagagctaggagaaagcattaactgtagctactaagagacaattatgagtttagagtcagcttcatcctaacttgacttatacagtgcacagtatctcatggtacatggtcttgttagtaacatttgggaggtgtaaagttttatttaagggagggctttctttgatatatctattctgttagctgccaagtagatgtttagttcttctgatttttcaatttacctcctttttaggaacatgcttgtactgtcaggaacctagcacgttctcaaagtgtcaagatgaaggataaactaaaaattgacttattgcgtaagtagttaatatccattcactatacattgaacaataatttattaagggattgctatgtgccatacactgtacttggtactaaggatgtgaaaaatgatagaatatggtctctgacttgatggactcatgctttagagaggcttaagtcctcttcttttaagaggaaaggaagtaggaatattgcaccttgagttgagtgattatcatagtgtgtttaaggaaacttgggggtcaactgtggggtttttatactgctggtagcctcccatatataaactttatgatttctgaacatccaagggaatgacaaatggatatgccattctttgtttataaaggtgacatgtatttctttctttctttctttctttctttctttttttttttttttgagatggagtctcgctctgtcgcccaggctggagtgcagtggcgcaatcttggttcactgcaacctctacctcctgggttcaagtgattcttctgcctcagcctcccaagtagctgggattacaggcacatgccaccatgcccggctaagttttgtatttttagtagagacgtggtttcaccatgttggtcaggctagtctcaaactcctgaccttgtgatccgcctgccttggcctcccaaagtgctgggattacaggcgtgagccaccgtgcctggccagtgacatatatttttcttttaaataatatttgttatattggcaaattgtacatccaataaagtggttaatatccaaatatataaggaactcaaacaactcaatagcaagaaaacaaataacctgattttaaaatgggcaaaggatctgaacagatatttctcaaaagaagacatacaagtagccaaaaggttcatgaaaaaatgctcagcatcactaatcattaggggaatgcaaattaaaacaacagcgagatatcacctcatacctgttagaatggcttttattaaaaaaaaaaaaagaacaataacaactgttaatgaggatgaggagaaaagggaaactttgtaccctattggtggtaatgtaaattaatacagccttttttttttttttttttttttgagatggagtcttgctgtgtcacccaggctggagtgcagtggcgcgatcttggctcactggaacctccacctcctgggttcaagcaattctcctgcctcagccttccgagtagctgggactacaggcatgcgccaccacacctggctaatttttttgtatttttggtagagatggggtttcaccatgttgaccaggctggtcttgaactcctgacctcgagtgatccacccacctcagcctcccaaagtgctgggattacaggcgtgagctactgtgcctggcctacagccattattttttttaaatggtatggaggttcctcagaaaactaaaaatagaacaaccatgtgatccagcaaccccacttctgtgaatatattcacagaaggaattgatatcaacatgttgaaggcatatctctctgcactcccatattcattgtagcattattcacaatagccaagatatggaatcaacctaagtgtaaatgtgatacgtatacacaatgctatactactcagccttttaaaaagaacaaaattctgtcatttgggacaccatggatgaatctagaggccatttgcaccaagagcatgtgtaaataaataagtaaataagtaaataaataaataaatgtttccacacaagtttatctgcctaaaaaacacacaaccaaaaataaataaattttgctagtttttttttttaatacagagaagcatataaaggagaaaacaaaaagtggctcataatctcaccagttagttaacacttactgacattttttaaaaaagataatataagttcatagttagaaaattcaaataaaacaggctgggtgtgatggctcatgcctgtaatcccagctctttgggaggctgaggcgggcggatcacttgaggtcaggagttccagaccagcctggccaacatggcgaaaccccgtctctactaaaaatgcaaaaattagccgggcatggtggtgcacacctgtaatcctagctatttgggaggctgaggcatgataattgcttgaacccagggggcggagattgcagtgagcagagattatgccactgcactccagcctgggtgacagagtgagactccttctcaaagaaaaataaaaaaatcaaatgaaaaagaaaagttcgaaaggagaaataaaactcttcttccttatggtgccccaacctcaataccacagataactgatactgtttcttgttacttccttattgacaaaactcttatgcataatactagaattgaagcaatctctctatttttagagttaattcacacaaaatgataaacattgttttgtatctttcttttttcacataatactagaagattatacctgaatcctcttgtgtcaaaagacatttatgtttgggacatctgagcagcaatattcagagtttagtatatggctgttgtatagaattttatctttatgaagctaattagagatttaacttgagatttattagcaccattctagggtcagtcaacccttccctcacccagccctttgaaaacacacatgtacaatgacacgattgaatgcttctaaaaaaaaaaaaaaaggaattggttttaatgaatggaatttgcttttcaggatgagaatgaaacatttattacttcacctatatttagttcacatccattaacaagaaacttagctacttttgcacaagtgacgtaaactaggaaaaaagagctccatatactttccatttcttttctttaggaagctattaattgtgtacacaattctagcattatgagagatagtaggtttcttggaaagactaatctgtcccacataagtcttcattattcaaaccttaggaagtttaagagttcactgggaagatatcaactttaatctttacttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaaggttagttacatgctatttgtgtgtctgccgggccgattagaagaggatcatgggccagaagaaaagagaaaaagtcagttgggaattaatttttaattcatttatatgttcaataaacatttattgaatgtgaactaaatgccaggcactgtatgctagcagtagggaatatagcagtgaataaaaagacctgatccttgaggttataggctagtcatttggggtctggaagaatcatacatttgaaacttctgttaatgctttcagttttctattgcaagatctagttttaaagtgaacccatccagaacctgaaaattgggaattgtggttatattcctaatgttatttcaggcttgtagaatcttgggcaaactacaggagtattgtggcttggcttcttcttttgtttaaaattaaacatgttattttgaaataattgtaaattcatatacagttgtaagaaataaaagagagatatcgtgtaccctttcgccattttccccattttgcaaaactatagtacaataccacaaacaggtaattgacatgattagaattctgcaatcttattccaatttctccagttttacttgtactcgtgtatttttgtgcatgtgtttagttctatgcagttttatcccatgtgtaagttcatgtatctgtctacacagtcaaaatacaaaacagtttcatcacaaggatccctcattttgcttttatataaccatgcccacttcccttccacctcacaccccagtctctgacacttggtaatcactaatctgatctctatctctgtaattttgtcatttcaaaaatttaatattaatggaattatatagtatataacatcagagactagcttattttttcattcagcataattcacttaagatccatataagtttttgtagcatcaatagtttattttttattgctgagtagtattccatggtatgaatgtaccacattacataactgttctccctttgaaggacatctgggttgtttacaggttttgactattataaataaagctgtgaacaggtttttgtgtgaatataagtattcatttctttggaataaatgtccaggagtataattgctgggtcatatggtagtcacatgtttagttttgtaagaaatgacctgttttccagagtgactgtaccattttatattcctgccaataatgtatgaatgatccagtttctccacctcctcaccagcattaggtgttgtcactatttttcattttagccattctgataggtgcatagtgatcccattgtagtattaatttacatttccctgatggttaacggggttgagcatctcatgtgccatctattccacttcagcgaaatgtctgctcatgccttttgcctattttctaaattgattttttattattgaattttgagagttctttttatattttaaatactaccagtgttttatcagatatgtagtttgcaaatatattctcccagtctgtagcttgtctttccatcctcttcgtagggtctttcagagagcaaaagtttttagttttgatgaagtacaatatattgatttttttgaaaacgatcttgctttttatagtaaatctaagaactctttgcctagcccagatcctgaagattttctcctgctttttttttttttttacatctttttaagcctgatgcccattttcgacttaatttttgtaaaagctatgaggtttagttcaaggttttttttttgttgttgttgttgttttgtttttgtttgtttgtttgtttttgcttttcttgccaaaggatgtctaattgctctcgcactatttgttgaaaaggctattcttcctctgttgtattgcttttgcacctttgtgaaatatcagttgggcttggttttatgggtctgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacgatctctgctcactgcagtctctgcctcccgggttcaagcgactctcatgcctcagcctcccaagtagccaggattacaggcatgggccaccatgcccggctaatttttgtatttttagtagagacgggtttcaccatgttggccaggctggtctcgaactcctgacctcacgtgatccgcccgccttggcctcccaaagtgctgagattacaggcatgagccaccacgcctggccaaaagcctgtatcttttaatataaattttagaataagcttgtctatagctatagaaaaccttgctagaattttggcaggaattacattaaacttgtagatcaatttggggagaactgacatttttactatattgagtcttccaatccatgaacacagttgccttggcttttatactctgtaaatcaacatttattgagtgcctactaaatgtaaaactaagttaaggatagttgtagagctctttaagctttactgaaatataggtatcataatataacttgtttattgtgttttatttcataggtccctgatgtcaaagaaatggaaaaaagcagctttactgaggtagagcaatcataatataacttcatttttacccttaatgtgttttatttaatagctcattagtttcaaatgaatcaaataaaccacagaagctacttttgagccttccttctcacctctaaccctcatcctaaacacatacactgggtttgattcactaaaaaatgaattcattgtttgatgtttgataactgctagaggaaaagatacaatttggccagtgaccccgtgtattctaatctgctctttttattctgatatttatttcaaaagccattccttgggagccagagctcacttttaacagcagttgtttgcaattgcttattccccatcaaaatcctaatttctatttgtggcacaacaaattggttgctgtggagataattatgtaaaactggattcaagggagaacatgcagctaagatccagtttttataggaacgtctctaataataaagatgtggggaagtgaaatctgggaatttggatctttaaaccaaattatttctaaataactaataaggaattatagttctttgccaatataaatcaggagaaataatttataactgagacctaagggttgcacctctgagagagggctttaccatagagctgcagattgaaaagattaaatgtctcaagtaatttgtttaattaggaaaaaagtaagtttactgtacaaaattctagaccctggctaaagattcctttataaatagcactacttaaagtagaaatttggttggatcagaatttaaagaggcctaacatttgaattcgttggtacgtaggagggcactcctgcaacacacagggtgttaaatgacagtattggtatccccctctaatccccaactttgcttcagtacattgaatctccagacgtggaaaatgaagtaaagagactgctgcgttcggatgctgaagccgtaagtacccgtatcctttatacaaatattttctgcatagtctgttctgccccatttgtacatgctgacgaagcctcacctctggtgtttgtgtgccagtcttgatgtgtggaacttaagattctttgaaatgttctagctaggaacagtaaattcatgtaatagaaaattatttattgtgtaattcaatatgaggcacttctccaaactaggaattccaatacaaatggcctaaagttggactaaattaaatagcactgttagccaaagagccccttccctttcagctgtgcctttttgtttccttctgtgttttccttgactacccactcctttcaggttgggaagtcattgctgaagatggaaccaaggaaatagaaagtcaaggctccatcccaggatttttgatatcctcgggaatgagcagccacaagcagggtcatacctcgtcaggtactttagtaaaggcaaagcaggagtttcagatagggcaggtattgactgggtatcagatcattttccataaattcataggccaatccaaaaaaaaaaaaacccagaaaaaaaggatggtttcgtccttccctctttttttttttttttttttgagatggagtcttgctctgtcgcccaggctggagtgcagtggcgtgatctcggctcactacaacctctgcctcatgagttcaagtgattctcctgcctcggcctcccaggtagctgggattacaggtgttcaccaccatgcccagctaattttttactagcgtcggggtttcaccatgttggccaggctggtcttgaattccagacctcaagtgatctgcctgcctcggcctcccaaagtgcttgaattacaggcatgagccactgtgcctggcctttttttttttttttttttttttttgagacagagtctcgctctgtcgcccaaactggagtgtagtggtgcgatctcggctcactgcaacctctgcctcccaggttcaagtagttcttgtgcctcagcctcccaagtagctgggattacaggcatgtaccaccacaccaagctaatttttcttttttcttttcttttttttttttttgtaagtagagatggggttttgccatgttggccaggctggtctccaactcctggcttcaagtgttctgcccgcgttggcctcccaaagtgctgggattacaggcatgagccaccacacccagcccttcttccctcttattggtctcttggcagtttaggggttttagattagtgttctaatctcccatccacccctggtattttaacttcctatgacccttagagtctctaaatatcttgatcattcactacatgaatgaatgttacagtgttttgcatttgctgtccttgttttataaagggaataatcttcctgcatgaaaaaatgatttataaaattcactggttgcctggggaatgtgaaaggagtataattatatctggagtatgagtcatttgcagagttttagatagttcaccttcttcttgcttaaaactagtagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaataggtaagtcagaaaaaacaaagggatgggaccagggtgggtggcagtgctaacagttgactctaagcatacattagactcaaagctaagctcaagaagttatcgcttcgatgtgtagtagagttttacttgatttggatcttggtccattcatttaggctatatttaatatataaagttctatgtttctctattagtcatggaaattcagaagcagattgagaaaaaggagaaaaagctccataagattcagaataaagcacaaagacagaaggatctcatcatgaaagtggaaaacctgacactcaaggtaaattcttggctggcataaagaaatcctgatatcttactttcagtatcttgcctttgtgtttccacttatgttatctctgtgcagggttcttgttcattcatgaacctaaacagcctcttagaaactcctaataaaagataaccctgtttccttttacctgagtaattttgatcatctaatataagcattttggggaagggactaggtgatatgagataaaaattgccaatattgagcatttgctatgtaaaaggcacataaagggctaagaattgtgtacacatattatcacattttatcctcacatccttgaaacgtaaatactgtcaccactcccattttatagataaagaatggaaactcaaagaggttaagtaacttgccagggatcacagtaaatgatccctgagtaagggatcttttagtagagatgaaacctcatctctactaaaaatacaaaaattagccaggcctggtggcatgctcctgtaatcccagctacccaggaggctgagacatgagaatcacttgagcctgggaggcggaggttgcatgagccaagattgcgccactgcactccagcctgggtgacagaggaagattccgcctcaaaaacaaaaacaaaaacaattatttgccaaactccttgcctcccttggtttttttttttttctttgagactcagtgttcatcatttatacaatttatttttcagaatcattttcagtctgtgctggagcagcttgagttacaggaaaaacaaaaaaatgagaaggtaagaagtatgttttcaaattaaccagaaaacatttgatacagagaatcccccacttcaattccaatatcattgctggctgttcctctcataggaatagtggtagccaaatcttctaaatgaaggtagcagggtggaacaaggtctttgtgaaaattcactcattcaacagatattgaatgcctatgaagtgaaaagcactggatgtacggtgttgaataagacaaatgcaatacagtaaatcctcagtgtcattgataggttcttggaaactgtaactttaagcaaaataatgtatatataatgaaaccaattttactataggctaattgatataaagaagaattaagttcctatagcatatttctggtcacaaaaacatcaccaaacttctaaataaaaaccaaaacgcttctaataattaaacgttgaaataaatgtgagctatacatacatttgagaaagactgataaaaacaagtaagacaattatgtacccagtgattccagttcagggtctcagatggccagagcctatcccagcagctcagggcacaaggtaggaaccagccttggataggatggcatcccattgcagggcacactcacacccacactcacacccacactcactcagactgggacaattcagacaaaccaattcacctaatgtgtacagggaagtgattttatttttctcatcaacattataatgaggccaggagtggtggctcatgcatgtaaccccagtattttgggaggccgacgcgagaggattgctttagctcaggagtttgagaccaatctgagcaacatggtgaaacgctgactgtacaaaaaattagccggttgtggtggcataagcctgtagtctcagctactcaggacgctaaggtgggaggattgcttgagcccaggaggttgaggctgcagtgagccatgatcacaccactgcactccagcttgggcaacaaagtgagcccctgtctcaaaaaaaaaaaaaattataatgaaatgacattgaactaacaatgttatttggagaccttttgcatgtcattttgcttaaagttgcagtttctaagaacctattgatgacattaagtgaggacttactgtaacaaaacgacattggacaaaacgatgttattcaaggacctgctgtacttatcctcgtggagctgtctagcaggggagattgacaataaacaaattatacaaatataaagttacaaattgtgaagaagtgctatgaaggaaaaaagtcagtggtgctattagaataaagggtcttgaattaattgggggatcatgatagacctctcctaggaggtgctattgaagctgagaccggaaggattaagtccaggcaaagagtgggatgaggagcctcttaggtggagcgtatgcaaggtctcatgctcagaaagaacttggcttctttgaggacctttggagtatttaaagccaggaagagaatggcttaagataaggttggagaagtaggcagagaccatagtgtatggttccttgaaggccatgataaggaggatgggtttggccttaagtgtaatgtgaagtccttgaagaattgtagataggaaaatcacatctaatttaaacttttttttttttaaatggagtcttgctctgtcgcccaggctggagtgcagtggcacaatctaggctcactgcaacatccgcctctcgggttcaagagattgtcctccctcagcctcccaagtaactgggactacaggcacgtgccaccatgcccggctaattttttgtatttttagtagagacagggtttcaccgtgttagcgaggatggtcttgatctcctgacctcgtgatccacctgccttggcctcccaaagtgctgggattacaggcgtgagccaccacgtctggcctaatttaaacttttaaaaggttactctgattattatctggagaatgggttggaagaaggtgagagtagaagcaaagaggctggttggggggctttgtggtactctaataacagaggatggtaacttggactaagttagtagcaatggagattgaaagaatatagatttttaaactgcaataaaaatgtttttataacagatgtaattcataaaccatacaatatcacccatttaggctgggtgcggtggtgcgtgcctgtaatcctagcgctttgggaggccaaagtgggcagatggcttcagcccaggagttcgagaccagcctgggcaacatggtgaaaccccgtctctccaaaaattagccaggcatggtggtgtatgcctgtagtcccagctgctcgggaggctgaggtgggaggattgcttgagcctgggaggcagaggttgcagtgagcagagatcccaccactgcactccagcctgggtgacagagtgagactgcctcaaaccccgtcctccccacccccgacaagtcacccatttaaactatacaattcagtggcttttagcatattcagagttgtacaaccaccactgcagtcaattttagaatagtttcatcactccaaaaagaaaccctgtatccattagtagtcactccccacttctccagaacctctcccctgcccagcactaggcaaccactcatctagtttctactaatctactgcctattctagttatttcatacaagtgaaatcatataatacatggtgttttgagtcgggctcctctcatttagcatattttcagggttcatccatgttatggcatgtatcagtacttttttccatttaaaactgactaatactccattggatcaatataccacattttgtttattcattcatctgctgatggacatttgggttgctttcacttttggctattatgaataatgctgcaatgaatattgatatattagagaatatactttaaaggtagaattgacaggagttgggtcaattactgggtgttgaaggagaaggaatcattaaggatgtatgtatttctaacttgaacgacaactgtatttttcaaagccacaagagagtgtacagggcgaagagagaagaaggcaatataggctaaatgagggtcaagcagctgtatagaaaatgtgtgctgactctaaccttatactgttgagggttacaattttaaagagactggagttggtattatgaggatgggcttagcatggtgctcttgaagtacaggcactactccccacccccatccccacaaggctagcggaatttttatgttctatatattcccttcctctcagcaaatcacttatccaagtactgcttaatactgctttaaaacaatcagatgaacagttaatgccaggattgttttagtacccaccaaacatctttgttttcatcaatgtaagtacagttgtatgctgcataacaacattttggccaatgacagactgcatatatgatggtagtcccataagattataatggagctaagaaattcctgtcacctggtgacactgtggccatcataacatagcagcagaattacttaatttttaaattattttactatagcctaagtatatagtgtttatatagtcttcagtagtgcatagtaatgtcctaggccttcacattcactcaccactcactcactgactcacccacagcaacttctagtcctgcaagctctattcatagtaagtgccctatataagtgtaccatttttaattttttatattgtatttttagtttaccttttctatgtttagatacacaaatacttaacattgtgctacaattgcctacagtattcagtacagtaatatgctgtacaggtttgtaacctaggaacgatagactatactatgtagcctaggtgtgtagtaagctatactatctaggttggtgtaagtatgttctatcatgttcgcgtcatgacaaaattgcctaaggatgcatttcttagaacatatccccattgttaagtaacacatgactatatttagtattgaggagcagcatagaaatgtagctgtaaactttatttactcagagtcccttatgttagttcatttatccaaattagatttagtaggtgtctactttaagctaggctctacagggagctatgatatgcttatgatgtagtctctgtcttcatttggggagaaattggcaagaggggtagggacttaaaggaatgacagattgtccatggatattaaagaagacttcatggagaagatggtgtttgactggggccttaaaatataggtagggttttaataaggagatagggaaaggagtgcattccatgagaaagcagcatgcacactggctcagaggtggtgatgccagggtgaacagtttagatttttggtgtaggtcataatgaaccttcaaagcctttttacctggggaataactcaggaagatttttctgccagaagtatataggagaaattggagtggggacagcctggagcttcaaaggtgcaagtggtagaagcaaacagagcttaacaattgattggatttacagggcaaaaaggggaacaaagatgagtccaaagcctgggaaactgggaaatgatgtgccattaactgaaaataggataacaaaaagtggatttggaggggtatgtggagaagtgcttttgaaaatgggaaattggagagaggcccatacacagaaatgatcattgaagctgtggggctagttgagttagcctggttgattgttcagcaagaagtctgaacctaaggaaaaacctatctatagggggtggtgggaagagaaagagcctgcaaaggagaaagaactggatcagtcagtggttgtaatcatggtcaatcaggggtcactcagcaactgagtgagaagagcctctaagttactgcggacagcaattattgtggcttggtaggtgatgtgcagcataggattgttttataatgttcctttcatttcacagactaaaaattcattctggtatggagtgtcctgaaatgaataatattcaaaaacaacctttgttgtaaagatggcatacatctctgaatgttattggtcactttaccatttcaagttaaaaaaaagtaaatcctataccacaaaatgttcagggcttctaacttagaaagcattaagtagaacatcatcaggctcctgattggtcagggctctggctcagtttctaagtatctcctaatgtggtaagaagcagctggtaagactcagtctaagacccattgtgttcattgggacaagagagtgtcccaactgttttatcatctgactcttagaatatggctacagagatcccatctcctttgcccctacagtgagctgtgacctctgtatattcttcacagaagcacaaattcttaacagcaaaaatattgtttttttttaaagcctattcaattttaaagcttgatatggtttgtctgtgtccccacccaaatctcatctttaattcccacgtgttgtgggaggcacctggtgggaggtaattgaatcatgggggcaggtctttcccatgctgttctcgtgatagtgaataagtctcacgagatctgatggttttaaaaaggggagtttccctgcataagttctcctctctttgcctgctgccatccatgtaagatatgacttgctcctccttgccttccaccatgattgtgaggcctccagctatgtggaactgtaagtccattaaacctctttttcttcccaaactcaggtatatctttatcagcagtgtgaaaactgactaatacaaagcttctcttcataaattgggcataataaaggacatcatcatggccacagcagtatgcatgcattcttgactgtggccagtattctctggaacattgcaagactaagataaccttataaatgccaaataacagtagttctttttggttcatttaagtaaattctagatcaagtaatgggacctcaaatttcaaatgaatttttcatgtctttctacctctccctacagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcct

SEQ ID NO: 3522 - DNA, 24817 bp, human
attttacaaccccaacgaggtgggccatggagtgccccgagggacagctccccatttcttcagaaaatgattcaacaccaacagtttcaacatcggaagtaactagccaacaagaaccccaaattcttgtcgaccgtgggtctgaaaccacctatgaaagcagcgccgacattgctggcgacgaaggcacccagattcctgccgacgaggacactcaaacggatgcggacagcagcgcccaggctgctgcccaggccccagaaaacttccaggaagggaaaggtaggtggttttttaagcttgttcccccagccgaggaccttctttcggagaaacaaactgcttttagttcgattcaaaatttgtttgaattgcggcccccttgaggagcaatgggcgacgtaacctgtgtccctctccagaggatgtaaaatgttgactctgttgaggagaggggagcaaccgatcgtgttagagggctttgggcacagattctagttgttcagtgggtttgcacggtggcgtgtttgtcactaggcgaggtcaccgtgcctagggacaaaccgtccgacctaatggagtcgaggagcaaccaaaagcgagcaactcgctttttttttttttttttttttttgacggagtttcgctcttgttgcccaggctggagtgcagtggcacgatctcggctcactataacctccacctcctgggttcaagagattctcctgcctcagctgcccaagtagctgagattacaggcgcctgccatcatgcctggctaattattattattattatttttatttattttttttatttatttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaacatgttggccaggctgatctcgaactcctgacctcaggtgatccacccgactcggcctcccaaagtgctgggattacaggcgtgagccaccgcgcccggcccaactcgcctcttaggagtatcactgtcccctggtaaaaatcttctggcgccctgaaggttgcccctgtgtaaaggtaattttttttttttcggacagagtctcactctgtcgccaggctggagtgcagtggcgcaatctcggctcactgcaatctccacctcccgggttcaagcgattctcctgcctcagcctactgagcagctgggactacaggcgcgcgcaaccacgcccagctaatttttgtatttttagtagagacgggggtttcatcatgttggccaggatggtctcgatcttttgaccttgagatctgcccgccttggcctcccaaagtactgggattacagtcgtgagccaccgcgcctggccaaggtaacttgttttgaagcctcggtcttgcttcgcgaggtccctgagcagtcgcgtccccctcagccctcccctcggcgctcccctcggcgctccgcgcctttcgagccttcccgcccagcacgcggtgagcgggccactgcctcgaagtcgtgctccagtccgctgggcagcgcggccgcggaggcgtggcgaggcggggaggggccggcgcgcgccgcttttactgtccaggcgccggcagcccagcgttcgcctctacgttccgcgcgggagcccacgcgcggttcgtccggaacccacagaccagagacgcaggtcccagccttttcggtgtcggcgccagttcccggaggagcgggtgagtcgggcggccgaccgggcggccgggaccgggtcagcgccccgccagtgtgcaccccgccgcggtgcaccccgcagccctccccagccagcctgcacagcgaggcgcgaaggctgggacccgttgcgacctgttgggcctcgcgagaagttttcaagggaaagtggatcaaagcctaggggtcaaactttctctttgaaagcttagtgccccggggataaggatggaggtcagtctcttaaactgcagccggagactgcgaacttgaaaaaacacccatttaggcgtgtactgacttgcatggcctggagcatgctgccaggcgccctccagccaattataattccaattgtaattctgctaaagcgagatggaactagaggtgaatggtagtaaggggtcctgttaatttaatcaggcatcaaagagtgcttgctggaaaaaagtggatgctttttcttaaagtgaataccgtacaactagtcttttaggtaaatgcaagtaaatttaaaaaataattaaaacccagttcaaccaggattgtctaacttttctcccaccagactttttattaggtctgtttatcaaacaaatacattgaaatagtttcagttcttacattctttcttccataaaagaggaattaccaaaaaggcttggaaatgaacaaaatgccccagttttagttctgctgagaaatctaaaagttactactgatctgataaaatcttgcttagcagctagttcttcaaataatctgttcctgctcccagccttaattgttactatgttctgttagggaatgtgctcagcccccagattttttatttatttcgatcaactctcttcttgcatttacatttctcttttgtatttatatatgcatatatatacatatatatctgtatgaaacaagaagagaagaaattacaatcacaaataatgcatctttccctctcccatcctgggtgtctgcttttctactgctgactttttttgttttgttttgttttgttttgtttttgagaaggagtctcactctgtcacccaagctggagtgcagtggcgccatctcggctcattgcagcctccatctcctgggttcaagcaattctcctgcctcagcctcccaactagctgtaaagatacagctaatttttgtatctttagtagagatggggtttcactatgttggccaggctggtctggaactcctgacctcaggtgatccacctgcctcagcctcccaaagtgctgagattacaggtgtgagccacagcgcccagctgtctttccacctttgagaaaaatcttcctcagaagtgtgggcctggctgggcacagtggctcatgcccacaatcccaacactttgggaggccaaggcgggtggatcacctgaggtcaggagctcgagaccagcctggccaacatggtgaaaccctgtctctactaaatatacaaaaaaaaaatttagccgggtgtggtggcaggtacctgtaatgccagctactcaggaggctgagatgggagaatcacttgaacccgggcagcagaggttgcagtgagctgagatgcgtgccattgcactccagcctggggtcaacaagagcaaaactctgtctcaaaacaaaacaaaacaaaagtgtgggccctaatacccaaaatgcagggctctacaaatacatcccaaatacatggaaaataagattagaaataaagtcttggttcattgtaagaacataaaattgaaaaacaaataatgaaaacaataaaaaataataaaataaaaacttgggatccagcaatcccacgtctagatgtatatcctaaaaacttgagatcagtgtgtcaaagaaatatccgcacacacatgttcactgcagcattacaatagctaagttatgaaatcaatctaggtatccaacaagtgaatggataaatatgtggtatgtgtacccagctgaatactattcagcctttaaaaagaaggaaattctgtcatttgcaacaacgtggatgaatctggaggatattatattaagtgaaataagccaggcagaaaaagacaaaaatcacatattctcacttatatgtggaatctaaaataattgaactcatagaagcagagagtagtgttggttattacaggctggagtagcgggaggggcattgaggagatgttgatcaaagaacagaaaatttcagttaggctggtccaatagtagtgggatattatcacaacttattaacattaatgccactaaagttggtatacaatctcccacttccaaatttggcttttaaaattaaaaaaaatgaaagttgcagttagggggaataactgataagtatttaaggtgatggatgtgctcattagattgattcagtcatttcacactatatcataacatcattgtgtaccccataattatatatgattataatttgtcaaaaaaagattaacttggaagaaagtattcacttcaccaaaggtatatatatatattttaaataaaaagatccatcttaggagttcttttaaatagcttttgggggcattcgaagtaagtggtgattgtgaggattatatgaaatgatagacctaatgcactcaatgtagtactgggcatacagaatgcacacaataaagggtagtaatgaatgaaagggtagtaacgaataaatcaaatcagattttatgttctccataaaactccatctcaaaaagaaaaaaaaaagagactccgtctcaaaaaaaaaaaaagaactggattccatgctgggcgcggtggctcaggcctgtaatcccagcactttgggaggctgaggtgggcggatcacttggggtcaggagcttaagaccagcctagccgacatggtgaaatcctgtctctactaaaaaatacaaaaattagccaggtgtggtggtgcatgcctgtagtcccaactacttgggagactgaggcaggagaatggcttgaacctgggaggcggaggttgcagtgagccgagatcgcaccactgcactccagcctgggcgacagagcgagactctgtcttgaaaaaaaaaaaaaagaactggactcctaacttttccccagggtagctcaaagctgttgttgctggctctagagtcataaaaaactgcctggtctcccatggactgcttaatttctactaatccattaatgtaggtgaaatattgaaaatcaagcccttgtttacttcaaatcatcacagaacatttatgcaagtggtttctaggcgaatttcagcttttggtttgcattcttccctacagaggttagtttgcttaggtagccaccaacgtgttgttgaattgtagtcttttacctgagagtctaagaatatgattaagaagacgaaatcatgtttcataacagctcttatttcatttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggtaagaacttgtatctcagaacaaatatcttcataattatagtttaattataattatagttctacttggattctgacatttctatttcaggtaggctataaaaactcagaacatttgtttcccaggaatcatgttctgttaagcagtcctatcatagcgtgtacttttttggcagcattttttcctcctgtacaataccacctatcatgcaggttgatttcctggcaaaacagctgtgacaatgatggacccattcacttaccaccaatactaacagcctgttccctggacagccaagatacggctcctctgaaatcctttctgtcacctcaaaaggggcagtgagaagggccagcattattcaccaccatgcaagacttttaaagctcatctcaacaagtatttggctctcttcccccacactgatacctgtattcaagcaattacttagtctaggcagctatattaaggatggggttcagaaacctatttccctaattagggttacttaatataccaagcaaactgcaactaggtaagcctttctttagcaactacaacagaagggtagcagtgagaggcaggattgtagagctaggagaaagcattaactgtagctactaagagacaattatgagtttagagtcagcttcatcctaacttgacttatacagtgcacagtatctcatggtacatggtcttgttagtaacatttgggaggtgtaaagttttatttaagggagggctttctttgatatatctattctgttagctgccaagtagatgtttagttcttctgatttttcaatttacctcctttttaggaacatgcttgtactgtcaggaacctagcacgttctcaaagtgtcaagatgaaggataaactaaaaattgacttattgcgtaagtagttaatatccattcactatacattgaacaataatttattaagggattgctatgtgccatacactgtacttggtactaaggatgtgaaaaatgatagaatatggtctctgacttgatggactcatgctttagagaggcttaagtcctcttcttttaagaggaaaggaagtaggaatattgcaccttgagttgagtgattatcatagtgtgtttaaggaaacttgggggtcaactgtggggtttttatactgctggtagcctcccatatataaactttatgatttctgaacatccaagggaatgacaaatggatatgccattctttgtttataaaggtgacatgtatttctttctttctttctttctttctttctttttttttttttttgagatggagtctcgctctgtcgcccaggctggagtgcagtggcgcaatcttggttcactgcaacctctacctcctgggttcaagtgattcttctgcctcagcctcccaagtagctgggattacaggcacatgccaccatgcccggctaagttttgtatttttagtagagacgtggtttcaccatgttggtcaggctagtctcaaactcctgaccttgtgatccgcctgccttggcctcccaaagtgctgggattacaggcgtgagccaccgtgcctggccagtgacatatatttttcttttaaataatatttgttatattggcaaattgtacatccaataaagtggttaatatccaaatatataaggaactcaaacaactcaatagcaagaaaacaaataacctgattttaaaatgggcaaaggatctgaacagatatttctcaaaagaagacatacaagtagccaaaaggttcatgaaaaaatgctcagcatcactaatcattaggggaatgcaaattaaaacaacagcgagatatcacctcatacctgttagaatggcttttattaaaaaaaaaaaaagaacaataacaactgttaatgaggatgaggagaaaagggaaactttgtaccctattggtggtaatgtaaattaatacagccttttttttttttttttttttttgagatggagtcttgctgtgtcacccaggctggagtgcagtggcgcgatcttggctcactggaacctccacctcctgggttcaagcaattctcctgcctcagccttccgagtagctgggactacaggcatgcgccaccacacctggctaatttttttgtatttttggtagagatggggtttcaccatgttgaccaggctggtcttgaactcctgacctcgagtgatccacccacctcagcctcccaaagtgctgggattacaggcgtgagctactgtgcctggcctacagccattattttttttaaatggtatggaggttcctcagaaaactaaaaatagaacaaccatgtgatccagcaaccccacttctgtgaatatattcacagaaggaattgatatcaacatgttgaaggcatatctctctgcactcccatattcattgtagcattattcacaatagccaagatatggaatcaacctaagtgtaaatgtgatacgtatacacaatgctatactactcagccttttaaaaagaacaaaattctgtcatttgggacaccatggatgaatctagaggccatttgcaccaagagcatgtgtaaataaataagtaaataagtaaataaataaataaatgtttccacacaagtttatctgcctaaaaaacacacaaccaaaaataaataaattttgctagtttttttttttaatacagagaagcatataaaggagaaaacaaaaagtggctcataatctcaccagttagttaacacttactgacattttttaaaaaagataatataagttcatagttagaaaattcaaataaaacaggctgggtgtgatggctcatgcctgtaatcccagctctttgggaggctgaggcgggcggatcacttgaggtcaggagttccagaccagcctggccaacatggcgaaaccccgtctctactaaaaatgcaaaaattagccgggcatggtggtgcacacctgtaatcctagctatttgggaggctgaggcatgataattgcttgaacccagggggcggagattgcagtgagcagagattatgccactgcactccagcctgggtgacagagtgagactccttctcaaagaaaaataaaaaaatcaaatgaaaaagaaaagttcgaaaggagaaataaaactcttcttccttatggtgccccaacctcaataccacagataactgatactgtttcttgttacttccttattgacaaaactcttatgcataatactagaattgaagcaatctctctatttttagagttaattcacacaaaatgataaacattgttttgtatctttcttttttcacataatactagaagattatacctgaatcctcttgtgtcaaaagacatttatgtttgggacatctgagcagcaatattcagagtttagtatatggctgttgtatagaattttatctttatgaagctaattagagatttaacttgagatttattagcaccattctagggtcagtcaacccttccctcacccagccctttgaaaacacacatgtacaatgacacgattgaatgcttctaaaaaaaaaaaaaaaggaattggttttaatgaatggaatttgcttttcaggatgagaatgaaacatttattacttcacctatatttagttcacatccattaacaagaaacttagctacttttgcacaagtgacgtaaactaggaaaaaagagctccatatactttccatttcttttctttaggaagctattaattgtgtacacaattctagcattatgagagatagtaggtttcttggaaagactaatctgtcccacataagtcttcattattcaaaccttaggaagtttaagagttcactgggaagatatcaactttaatctttacttctcttcagctgatgggcgccatgcagttgttgaagtagaagatgtcccactagctgctaagctggttgacttgccttgtgttattgaaagcctgagaacgcttgataaaaaaaccttttataaaacagcagacatttctcaggtatggactagttttctttactagcctcacatccttcaaggaattcttttctcttcctatttttctttctttcagtactcctttccacttggtgaatggctgcttggcatttctaatttccagattgactgcacaggaatgaaatgtcatgttctcgtttggtgtttgatccttagctttcagtattgtattttgaccaaatagcctatagagagtcccatttgccacttatagtgacttttcattaattgaaacatatgagctgctgggatcttctgaactttgtattaaaacagtatgttgttaactctggaggtttaaattggttcttattcatcatctctgctgttgatttcttatttcctctctaaatcaaaatgctgagataggccagacacaatggctcatgcctataatccctacactttgggaggctgaggtgggaggatcacctgagcccaggagtttgagaccaacctgggcaacatagtgagacctcatctctacaaaaacaagattagccaggtgtggtggcacacacctgtagtcccagctattctagagattgaggtgggaggatcacttgagcccaggaggtcgagggtgcagtgagccatgatcacgtaccactgcactccagcctgtatgacagagcaagactttgtctaaaaacaaaacaaaaaacctaagctaagttccaagatctgtttccaatatattccctctgtagtggtaaacactctcgtggaaaaaaaaaaacaaaacaaagcaccttcagagttcatatgtagtgctgctggtggctggtggtggggaggagagggagagagagagactgcaaaaatgagagaatataaatgtacattacaaaatacttggttttctggaaatggcaagtatcagtctcttctgtgcatttctagtggtaagaatgattatgattgctaacccaaaattcgtggtcatagtcaacttctttgtctttgttaaatgtagatgcttgtgtgcactgctgatggtgatatccacctttctccagaagaaccagctgcctctactgatcctaatatagtcaggaaaaaagaaagggggagagaagaaaaatgtgtctggaagcatggcagtaagtcaccagccccttgctcattcctgctgactaaaatttatttgctgaatcctaattccttgtgaaacagggacgtcttaccacacttaggtgtttggttcattaggttctcagatactctttaagaggagtcacgtcagctgggcgcggtggctcacgcttgtaatcccagcactttgggaggccgaggcgggtggatcacctgaggtcaggagttcgagaccagcttggccaacatggtgaaactctgtctttactaaaaatacaaaaattagttgggtgtggtggcgggcacctgtaatcccagctactcgggaggctgaggcaggagaatcgcttgaacctaggaggaggtggttgcagtaagctgagctcgcaccactgcactccagcctgggcaacagagtgggactcgatctcaaaaaaaaaaaaaaaaaaggagtgatgtcatgaccctttggtttatagcatgatctttgtctttatcaaattcagctatgtgactaccatcagtcatataacgtttcactgtgttgtatttattttagttacgccaccacttaagaatgtcagaaagaaaaggttccggaaaacacaaaaaaaggttagttacatgctatttgtgtgtctgccgggccgattagaagaggatcatgggccagaagaaaagagaaaaagtcagttgggaattaatttttaattcatttatatgttcaataaacatttattgaatgtgaactaaatgccaggcactgtatgctagcagtagggaatatagcagtgaataaaaagacctgatccttgaggttataggctagtcatttggggtctggaagaatcatacatttgaaacttctgttaatgctttcagttttctattgcaagatctagttttaaagtgaacccatccagaacctgaaaattgggaattgtggttatattcctaatgttatttcaggcttgtagaatcttgggcaaactacaggagtattgtggcttggcttcttcttttgtttaaaattaaacatgttattttgaaataattgtaaattcatatacagttgtaagaaataaaagagagatatcgtgtaccctttcgccattttccccattttgcaaaactatagtacaataccacaaacaggtaattgacatgattagaattctgcaatcttattccaatttctccagttttacttgtactcgtgtatttttgtgcatgtgtttagttctatgcagttttatcccatgtgtaagttcatgtatctgtctacacagtcaaaatacaaaacagtttcatcacaaggatccctcattttgcttttatataaccatgcccacttcccttccacctcacaccccagtctctgacacttggtaatcactaatctgatctctatctctgtaattttgtcatttcaaaaatttaatattaatggaattatatagtatataacatcagagactagcttattttttcattcagcataattcacttaagatccatataagtttttgtagcatcaatagtttattttttattgctgagtagtattccatggtatgaatgtaccacattacataactgttctccctttgaaggacatctgggttgtttacaggttttgactattataaataaagctgtgaacaggtttttgtgtgaatataagtattcatttctttggaataaatgtccaggagtataattgctgggtcatatggtagtcacatgtttagttttgtaagaaatgacctgttttccagagtgactgtaccattttatattcctgccaataatgtatgaatgatccagtttctccacctcctcaccagcattaggtgttgtcactatttttcattttagccattctgataggtgcatagtgatcccattgtagtattaatttacatttccctgatggttaacggggttgagcatctcatgtgccatctattccacttcagcgaaatgtctgctcatgccttttgcctattttctaaattgattttttattattgaattttgagagttctttttatattttaaatactaccagtgttttatcagatatgtagtttgcaaatatattctcccagtctgtagcttgtctttccatcctcttcgtagggtctttcagagagcaaaagtttttagttttgatgaagtacaatatattgatttttttgaaaacgatcttgctttttatagtaaatctaagaactctttgcctagcccagatcctgaagattttctcctgctttttttttttttttacatctttttaagcctgatgcccattttcgacttaatttttgtaaaagctatgaggtttagttcaaggttttttttttgttgttgttgttgttttgtttttgtttgtttgtttgtttttgcttttcttgccaaaggatgtctaattgctctcgcactatttgttgaaaaggctattcttcctctgttgtattgcttttgcacctttgtgaaatatcagttgggcttggttttatgggtctgtttctgggttctccattctcctccactgatccatctgtcaatccctccaccaatatcacagtgtcgctatataattggtcctgaaattagaaggctgattgctctgactttacttttctttgtcaatattgtttagccattctagagtccatatctttatttatttatttatttatttattttttgagatggagtctcgctctgttgcccaggctggagtgcaatggcacgatctctgctcactgcagtctctgcctcccgggttcaagcgactctcatgcctcagcctcccaagtagccaggattacaggcatgggccaccatgcccggctaatttttgtatttttagtagagacgggtttcaccatgttggccaggctggtctcgaactcctgacctcacgtgatccgcccgccttggcctcccaaagtgctgagattacaggcatgagccaccacgcctggccaaaagcctgtatcttttaatataaattttagaataagcttgtctatagctatagaaaaccttgctagaattttggcaggaattacattaaacttgtagatcaatttggggagaactgacatttttactatattgagtcttccaatccatgaacacagttgccttggcttttatactctgtaaatcaacatttattgagtgcctactaaatgtaaaactaagttaaggatagttgtagagctctttaagctttactgaaatataggtatcataatataacttgtttattgtgttttatttcataggtccctgatgtcaaagaaatggaaaaaagcagctttactgaggtagagcaatcataatataacttcatttttacccttaatgtgttttatttaatagctcattagtttcaaatgaatcaaataaaccacagaagctacttttgagccttccttctcacctctaaccctcatcctaaacacatacactgggtttgattcactaaaaaatgaattcattgtttgatgtttgataactgctagaggaaaagatacaatttggccagtgaccccgtgtattctaatctgctctttttattctgatatttatttcaaaagccattccttgggagccagagctcacttttaacagcagttgtttgcaattgcttattccccatcaaaatcctaatttctatttgtggcacaacaaattggttgctgtggagataattatgtaaaactggattcaagggagaacatgcagctaagatccagtttttataggaacgtctctaataataaagatgtggggaagtgaaatctgggaatttggatctttaaaccaaattatttctaaataactaataaggaattatagttctttgccaatataaatcaggagaaataatttataactgagacctaagggttgcacctctgagagagggctttaccatagagctgcagattgaaaagattaaatgtctcaagtaatttgtttaattaggaaaaaagtaagtttactgtacaaaattctagaccctggctaaagattcctttataaatagcactacttaaagtagaaatttggttggatcagaatttaaagaggcctaacatttgaattcgttggtacgtaggagggcactcctgcaacacacagggtgttaaatgacagtattggtatccccctctaatccccaactttgcttcagtacattgaatctccagacgtggaaaatgaagtaaagagactgctgcgttcggatgctgaagccgtaagtacccgtatcctttatacaaatattttctgcatagtctgttctgccccatttgtacatgctgacgaagcctcacctctggtgtttgtgtgccagtcttgatgtgtggaacttaagattctttgaaatgttctagctaggaacagtaaattcatgtaatagaaaattatttattgtgtaattcaatatgaggcacttctccaaactaggaattccaatacaaatggcctaaagttggactaaattaaatagcactgttagccaaagagccccttccctttcagctgtgcctttttgtttccttctgtgttttccttgactacccactcctttcaggttgggaagtcattgctgaagatggaaccaaggaaatagaaagtcaaggctccatcccaggatttttgatatcctcgggaatgagcagccacaagcagggtcatacctcgtcaggtactttagtaaaggcaaagcaggagtttcagatagggcaggtattgactgggtatcagatcattttccataaattcataggccaatccaaaaaaaaaaaaacccagaaaaaaaggatggtttcgtccttccctctttttttttttttttttttgagatggagtcttgctctgtcgcccaggctggagtgcagtggcgtgatctcggctcactacaacctctgcctcatgagttcaagtgattctcctgcctcggcctcccaggtagctgggattacaggtgttcaccaccatgcccagctaattttttactagcgtcggggtttcaccatgttggccaggctggtcttgaattccagacctcaagtgatctgcctgcctcggcctcccaaagtgcttgaattacaggcatgagccactgtgcctggcctttttttttttttttttttttttttgagacagagtctcgctctgtcgcccaaactggagtgtagtggtgcgatctcggctcactgcaacctctgcctcccaggttcaagtagttcttgtgcctcagcctcccaagtagctgggattacaggcatgtaccaccacaccaagctaatttttcttttttcttttcttttttttttttttgtaagtagagatggggttttgccatgttggccaggctggtctccaactcctggcttcaagtgttctgcccgcgttggcctcccaaagtgctgggattacaggcatgagccaccacacccagcccttcttccctcttattggtctcttggcagtttaggggttttagattagtgttctaatctcccatccacccctggtattttaacttcctatgacccttagagtctctaaatatcttgatcattcactacatgaatgaatgttacagtgttttgcatttgctgtccttgttttataaagggaataatcttcctgcatgaaaaaatgatttataaaattcactggttgcctggggaatgtgaaaggagtataattatatctggagtatgagtcatttgcagagttttagatagttcaccttcttcttgcttaaaactagtagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaataggtaagtcagaaaaaacaaagggatgggaccagggtgggtggcagtgctaacagttgactctaagcatacattagactcaaagctaagctcaagaagttatcgcttcgatgtgtagtagagttttacttgatttggatcttggtccattcatttaggctatatttaatatataaagttctatgtttctctattagtcatggaaattcagaagcagattgagaaaaaggagaaaaagctccataagattcagaataaagcacaaagacagaaggatctcatcatgaaagtggaaaacctgacactcaaggtaaattcttggctggcataaagaaatcctgatatcttactttcagtatcttgcctttgtgtttccacttatgttatctctgtgcagggttcttgttcattcatgaacctaaacagcctcttagaaactcctaataaaagataaccctgtttccttttacctgagtaattttgatcatctaatataagcattttggggaagggactaggtgatatgagataaaaattgccaatattgagcatttgctatgtaaaaggcacataaagggctaagaattgtgtacacatattatcacattttatcctcacatccttgaaacgtaaatactgtcaccactcccattttatagataaagaatggaaactcaaagaggttaagtaacttgccagggatcacagtaaatgatccctgagtaagggatcttttagtagagatgaaacctcatctctactaaaaatacaaaaattagccaggcctggtggcatgctcctgtaatcccagctacccaggaggctgagacatgagaatcacttgagcctgggaggcggaggttgcatgagccaagattgcgccactgcactccagcctgggtgacagaggaagattccgcctcaaaaacaaaaacaaaaacaattatttgccaaactccttgcctcccttggtttttttttttttctttgagactcagtgttcatcatttatacaatttatttttcagaatcattttcagtctgtgctggagcagcttgagttacaggaaaaacaaaaaaatgagaaggtaagaagtatgttttcaaattaaccagaaaacatttgatacagagaatcccccacttcaattccaatatcattgctggctgttcctctcataggaatagtggtagccaaatcttctaaatgaaggtagcagggtggaacaaggtctttgtgaaaattcactcattcaacagatattgaatgcctatgaagtgaaaagcactggatgtacggtgttgaataagacaaatgcaatacagtaaatcctcagtgtcattgataggttcttggaaactgtaactttaagcaaaataatgtatatataatgaaaccaattttactataggctaattgatataaagaagaattaagttcctatagcatatttctggtcacaaaaacatcaccaaacttctaaataaaaaccaaaacgcttctaataattaaacgttgaaataaatgtgagctatacatacatttgagaaagactgataaaaacaagtaagacaattatgtacccagtgattccagttcagggtctcagatggccagagcctatcccagcagctcagggcacaaggtaggaaccagccttggataggatggcatcccattgcagggcacactcacacccacactcacacccacactcactcagactgggacaattcagacaaaccaattcacctaatgtgtacagggaagtgattttatttttctcatcaacattataatgaggccaggagtggtggctcatgcatgtaaccccagtattttgggaggccgacgcgagaggattgctttagctcaggagtttgagaccaatctgagcaacatggtgaaacgctgactgtacaaaaaattagccggttgtggtggcataagcctgtagtctcagctactcaggacgctaaggtgggaggattgcttgagcccaggaggttgaggctgcagtgagccatgatcacaccactgcactccagcttgggcaacaaagtgagcccctgtctcaaaaaaaaaaaaaattataatgaaatgacattgaactaacaatgttatttggagaccttttgcatgtcattttgcttaaagttgcagtttctaagaacctattgatgacattaagtgaggacttactgtaacaaaacgacattggacaaaacgatgttattcaaggacctgctgtacttatcctcgtggagctgtctagcaggggagattgacaataaacaaattatacaaatataaagttacaaattgtgaagaagtgctatgaaggaaaaaagtcagtggtgctattagaataaagggtcttgaattaattgggggatcatgatagacctctcctaggaggtgctattgaagctgagaccggaaggattaagtccaggcaaagagtgggatgaggagcctcttaggtggagcgtatgcaaggtctcatgctcagaaagaacttggcttctttgaggacctttggagtatttaaagccaggaagagaatggcttaagataaggttggagaagtaggcagagaccatagtgtatggttccttgaaggccatgataaggaggatgggtttggccttaagtgtaatgtgaagtccttgaagaattgtagataggaaaatcacatctaatttaaacttttttttttttaaatggagtcttgctctgtcgcccaggctggagtgcagtggcacaatctaggctcactgcaacatccgcctctcgggttcaagagattgtcctccctcagcctcccaagtaactgggactacaggcacgtgccaccatgcccggctaattttttgtatttttagtagagacagggtttcaccgtgttagcgaggatggtcttgatctcctgacctcgtgatccacctgccttggcctcccaaagtgctgggattacaggcgtgagccaccacgtctggcctaatttaaacttttaaaaggttactctgattattatctggagaatgggttggaagaaggtgagagtagaagcaaagaggctggttggggggctttgtggtactctaataacagaggatggtaacttggactaagttagtagcaatggagattgaaagaatatagatttttaaactgcaataaaaatgtttttataacagatgtaattcataaaccatacaatatcacccatttaggctgggtgcggtggtgcgtgcctgtaatcctagcgctttgggaggccaaagtgggcagatggcttcagcccaggagttcgagaccagcctgggcaacatggtgaaaccccgtctctccaaaaattagccaggcatggtggtgtatgcctgtagtcccagctgctcgggaggctgaggtgggaggattgcttgagcctgggaggcagaggttgcagtgagcagagatcccaccactgcactccagcctgggtgacagagtgagactgcctcaaaccccgtcctccccacccccgacaagtcacccatttaaactatacaattcagtggcttttagcatattcagagttgtacaaccaccactgcagtcaattttagaatagtttcatcactccaaaaagaaaccctgtatccattagtagtcactccccacttctccagaacctctcccctgcccagcactaggcaaccactcatctagtttctactaatctactgcctattctagttatttcatacaagtgaaatcatataatacatggtgttttgagtcgggctcctctcatttagcatattttcagggttcatccatgttatggcatgtatcagtacttttttccatttaaaactgactaatactccattggatcaatataccacattttgtttattcattcatctgctgatggacatttgggttgctttcacttttggctattatgaataatgctgcaatgaatattgatatattagagaatatactttaaaggtagaattgacaggagttgggtcaattactgggtgttgaaggagaaggaatcattaaggatgtatgtatttctaacttgaacgacaactgtatttttcaaagccacaagagagtgtacagggcgaagagagaagaaggcaatataggctaaatgagggtcaagcagctgtatagaaaatgtgtgctgactctaaccttatactgttgagggttacaattttaaagagactggagttggtattatgaggatgggcttagcatggtgctcttgaagtacaggcactactccccacccccatccccacaaggctagcggaatttttatgttctatatattcccttcctctcagcaaatcacttatccaagtactgcttaatactgctttaaaacaatcagatgaacagttaatgccaggattgttttagtacccaccaaacatctttgttttcatcaatgtaagtacagttgtatgctgcataacaacattttggccaatgacagactgcatatatgatggtagtcccataagattataatggagctaagaaattcctgtcacctggtgacactgtggccatcataacatagcagcagaattacttaatttttaaattattttactatagcctaagtatatagtgtttatatagtcttcagtagtgcatagtaatgtcctaggccttcacattcactcaccactcactcactgactcacccacagcaacttctagtcctgcaagctctattcatagtaagtgccctatataagtgtaccatttttaattttttatattgtatttttagtttaccttttctatgtttagatacacaaatacttaacattgtgctacaattgcctacagtattcagtacagtaatatgctgtacaggtttgtaacctaggaacgatagactatactatgtagcctaggtgtgtagtaagctatactatctaggttggtgtaagtatgttctatcatgttcgcgtcatgacaaaattgcctaaggatgcatttcttagaacatatccccattgttaagtaacacatgactatatttagtattgaggagcagcatagaaatgtagctgtaaactttatttactcagagtcccttatgttagttcatttatccaaattagatttagtaggtgtctactttaagctaggctctacagggagctatgatatgcttatgatgtagtctctgtcttcatttggggagaaattggcaagaggggtagggacttaaaggaatgacagattgtccatggatattaaagaagacttcatggagaagatggtgtttgactggggccttaaaatataggtagggttttaataaggagatagggaaaggagtgcattccatgagaaagcagcatgcacactggctcagaggtggtgatgccagggtgaacagtttagatttttggtgtaggtcataatgaaccttcaaagcctttttacctggggaataactcaggaagatttttctgccagaagtatataggagaaattggagtggggacagcctggagcttcaaaggtgcaagtggtagaagcaaacagagcttaacaattgattggatttacagggcaaaaaggggaacaaagatgagtccaaagcctgggaaactgggaaatgatgtgccattaactgaaaataggataacaaaaagtggatttggaggggtatgtggagaagtgcttttgaaaatgggaaattggagagaggcccatacacagaaatgatcattgaagctgtggggctagttgagttagcctggttgattgttcagcaagaagtctgaacctaaggaaaaacctatctatagggggtggtgggaagagaaagagcctgcaaaggagaaagaactggatcagtcagtggttgtaatcatggtcaatcaggggtcactcagcaactgagtgagaagagcctctaagttactgcggacagcaattattgtggcttggtaggtgatgtgcagcataggattgttttataatgttcctttcatttcacagactaaaaattcattctggtatggagtgtcctgaaatgaataatattcaaaaacaacctttgttgtaaagatggcatacatctctgaatgttattggtcactttaccatttcaagttaaaaaaaagtaaatcctataccacaaaatgttcagggcttctaacttagaaagcattaagtagaacatcatcaggctcctgattggtcagggctctggctcagtttctaagtatctcctaatgtggtaagaagcagctggtaagactcagtctaagacccattgtgttcattgggacaagagagtgtcccaactgttttatcatctgactcttagaatatggctacagagatcccatctcctttgcccctacagtgagctgtgacctctgtatattcttcacagaagcacaaattcttaacagcaaaaatattgtttttttttaaagcctattcaattttaaagcttgatatggtttgtctgtgtccccacccaaatctcatctttaattcccacgtgttgtgggaggcacctggtgggaggtaattgaatcatgggggcaggtctttcccatgctgttctcgtgatagtgaataagtctcacgagatctgatggttttaaaaaggggagtttccctgcataagttctcctctctttgcctgctgccatccatgtaagatatgacttgctcctccttgccttccaccatgattgtgaggcctccagctatgtggaactgtaagtccattaaacctctttttcttcccaaactcaggtatatctttatcagcagtgtgaaaactgactaatacaaagcttctcttcataaattgggcataataaaggacatcatcatggccacagcagtatgcatgcattcttgactgtggccagtattctctggaacattgcaagactaagataaccttataaatgccaaataacagtagttctttttggttcatttaagtaaattctagatcaagtaatgggacctcaaatttcaaatgaatttttcatgtctttctacctctccctacagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatg

SEQ ID NO: 3523 - DNA, 1476 bp, human
tgggtcccgccatgcctcccagtaagatgccagaaagctcaggagttagtgtctccagtggactgagtcagtgttactggggcagtggtttctccaagccctttaggaagatgatgacctcgacttttctctgcctgacatcctattgaaagaggagaccatggaagatgaagagctgaccaacctgagctggctgcatgagagcaagaacttgctgaagagctttggggagtcgatcctcgagtgtcagcccggtccagggcctggacgatgacagccaccgtccccacccactctgatatgccctaggatgccaggcagaaccccaactgcaatccccccttactcctttagctgcctcatatttatggccatcgaggactctccaaccaagcgcctgcctgtgaaagatatttacaactggatcttgaaacattttccatattttgcaaatgcacctactgggtggaaatactcagtgagacacaatttgtcattgaataaggattttaagaaagtggacgaagagaggagtcagagtattgggaaagggtcgttgtggtgcatagacccagagtatagacaaaatctaactcaggctttgaaaaagacactttatctcccacacccacatccacacgtgttcaatacacctcccacctgtcctcaggcatatcaaagcacatcaggtctacccgtctggccgggcagtaccttcttcaagagaaatggagcccttctccaagatcctgacattgatgctaccagggccatgggactccccctgaaatacaagcaggttttcctccaggagtgatacaaaacggagcgcgggtcctgagctgagaggactgtttcctggtgtgcggcagctgccgatcagtcccattgagatgacggctgccatgatgtacggcatcaccagctgccggatgcggactgagagcgagccatcgtgtggctccccggtggttagcggagaccctaaggaggatcacaactgcaccaatgccaaatcctccaacgcccggagcaccttgcccaccagcgactccatcccctcctcctccttggccgacgaccactacaagtttgccagcaaggagagccaggagggcaatgagggcagcgaggggagcttccggagccacgagagccacagcgacagggaagaggacgacaggaaacacagccagaaggagcccagggatgctctgggggacagcgggtacgcatcccagcacaagaaacgccaggactttgctaaggccaggaaggtccccagcgacacactgcccctcaaaaagagacgcactgtaaagcaccgcccccgcaccgccccccaccagggcgaagaagaggagattaaagaagcggcggggtcgctcctgcacttagcagagatccgatcctgtttgaataacatcaccaatcggacggcaaaggggcaggaagagcaaaacgaaatcacaaaaa

SEQ ID NO: 3524 - DNA, 3181 bp, human
agtgggctggctcctgacgcactttctgcgggtgggaggggaactagggacccgagcccactggtgacgtttttctcacgtgatctgaagccgacgtgtgcagaagtccctctcctccaggtaccagatccctgtttccgtggaggaaggcagacttcagactgaaggacagagaaggcaactgccctacagccctgcaggtcggtacaagccggggacccctgaggtagggatggtaatgcacataggctacagaggatcggatctgctttctagataccgccctgttccacccccattcattttggcgcagaaatttttttgtgttgggcaagaggtatgggtaccagcttttatttccctggagaagtgcaggcttctggcagaaggaaatgtgagaaagagtcatttccccgagatggctacgaacccatccacagcctgtggatccctgtggttgggatggcagagggcaaagaccagagcgggtccaggactggattctctccactcctttcccgatgctcactcatttggtgcaagaaatggagggcttggtgcggggcggggaggggggaggggggcggaactcgagagaggtcaagggttgagaattgggtaccagttgggaactcctaggaagccggcgaccgggtgatgtctgatggaggaggaggaggaccagggaagagaacagcgacgaaacggcgagaaaacggcctgatccctgcaaggcagcgggaggcgggcacagtcagtgaccccaggctgctgagggcggaccctgcaacgggtccaggcctgagttccctgtgtcttttctccaacctccctccattttggagccggaaacggtgggctaagggggtcaggggaaggaggtgctgtagaaaaagggagacagaggtttgatctggggatcagctccctatccaggaggagtggcttctgaagtaggaggattgagatgaggtagcagcaagaccaaaaatgttaccgggtttggaaataatttgtctcttgcattgcagaaaaatgtgggctttctgtgtatgtggggagggaggaggtggcaggagtgttttggacatttctgccctgccccctatctctgtcatcaccattttcagagaagtggtgggctctgctatttggctaccctagggtgagggatttggaatgtagagatctgagtgcatcagaacactctgtcttcagaacatccttgtctctaaccctactcattttcgtgccagaaaagtgagataaaaatttgggaggaagattcagaaacatagaaacgctttggaaataatctttctcgcctatttcccacaagtagaacaatggaggctcttaagaaagagctgcgcgcggagggggaatcagagaatgcaagggaaaaggcgaggaggtgataggagctcggaaagttttgacaaatacggtcccaaagaaccagtgtccaagttaccagtcattcactttctcaatttctcattcacccacctgtttcttgtctttctgcaggtcttcaagtctgtggttgtgggcactaacccagacaagaaaaggaaagacctgcagtatcggtgcaggtcagtgggagagggctactgcaccaggacccttgggagtaggagtaacttaagccagagcagaagttggggaggccactgcctgccacccctcctccaatcctccctcttgcagtttcgggatacatgactgctgtcaagaccctaaggggatatggtgatctatggctggtgaggatagaggggagaataagaaagtaagagaatggaggtgtagcatctgtgatgccccctgaggacataagggtagccctgaaatctgagaactggctatggttctgttctgtctgcagttttataagtcttacaactgcatgcaaggggaaaaagaagaaaactgcccaggatttctgcaggtccgtgtaaattggaactacccagttaaaattggtatgggtaggcatagccaaggccagagcaaagtttaagggccaatatgctcctacgcatttctcagcacatcctccttaaatgtagggagaagcacctgtggaagtttctgtaaggttggcttgtgtgaacatgtgtaaagtgaaaaggaaaggaaggaatgtaagggtgggagtgcacctggaagatgggatagggccaggaaaaccctaagttaagaaagacaagtactataaggacctgtgttcaacccccaaagccctcagtgtcctgtgtcttctttttgtctcctaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgtcccatatgtttaatgtctttggcctttaattctgatttctctgatgggaatattgccagtcctgcttttcctggcaggcatttgccggcctatgtgctttaaccttaagctgatactttcctttaggtgtcactcttgttaccagcagacttttgacccaactacagtgctctgtcttttagtagaggattttcacccatgtgcatggaataaatgttcatggtacattgtaaaataacaataaaaaagagttttcagaaccat

SEQ ID NO: 3525 - DNA, 1263 bp, human
tggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtcagcttggggggctgggcggctgaggcggggggcgagagcggctaggagggcccgggcccggcgtggggaaggggccgggtggcggcgggtcctctctagcgttccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaa

SEQ ID NO: 3526 - DNA, 1505 bp, human
cgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtcagcttggggggctgggcggctgaggcggggggcgagagcggctaggagggcccgggcccggcgtggggaaggggccgggtggcggcgggtcctctctagcgttccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttg

SEQ ID NO: 3527 - DNA, 1700 bp, human
gggacgggggcggagcctctggcgatgacaacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtcagcttggggggctgggcggctgaggcggggggcgagagcggctaggagggcccgggcccggcgtggggaaggggccgggtggcggcgggtcctctctagcgttccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttttaaaaagc

SEQ ID NO: 3528 - DNA, 1601 bp, human
gctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggaggggtgcccggccccgcgggagccggcgatcctgaggctacgacctttcggaagcacctgcctccgtcaccagcgcaagcttttccaacacccctgctccgcccttcttgatgcagaaaatggtggtcagcttggggggctgggcggctgaggcggggggcgagagcggctaggagggcccgggcccggcgtggggaaggggccgggtggcggcgggtcctctctagcgttccgctgcagcagcccccactcttcccaccccggccgtctgcaggtttgcggggccaagtgttgcggcgacgcacctcacgtcgagaatcgggaggaggagactgcaaggataggcccaggtcagtgcgagggacggtggtggggagggggtcagaacatgaggaaagcccagtctgagaccccaatccgtgccttcacccccacacttagcaatcccccacccccaccccttcttcgtcctccattttggtgcctgcagaggcctggagatggatctgcagagaagatggtgggctttgcgggagagaagggcacagactggctcccctcgcccccccgagggtacatggggcctctctggtggaaaaaaaatgaaatttaaaaaaggcctttgaaatccagggctctgaattttgaaaggtgggtagtcgggcctctgtcctcggtgctgatcagttcaccaagaattgagtccattttctctctgtctcctaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtttgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaagatgctcattatatattgtgaagttaataaaacagttt

SEQ ID NO: 3529 - DNA, 2130 bp, human
tgaaccgaagtccttatattcccgggcttctttctcctctgggtaccagctccttactgccctgcagacaagcgtgccgtgcgtgcttgtggccaagggaaggaagaggtaaattccttaaatcccagcaggttggagtgaaggaaccactggacccccggggtcagtagtgggtgaatctaatgactggaataggtccagacttgctttcccaaaaccgctgcaaaatcgtcggagataattgtatcttttgcagggggaagcaagggggtaggtcgaaatcttttgagagacacctagagatttagtgacagctttgaaataatcggcttctctcaccctggcatgctttctttttatccttctcctcatctttctccaattttgttaagagaaaattttaggcctggggtatgtgttggtgtgtggagaaaggctgaaatcccgggatggagacaacagaaatttagagatcatttgaaaatagttcacctcactcaatgccggcctgtggtggtggggtggggcgcgggacggggcgaaggagggagacgcgggccttgcaaggcccaggcctgagggtgaggagtggggagtggaaacggaaatcctgaaggaaaggatacagacaggaaggaggggccaggaggtagaaatccggggggcgatgacggtgatgatgagaatcccaggttcaaaataataacgtctgtcttgtctctggagctggttgatccacagatagctccttcctccccgccccttcctttttgtttggaggtcccaggatctgtgttcacagacatctgggggaagaaaaggagcaggaaactaccccgcacaggtcagtatgagagaggcacttagactgagatctctgaggataggagtcgggaaggggcaaaagctaggcgaaatttgcggcttcgcagtccatctccttttctgctccgcctctcctgcctattggagaggccattagctttgtctgctggggaaacggtgggttcctgaggtgggaggggagaaaagggggagatgagagggtggagggaactgccgcagacttatgaggtctggacctgtggggcagagatgggaaagtatcttgcctcagagagaaactgacaatcgtgattcaaaagtaatgaagcaatttgtctttacattttctccctagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagata

SEQ ID NO: 3530 - DNA, 1859 bp, human
ctcctctgggtaccagctccttactgccctgcagacaagcgtgccgtgcgtgcttgtggccaagggaaggaagaggtaaattccttaaatcccagcaggttggagtgaaggaaccactggacccccggggtcagtagtgggtgaatctaatgactggaataggtccagacttgctttcccaaaaccgctgcaaaatcgtcggagataattgtatcttttgcagggggaagcaagggggtaggtcgaaatcttttgagagacacctagagatttagtgacagctttgaaataatcggcttctctcaccctggcatgctttctttttatccttctcctcatctttctccaattttgttaagagaaaattttaggcctggggtatgtgttggtgtgtggagaaaggctgaaatcccgggatggagacaacagaaatttagagatcatttgaaaatagttcacctcactcaatgccggcctgtggtggtggggtggggcgcgggacggggcgaaggagggagacgcgggccttgcaaggcccaggcctgagggtgaggagtggggagtggaaacggaaatcctgaaggaaaggatacagacaggaaggaggggccaggaggtagaaatccggggggcgatgacggtgatgatgagaatcccaggttcaaaataataacgtctgtcttgtctctggagctggttgatccacagatagctccttcctccccgccccttcctttttgtttggaggtcccaggatctgtgttcacagacatctgggggaagaaaaggagcaggaaactaccccgcacaggtcagtatgagagaggcacttagactgagatctctgaggataggagtcgggaaggggcaaaagctaggcgaaatttgcggcttcgcagtccatctccttttctgctccgcctctcctgcctattggagaggccattagctttgtctgctggggaaacggtgggttcctgaggtgggaggggagaaaagggggagatgagagggtggagggaactgccgcagacttatgaggtctggacctgtggggcagagatgggaaagtatcttgcctcagagagaaactgacaatcgtgattcaaaagtaatgaagcaatttgtctttacattttctccctagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttt

SEQ ID NO: 3531 - DNA, 2476 bp, human
ggagacagaacttgaggactgaggagagaggaggcccaggacagaaccctaggaacactgccactcaaggtggcagctcagcttcctggcaggcagcaccaccctgggctctggagtcaggcagagacagtcttgaaagcgggctctggagttctggggctgagcgctcttggcaaagtcgggtaccctctttgatcagctgtcacacctggcgataatggcatcagagagagataccctgcgaggatgccgtgagatgcgccaggtaaagcacctggggtcagaaagccaccccctcctcctcttctccgtgacccccctttgctacacaaacacaccccgaccccgaccgtccccagcctcccggtccttcggggttggatggtgaggtgggtcaggcaaggggggccgagctcgggtgacgcggcgctcacgtgacccgccgggcgcctacgtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtcagtgtgaaggtgggcgctgccggcggaaccacggaaggggtggaggtggctggcagtaggagtagggaggggcggagaaaggatccgggagactggtgaggagggggaagcggagcggtcggaggcaagggcgggggagcctggcccgccttctcgacgaccccctgcactgagccgtccatccattttagtactggaaatggagtacgggggggcaaccccgcagtgcaacagtgaaacgtagacatattctggaaataaccgcctctcacaatctgctcccatggaaacatctgacctccgcaaaaacggggtggcgctgggacaggttgcctccaggggaaggggacacagagacaaacgcagtttggaaagcatcctggtttggtgcccgaggcctggaaagaaatggcggctggggtgcgggggatgtaggggaggaaaacgttgggtaagcagggcctggactcaggaaagggaaccgagtccctgtgagaccgctgactgcgcagcccctacccctgtctcctgtctgtccgcaggtctgcgcgtctgttcccagcgctctgcgaggcctaaaaaggaggagcaacctgtccagaatccctgcaggtctgtgaaggtggttgtgggggagctcaatggacagggccctataagggttgagagtgtggagggcccggccagggccgaactggggcccctgcccatcccccactcacatgaacacacaccttaccaggctgaaccagtgcagagaaggtggcagggactgccagggaatggctggctcacgtgtgtgggaggagtggcaggctacgtggtgggcagaaggccctcttgggggccctgccagcttaggggaaccctcaccaggggtgagatgcaagtactatccagacctgcattccaccccatgccctcagtctcccatgtctcttatttgtctcctcttccctccattcccatcccccaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgca

SEQ ID NO: 3532 - DNA, 2126 bp, human
ctttcctgttaagtgggcacactactacctccttcacagggctgctgagaagaaaggagacaggcgcatccgcacacagaaagcactcagtaaatgctgtttccccccttccccctatacaaaggtaaggaactctcattgttcacttggtttctgtcccacctcgtgtttcaggcatccggtctcaaagcccggagcagagccgaggcggaaggggatggggagaagggaagcgacggggtagcagcaaactcacagatgaaagggaaatgggcctggtccgtgcgtccgagctccacttgacgccgcgccggctcccgtgcctgtcggcctcagcccccgccagccagctcccgagtcttgctagcagtagcttcagggccagaggctgcttggggaggccgcctcctcgccccgctgattggccgcgtcgcgcggcttgtcacgctcttttgtctcaatgggcagagactgaaagcaaccgcggctgcccggaggtccgaactggagggtggccgcagccgtgacttccttgggaaccgcgctgcctcgactcggctacctctctgcgaagcactcgctaagccgggcagccccggggtcgcttagcggcccaggaggcgccagcgatcctgttcccctgcagagctatggggaccggaaggcgaaacagagctgtcgacgcgggagcatacgctgcccaccagtggagcgcaggtaaagaaagagcgcgcgatttcccggcgcggagaggggtgggggaagccccaccaggactgggcggcgcccggcttggagaatcagtaactgcgaggcaggggatggagcactcccatggcctggttgcgctgagaaaggagttgtggctcatctggatgctgccgactgggtaggatttatgatttgcctggattgaagtgggcgggggtgttgtcgggcgtcgggggcgggtgttcggggaggtggcaaggggcgggagaagacgatcgcaagctgtcttgaaccccttttgcatctcctcatctcttcctgggaaggaatatgggggtgggaggtcatccaacttctagtccctttctctctggcaggtcatcaaagccgaatccgaatttgaattctgtgcggctgattgcagagctggtaggccgacggtttcccgcaggaaatgtacggggggcgggagtgcaggaggcactttggcttgtgttcagaagatgggagagggaattttccgcctggcgacagaggaggcggtggaggggaggtatcaggttttcagaagaggctgctcccaacccttcctttccttccttcgcggcacagtcttgaggccctgaggactgggatctgcgacccccagtggacaaaagtcgactctaccccagaggctaattttctcaaggcaggcacctgttgagaggctgcaagtaaaatacaggggaacgctagtttccgagctcatgtaagaatctgagaaataacgggggtaaactttgacaaaggggtgtgtgattgagacctgaggtcatgagattaatgggttcttattacctcttgcggggggaggtagtaaaggggaggggcaggtggcctgtggcgtcctgaagatttttcatgcattctttttccgagaactaaacattgtcaactctaatatatctatagcgcaacttgcttcaaggacagtaataattttcatttaataattttccatttaatccctttactacatggtcatttctgtctcttatattcctaggtttccctttataaggattagtcagatcaacattatatctctaacaatgttccttagctttttcactctcattatacctagagaatttaatggaataaaccagattttatatatatatatatatatatatataaatgtgtgtgtgtgtgcgtgtgtgtgtgtataaaattactcaacattcaagtagtcttgaaaaaagatgggtaggagtcaccttctttcccttcatcagttaccagtgttctcttaacataatggaagaggcaggaggtattcccacctacaactcaggattcctatgtcctatgggttcagttgtgtccccccccccaaaaaaaaaacaccaaatacatctattggactcctg

SEQ ID NO: 3533 - DNA, 13715 bp, human
agactcgggagctggctggcgggggctgaggccgacaggcacgggagccggcgcggcgtcaagtggagctcggacgcacggaccaggcccatttccctttcatctgtgagtttgctgctaccccgtcgcttcccttctccccatccccttccgcctcggctctgctccgggctttgagaccggatgcctgaaacacgaggtgggacagaaaccaagtgaacaatgagagttccttacctttgtatagggggaaggggggaaacagcatttactgagtgctttctgtgtgcggatgcgcctgtctcctttcttctcagcagccctgtgaaggaggtagtagtgtgcccacttaacaggaaaggactgaaacacccaggcggtacagttaggaagtgcagagctaagagctcactcccaagtcaacatatctgacttcaaaggctaccccttgccaacactcctctattctgttagattaagggatagcggagaaaaaccaaagccaggatgggaggaccaacttgggactgcatagaattagtgagcaagaactgttatctccatttcacagatgaagaaactgagccaaagacagagaggttaagcgtcttgcactgtatcccgcagcaaagaagttacagcatccaacttagcacctgtatgttgctctctagatgctaattgtttgccctgcagcattgtctgaagagcacttttgcacaggtagtctcaaaccatctcaacagcagtctcaatgtgatgatagtgctgagggagggggtgaggaggtagtagggagagggctgagggaagatgaaggcaacctttatggtgcccattgtacagaagaggaaactcttcttggcactcttctttccttcgtttttttaaaaatacttttttttatactacaaaaagctgccctttttataaaagcaacataatttcgacagccctttgtgacgccaagggaggcaaggctcagagaggtaaaatgatttgtctgaaattacaaggtgaagccaaaatttggaccgaatctctgaatccagaactcatactattaactaaagtgagtaaaaagtgggctgcctcagaatcattttggagagcttgttataaatgcagattcctgggccttacccctgggggattttgatgtactaggactacaggtaaagagtgtgatttgtagttttaaacagccccatagttgattctgaggtgtagagagattcgtgaaccactgttctaaacaccaccacgtgatgctgaaggttataagtaaatgggcctgtcatcagtgtatttgtccatggcatatctgttatgaaatgtaactccagagcacaggttcctacccgcggtccttcctggaactgtatgcaaagaatctggactccgtacattcttctgagtccacagctttgcagattttcaaatgggtctgtcataatgtcttccttcttcaagccatgcttgatgaagaagtgtgagaaatcaaaccccatttaacctaacccccaaaccacagctctctgttgctgatatggctctttcatttcctggctcaaggacaggttgctaggttgcccttctgtgagctcttcaggggacttctcctttgctggatttggcatcactggccccagagaaggagcaactccatggaaacagcatgcagggctgtccaaagtgaatggccatgaaggcagtggctggaaaacctgctccatttttccctgacttagagagcaggtattacttcctttatgtatagtgtggctaggaggctcctgtggggcctgttcttgactcctgatgcttggaagcaagtgaacagtctgaagcccttccactgccgttggcttcatcttcagcctgccaaggcacttcactcactcatttccaccctcttatttacaaccccaagatgtagagttccttggagtaaacaatacagatttggagatgaagcactttccatctcaggattgtggcctgtggatggaacagtggggtagtggtggtggaaggtggaaagtgtggatgtatggagaaggcaggttgctcacctcgcacacttaggggtgatggtggcagtagctcttaggtttccttcagacttttgcttctgctcccctgtcccgtgacatctgactcttgcctcccagaagactcttgttcagtgtttaaattggctttatcaccaaattaggtatttgcagctggacttggtagggatggaatcacataagaccaagaataggtgtcagagctcggacaaaaataatgacaggaaatggattgtgtaaaggtgccagagttggactactggaacaaagcgagagacattttgtgcagggatggggggagtatttgcaacctggctccaattggatacaggacatcctatctctggcctcatgtgtgtgagtctgttccaactgatggctctaatgagaccacattttgtaattttaacacataaaccttagaagcttgaaggtttagagataaactttcagctgaaacaataatagctcctttggctgccttcctcctttgtaccaggaactttctatctgttatctcatttaagcttcccagcaacactgttgagacagccattgtatcccattttgcagagagggaaactgaatttcagggatgttaagtaacttgtgtaaggcttcacaacttttaagtgcaggcactgggattgcaggccagggatgtcaaactccaaagcccatgaaaactcttctttgctgccttccaaacaagcagtctaaaaggcattctgcagataacccagttcattagaccgattgcagcttttagaacaatttagttgttatcttgcctttattcctattatctctctctctctctcttttttttttttttgagacggagtctcccactgtcacccaggctggggtgcagtggtgcgatctcagctcactgcaagctctgccctattatctcatttttatttaatttatttatttatttattttttattagtgctatactttaagttctagggtacatatgcacaacgtgcaggtttgttacatatgtatacatgtaccatgttggtgtgctgcacccattaactcgtcatttacattaggtatatctcctaatgctaaccctcccccctcccccaccccacgacaggccccagtgtgtgatgttccccatcctgtgtccaagtgttctcattgttcaattcccacctatgagtgagaacatgcagtgttttgttttctgtccttgcgacagtttgctcagaatgatggtttccagcttcatccatgtccctacaaaggacatgaactcgtccttttttatggcttcatactattccatggtgtatatgtgccacattttcttaatccagtctattattgacggacatttgggttggttccaagtctttgctatcgtgaatagtgctgcaataaacatgcatgtgcatgtgtctttatagcagcatgatttataatcctttgggtatatacccagtaatgggatggctgggtcaaatggtatttctagttctagatccctgaggaatcgccacactgtcttccacaatggttgaactagttcacagtcccaccaacagtgtaaaagtgttcctgtttctccacatcctctccagcacctgttgtttcctgacttgttaatgatcaccattctaactggtgtgagatgctatctcattgtggttttgatttgcatttttctgatggccagtgatgatgagcattttttcatgtgtctgttggctgcataaatgtcttcttttgagaagtgtccatatccttcacccactttttgatggggttgtttgattttttcttgtacatttgtttaggttctttgtagattctggatattagccctttgtcagatgggtagattgcaaaaattttctcccattctgtaggttgcctattcactctgatggtagtttcttttgctgtgcagaagctctttagtttaattagatcccatttgtcaatggatcatttgttgccattgcctttggtgttttagacatgaagtccttgcccatgcctatgtcctgaatggcattgcctaggttttcttctagggtttttatggttttaggtctaaaatttaagtctttaatccatcttgaattaatttttgtataaggtgtaaggaagggatccagtttcagctttcctcatatggctagccagttttccgagcaccatttattaaatagggaatcctttccccatttcttgtttttgtcaggtttgtcaaagatcagatgtttgtagatgtgtggtattatttgtgagggctgtgttctgttccattggtctatatctctgttttggtaccagtaccatgctgttttggttactgtagccttgtagtatagtttgaagtcaggtagcgtgatgcctccagctttgttcttttggcttaggattgtcttggcaatgcgggctcttttttggttccatatgaattttaaagtagttttttccaattctgtgaagaaggtcattggtagcttgatggggatggcattgaatctataaattaccttgggcagtatggccattttcaagatattgattcttcctatccatgagcatggaaggttcttccatttctttgtatcctcttttatttcgttgagcagtgctttgtaattctccttgaagaggtccttcacatcccttgtatgttggattcctagtattatctgatttttaaaaatgaaattactaatataacttatggaacaacttatataccagttgctgtgctaagcactttccatactttgtctcatgcatccttcatgacaatcattttacatatatagatactgaggatcagagagatgcagaaacttggccaaggttataaagctaggaagtgacagagtgaaattcaaaccgagggctggctgaatccagagcccatgtctgtgccctacaacacaatgcagtggggaagacaaatgtggtcctcattctaaatgggctcctctctgtcaaccacagctctatttccttctcaccacatggggtaggccatccccatgcacaactcacacttttaagcctatgtgccttaggctactttctcagcctagaatgcttgccctcactcctctacttaacaagatcctattctactctactcagttaaggactgtgtcatatgccccttctcagagaaatttcttggttgctccccgtcccaggtggaataaattgctcttgtctttttgcttccaccttcattagtgtaccctttattttgtctttctgtagagtttagctcattgtttacccgtcttccctactaggttcccaggcacttgagggcaggcaccaaattctattcactctagctccatggtggtttacccccaatgatttagtggatgatcaatacatgtttgtgagcagaccaaaggactgggtgagagatgtccccaatgaacagacaaatgcattcatttgtggctggatcctggggcagtcacacaggctacccatgtggactagactggctcggacagtctggaatcccctgggctcattttactaggctgtaaacataggaggcaggtcagggtacaggtgatatcttctcaaggccaactctaggtccattcggtggtctgtactttgaattcatgtcaaggggccaggctctcctagattatttatgttgcaccttcccattcgtggaagaaagggcttccctgcctcccttaggaacacaaaatgtgttcctacatgcctctttatctgcttctggctgtcctgagagtgtctggaaggagcatgtgctctgtggagacatagtgaggtccagaagcatcttttttttggatatcttttatcgaggccactatattatggattctcaaccactttatctcattttatgttactaatctctgccacaatgttttgaggtgggtcttaatgtcctggttttgtatctgaagaacctgagactgaatgaaatgtcttgcccaaggtcacacaattaagtaagtggcagaggcagtattcagtctcgggtctgtctgccctttccaaagcctggcatcttaatagaaaatactttggagaaacttgatcttcactcccataaaatggaaaggattggatttatacaatggattacatatttaaggtgagatgtttctcaattattgttcacttttggtcccccaaaatgatttacaaaaatggcagaaggagttggggattgaaaagtacaatttctctatcaactactggcctgaatgcccccatgtcaaccccctctgacagatatagtatggagatgactacaaattattttgccctttctgctccttttacagctcaggtgggtaaggctccaagatgtcattgaatttctaaaggtcacacatcaagttaataacaaaactcacttagaatgctggtatctcatactaccccacttgcttcctggcctttctggggttggtacaatagttgggagtccttgcactgccaaatcctagcccagttttctttctgctaaatcatcctgccttatggcatcagtgaacacatgtttataaatggcagggaggaagtggaacattattgcgctctgaggtagaagagggaacaaacatttacctcactacctgtacttatttaggtgcaggtaagatttgggaaagaagacctttggtaggagagctgaggactgttgggggctcctgtggatttagtggcctgggtatctgggaggagtcccctttggctctggagaaatggaagtggggctgccaggggctagaggtgccccagagggatgcaaatagtgggcctcttgagcttttactcctgctcagttctcagctaaagggtaagaggcagagggaccctcccagtgtactggccatgagcgttaaggaagctgaggcttaaggccatcatggaatgcggaggagggggaggtggtgatgggctgagtacaggaggctgagcctccatgtctctccaccaagaggtgagtgtggctccaggggaggggagtggtggtacagtgagactgtgggaaaatggatggagcagggtggtatgaatgagactgtggggatatggatggagtggggtggggtatgaatgagattgtgaggatatggatggagcaggggggatagaatgagactgaggggatatggatagagtggggggtatgaatgagactgtagggatatggatgtagtgggggggatagaatgagattgaggggatatggatggagcaggggggataggatgggattgtggggatatggatggagcagggagaaggggctagggaagagcagagctaatgggagtgattctggaaggagtagcacgccaaggctgattctgggcctggcagccccgggaaggctgcattaggcttcttgcagtgtgtggcttctactcctccatggggacctgatcctggactctgtggtcccccattggcctgctagcttaattagagtcccaaccttcatgccccccatcacatagcccagggttcggtgggaaacctgtgggtctgctgttcctgccaggcttcctgtccctgtcagtgtagatggaagccctccagcctggccatcatgtccctccccctctcccctgtcttcctgccccacacccacacagctctgtgctctttccctgaggttccagctctggctgctgcaccccctgtctcgtcattccagggaccccctctttcctccccggcaaactccctcagatctgctctgagcattcattttttttcgatcccaaagttccttcatatgtcctggcttccaagttgcttctcatactagccatctgcttcctggcctttctggggtaaggagcaatagtttggagtccttgcactgcctattctatctagtacagtggtgctgagctgggaacagttttgcctccctggggacgtttggcaaggtctcaagatatttttgggtcatcatactgggtatgtcaccacaggtgctaccagcacgcactcagccgaagccaggaagcctctgaatatcctccaatgcacaggacagggaccaagaataaaaaattatcctgcccaaaatgtcaatagcactgaatttaagaaaccctgctctattatatagctacaggtctacagggttaggtttggaaattgccaggtgctcatcctttaggcactgaacttccaggagtagctgctctttcccttccccacttgctggagggggactgggcatagccatgaaacagctacaacttgggcaggaatctatggagagaaaagtgaggggagattccccttacccaaatttaataccaacttttagagaaagcgttgcacttcaactgttaaatgcctttctgcctctgcaagatagtgccaggtttttttttttttttttgaaacagaatagcaacttattattctagtagtttatagaatgcacagttttatgtcgtgaaagttgatgcattaagttttggagtcttcccctcctctatttcatgttcttcaagtaatccttctttgaatattggaatatttgctgtgtcagcaaaatactgtagtggtggctctgtccagaaaaaccgattgcctttcttttaatttaaggttaatgaattctgaatttcttaagggtgtgcttatatatcagaaactggctcaaagagttgcttgtttctgtcgacctgagtttcttagggttcatttccaattaagcaatgagaatgcttgccaacggaattaattggtcgctctaatctctttttttccacccttgccagtttcttccacctgcacccagttgtcttcagcatgggggagcagaaccactctcccaggaaggagcttcagcacagaacacaagcagaggctccaggaaagaaaagctggcactcccaggcctatgcccttggggctgtttccaactctatgtctacttttctgacctttcctatctataaggttgtgtttcggcaacagatccatgccatggcagtgtcagaggctgtgagacactttggcacgaaggtcctcaatacttctaccggggaatctaccctcctcttctctccaagatgttgcaagggactcttctgtttgggacttatgatagcctgctgtgctttctctctcctgttgggccacacaccctgggacgccactgggctgcagggatcatgtctggcctggtggaggctgtggcactcagcccctttgaaagggtgcaaaatgtgctccaggatggttgcaagcaagctcgcttacccagcaccttcagcattcttgaggaattcaattcttatgggctttgggggcggctgtcacggggctactaccatggtttctggcctgtcctggccaggaacagcctggggagcactctatatttttctttccaggaccccatgcaggatggcctggcagagcaaggcctggcccattgggttcctgccttggtgtctggtagtgtcaatgaaacaatcacctgcctagttctgtatcctccgattgtgctggctgctaatatgcagtcccatattggatggcagaacatgccaagcctgtgggcctctgcccaggatgtgtggaacacttggggccaaaagcttctcctgatctaccgtggaggctccctggtcatcctaaggtccagtgtgacatggggcctcactacggcaatccatgacttcctgcagaggaagtcacactccaggaaagagctgaagactgactagctgcagaaagtgtggccatgccacctttgttattctgaatcttccctggttggttctatatagcttacttctttggctcggttgcctaatacagccatcttttagcatctgtaaactcattgcatgggagaagttcccaactaccaacctgttgagcaaggacaaagcccaaaagtattccttagtcaaaaagaaacgttcgccccagtctctccacagcttcagtagcctcagagccaggaggcctttaaataacatgtaacccagattaagtgtcattcctttaaggaattccttggcaataaacagaaacttaaaaagataaccttacttaggcactctgagctctgggacccctctaggtgtcctccagaccaaactgagtggaactccaatttcaaagaactgtgcttgactcttaggatgggaattccataaaacttctcagatggctacattttcatgatattgttcactgcctctaccaccacctctcacttctcaaggctgtgggtcctactttcagggtagcagctgtggctggaaatcctaaattaggcttgcatgaactcgtcaggtgccacaagaactagtggggctggagatgggaatgggaagaagtgtgacccatggatggaaatgataaaactttgaaagaagagatttaattacatgcaaaatagaaacatttgctatagtctgcttggtgttatctgttaggacatttctgagagcaaggtgataacattgcccagaaacgatttgagtttccccaagaaacctggaagtgaagtgaccatatctcttcacagataattgcatatttttaaaaattattttattttattttattttattattattatactttaagttttagggtacatgtgcacaatgtgcaggttagttacatatgtatacatgtgccatgctggtgtgctgcaccaattaactcgtcatttagcattaggtatatctcctaatgctatccctaataattgcatattttgttgatgtggtaaatgtagttagtatgacataaagatcagaaatcttagcctgtcattcagagccattcaaaatatgctccttatataactttcaacatattttcactccacttacataaaccccaaacactagccataatgaaccttgttctctccccaaacattccatgaactttcccatggccatactttggcccacactattctttccacctgcagtgctccttcttcacatgccagtctaccaaaatccttccagctcctcgaagcccagctcagaggtcaccttctctttggagcctcttgatttcccccaagtgaatgtgacattagtctctgtgatgcccctttctaacagcacttcatagatggtactgattctgttatgtcactaatctcatgtgaccctgtgttcttgtattcttcaatacctcccactagaccgtaaaacttattgaaagcagggattcttgtatgcattttaaaatcttccattgtgcctaggtgctcaataacattggtcgaattactgaattgattatcaagctctgatgtggtatagcctccggttgctgtcccttgcacatgaagataaagttattgactcactgtcagtaagacacatgccttggagctgtgtttttattttcttttaatagtggatttagttttgtgctaatgataatgatgctgttgataataataataataataataataataataataataaattactttcaactggaacatttgatgggtttgtgttactgatggcatatttgctattagcaccagttcaggaactgaaatttcacaaacagattcacaatatataacagtcccatttgtttcaactctgggattttgaggatttccaagatgacatgtgttatagtttccccctacagatatctcagtaatgccctccacttgcatctccttactgaaccaaatttgtcctgtatttgtcttaccaggttgtagttctagcagtgagaacttctcactgaatgccacagaaattaaagacacagttgttggaggtatgatgtcagacagcatttgtcaccaaggttggcagaaaatggctagtccaggagagttgaaaatgagcttccacatctgcaaatcgggatgtgttggaacagtactcaacttgtggattcaaggaagtatgaacacagagtctgcataaggaaaggaaaaagatgcatttatctcctaattacactggtgatttccacttatgtcactctgtacatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactgtgaattgcatacatcaattttcagtattcctcgattcaatgtttgcaaatccaaattcttttaaaaaagactgtgttttatctctatgacaatggaaccgttattgcagaatattataaaatgaaaagtcacatggtatatgtgatactgtgaaatatatatttgctcttcgatcctgtttcctggcatgcaactcttaaaatccttagaatttccaaagtgatatctttttgtatgctaataattgactgatggctggcagcctctggttgcttcaggatgggaactagtcaccagagagaccaaggcgccattagagggttgggacttaacagcctcattcccgacctccagggaggggagaggggtggaaggttaagtcgatcaccagtggccaatgatttaatcaatcatacctatgtaatggagcttccataaaatccccaaggaactgggtttggttagcttccagatagctgaatatatggaggttcctggagggtggtgacccaaggagggcatggaagctctgagccccttccccagtacctcaccctatgcatctcttcatctctatcctttgcaatatcctttataataaactggtcaacgttaggtatttccctgagttctgtgagcctttctgacaaattaatcaaacccaaagagggggtcatgtgaaccgaaacttgaagcccatctgtcagaagttctggaggactggatttgcgactggtgtctgaagggcctgggaacagtcttgtgagacctagtcctcagcttgtgggatatgacgctatctccaggtagatttgtgtcagaattgaattggagtacacccagctggtgtttgctgcagaactgattgctcacttagtgtgtgggaaaaccccacacatttgaacatggaaatattctttgttgattgccgtgatgtgaaagcaaaggaaaaagtttgtgtgttttcccctcagagcatattttaaagctaagttgctaataattgcttaaatttactatatttgcctttataaaaactttatgtatgtttaaagcttgaagctattcaattataatataaacgtggatttacaactgaagcatgttataatttaaataattgagttttacaaattggttcatataaaatcctaggcaatactgtaaaattatacagacttgtcaactttttccacttaaatcttctgagcaaaatttaagggtgtagtagttttcaagtaatttcaaatgtcaatattaatatttagttttgtgatgtttatgtgggcatattttctgatataaaaaatgacttttaggagttgagatcaataaaataaggaggtaataaatacctacatctgtttaaagacataaaatatacaatttaacactaaagctacttggtat

SEQ ID NO: 3534 - DNA, 47075 bp, human
atagctctgcaggggaacaggatcgctggcgcctcctgggccgctaagcgaccccggggctgcccggcttagcgagtgcttcgcagagaggtagccgagtcgaggcagcgcggttcccaaggaagtcacggctgcggccaccctccagttcggacctccgggcagccgcggttgctttcagtctctgcccattgagacaaaagagcgtgacaagccgcgcgacgcggccaatcagcggggcgaggaggcggcctccccaagcagcctctggccctgaagctactgctagcaagactcgggagctggctggcgggggctgaggccgacaggcacgggagccggcgcggcgtcaagtggagctcggacgcacggaccaggcccatttccctttcatctgtgagtttgctgctaccccgtcgcttcccttctccccatccccttccgcctcggctctgctccgggctttgagaccggatgcctgaaacacgaggtgggacagaaaccaagtgaacaatgagagttccttacctttgtatagggggaaggggggaaacagcatttactgagtgctttctgtgtgcggatgcgcctgtctcctttcttctcagcagccctgtgaaggaggtagtagtgtgcccacttaacaggaaaggactgaaacacccaggcggtacagttaggaagtgcagagctaagagctcactcccaagtcaacatatctgacttcaaaggctaccccttgccaacactcctctattctgttagattaagggatagcggagaaaaaccaaagccaggatgggaggaccaacttgggactgcatagaattagtgagcaagaactgttatctccatttcacagatgaagaaactgagccaaagacagagaggttaagcgtcttgcactgtatcccgcagcaaagaagttacagcatccaacttagcacctgtatgttgctctctagatgctaattgtttgccctgcagcattgtctgaagagcacttttgcacaggtagtctcaaaccatctcaacagcagtctcaatgtgatgatagtgctgagggagggggtgaggaggtagtagggagagggctgagggaagatgaaggcaacctttatggtgcccattgtacagaagaggaaactcttcttggcactcttctttccttcgtttttttaaaaatacttttttttatactacaaaaagctgccctttttataaaagcaacataatttcgacagccctttgtgacgccaagggaggcaaggctcagagaggtaaaatgatttgtctgaaattacaaggtgaagccaaaatttggaccgaatctctgaatccagaactcatactattaactaaagtgagtaaaaagtgggctgcctcagaatcattttggagagcttgttataaatgcagattcctgggccttacccctgggggattttgatgtactaggactacaggtaaagagtgtgatttgtagttttaaacagccccatagttgattctgaggtgtagagagattcgtgaaccactgttctaaacaccaccacgtgatgctgaaggttataagtaaatgggcctgtcatcagtgtatttgtccatggcatatctgttatgaaatgtaactccagagcacaggttcctacccgcggtccttcctggaactgtatgcaaagaatctggactccgtacattcttctgagtccacagctttgcagattttcaaatgggtctgtcataatgtcttccttcttcaagccatgcttgatgaagaagtgtgagaaatcaaaccccatttaacctaacccccaaaccacagctctctgttgctgatatggctctttcatttcctggctcaaggacaggttgctaggttgcccttctgtgagctcttcaggggacttctcctttgctggatttggcatcactggccccagagaaggagcaactccatggaaacagcatgcagggctgtccaaagtgaatggccatgaaggcagtggctggaaaacctgctccatttttccctgacttagagagcaggtattacttcctttatgtatagtgtggctaggaggctcctgtggggcctgttcttgactcctgatgcttggaagcaagtgaacagtctgaagcccttccactgccgttggcttcatcttcagcctgccaaggcacttcactcactcatttccaccctcttatttacaaccccaagatgtagagttccttggagtaaacaatacagatttggagatgaagcactttccatctcaggattgtggcctgtggatggaacagtggggtagtggtggtggaaggtggaaagtgtggatgtatggagaaggcaggttgctcacctcgcacacttaggggtgatggtggcagtagctcttaggtttccttcagacttttgcttctgctcccctgtcccgtgacatctgactcttgcctcccagaagactcttgttcagtgtttaaattggctttatcaccaaattaggtatttgcagctggacttggtagggatggaatcacataagaccaagaataggtgtcagagctcggacaaaaataatgacaggaaatggattgtgtaaaggtgccagagttggactactggaacaaagcgagagacattttgtgcagggatggggggagtatttgcaacctggctccaattggatacaggacatcctatctctggcctcatgtgtgtgagtctgttccaactgatggctctaatgagaccacattttgtaattttaacacataaaccttagaagcttgaaggtttagagataaactttcagctgaaacaataatagctcctttggctgccttcctcctttgtaccaggaactttctatctgttatctcatttaagcttcccagcaacactgttgagacagccattgtatcccattttgcagagagggaaactgaatttcagggatgttaagtaacttgtgtaaggcttcacaacttttaagtgcaggcactgggattgcaggccagggatgtcaaactccaaagcccatgaaaactcttctttgctgccttccaaacaagcagtctaaaaggcattctgcagataacccagttcattagaccgattgcagcttttagaacaatttagttgttatcttgcctttattcctattatctctctctctctctcttttttttttttttgagacggagtctcccactgtcacccaggctggggtgcagtggtgcgatctcagctcactgcaagctctgccctattatctcatttttatttaatttatttatttatttattttttattagtgctatactttaagttctagggtacatatgcacaacgtgcaggtttgttacatatgtatacatgtaccatgttggtgtgctgcacccattaactcgtcatttacattaggtatatctcctaatgctaaccctcccccctcccccaccccacgacaggccccagtgtgtgatgttccccatcctgtgtccaagtgttctcattgttcaattcccacctatgagtgagaacatgcagtgttttgttttctgtccttgcgacagtttgctcagaatgatggtttccagcttcatccatgtccctacaaaggacatgaactcgtccttttttatggcttcatactattccatggtgtatatgtgccacattttcttaatccagtctattattgacggacatttgggttggttccaagtctttgctatcgtgaatagtgctgcaataaacatgcatgtgcatgtgtctttatagcagcatgatttataatcctttgggtatatacccagtaatgggatggctgggtcaaatggtatttctagttctagatccctgaggaatcgccacactgtcttccacaatggttgaactagttcacagtcccaccaacagtgtaaaagtgttcctgtttctccacatcctctccagcacctgttgtttcctgacttgttaatgatcaccattctaactggtgtgagatgctatctcattgtggttttgatttgcatttttctgatggccagtgatgatgagcattttttcatgtgtctgttggctgcataaatgtcttcttttgagaagtgtccatatccttcacccactttttgatggggttgtttgattttttcttgtacatttgtttaggttctttgtagattctggatattagccctttgtcagatgggtagattgcaaaaattttctcccattctgtaggttgcctattcactctgatggtagtttcttttgctgtgcagaagctctttagtttaattagatcccatttgtcaatggatcatttgttgccattgcctttggtgttttagacatgaagtccttgcccatgcctatgtcctgaatggcattgcctaggttttcttctagggtttttatggttttaggtctaaaatttaagtctttaatccatcttgaattaatttttgtataaggtgtaaggaagggatccagtttcagctttcctcatatggctagccagttttccgagcaccatttattaaatagggaatcctttccccatttcttgtttttgtcaggtttgtcaaagatcagatgtttgtagatgtgtggtattatttgtgagggctgtgttctgttccattggtctatatctctgttttggtaccagtaccatgctgttttggttactgtagccttgtagtatagtttgaagtcaggtagcgtgatgcctccagctttgttcttttggcttaggattgtcttggcaatgcgggctcttttttggttccatatgaattttaaagtagttttttccaattctgtgaagaaggtcattggtagcttgatggggatggcattgaatctataaattaccttgggcagtatggccattttcaagatattgattcttcctatccatgagcatggaaggttcttccatttctttgtatcctcttttatttcgttgagcagtgctttgtaattctccttgaagaggtccttcacatcccttgtatgttggattcctagtattatctgatttttaaaaatgaaattactaatataacttatggaacaacttatataccagttgctgtgctaagcactttccatactttgtctcatgcatccttcatgacaatcattttacatatatagatactgaggatcagagagatgcagaaacttggccaaggttataaagctaggaagtgacagagtgaaattcaaaccgagggctggctgaatccagagcccatgtctgtgccctacaacacaatgcagtggggaagacaaatgtggtcctcattctaaatgggctcctctctgtcaaccacagctctatttccttctcaccacatggggtaggccatccccatgcacaactcacacttttaagcctatgtgccttaggctactttctcagcctagaatgcttgccctcactcctctacttaacaagatcctattctactctactcagttaaggactgtgtcatatgccccttctcagagaaatttcttggttgctccccgtcccaggtggaataaattgctcttgtctttttgcttccaccttcattagtgtaccctttattttgtctttctgtagagtttagctcattgtttacccgtcttccctactaggttcccaggcacttgagggcaggcaccaaattctattcactctagctccatggtggtttacccccaatgatttagtggatgatcaatacatgtttgtgagcagaccaaaggactgggtgagagatgtccccaatgaacagacaaatgcattcatttgtggctggatcctggggcagtcacacaggctacccatgtggactagactggctcggacagtctggaatcccctgggctcattttactaggctgtaaacataggaggcaggtcagggtacaggtgatatcttctcaaggccaactctaggtccattcggtggtctgtactttgaattcatgtcaaggggccaggctctcctagattatttatgttgcaccttcccattcgtggaagaaagggcttccctgcctcccttaggaacacaaaatgtgttcctacatgcctctttatctgcttctggctgtcctgagagtgtctggaaggagcatgtgctctgtggagacatagtgaggtccagaagcatcttttttttggatatcttttatcgaggccactatattatggattctcaaccactttatctcattttatgttactaatctctgccacaatgttttgaggtgggtcttaatgtcctggttttgtatctgaagaacctgagactgaatgaaatgtcttgcccaaggtcacacaattaagtaagtggcagaggcagtattcagtctcgggtctgtctgccctttccaaagcctggcatcttaatagaaaatactttggagaaacttgatcttcactcccataaaatggaaaggattggatttatacaatggattacatatttaaggtgagatgtttctcaattattgttcacttttggtcccccaaaatgatttacaaaaatggcagaaggagttggggattgaaaagtacaatttctctatcaactactggcctgaatgcccccatgtcaaccccctctgacagatatagtatggagatgactacaaattattttgccctttctgctccttttacagctcaggtgggtaaggctccaagatgtcattgaatttctaaaggtcacacatcaagttaataacaaaactcacttagaatgctggtatctcatactaccccacttgcttcctggcctttctggggttggtacaatagttgggagtccttgcactgccaaatcctagcccagttttctttctgctaaatcatcctgccttatggcatcagtgaacacatgtttataaatggcagggaggaagtggaacattattgcgctctgaggtagaagagggaacaaacatttacctcactacctgtacttatttaggtgcaggtaagatttgggaaagaagacctttggtaggagagctgaggactgttgggggctcctgtggatttagtggcctgggtatctgggaggagtcccctttggctctggagaaatggaagtggggctgccaggggctagaggtgccccagagggatgcaaatagtgggcctcttgagcttttactcctgctcagttctcagctaaagggtaagaggcagagggaccctcccagtgtactggccatgagcgttaaggaagctgaggcttaaggccatcatggaatgcggaggagggggaggtggtgatgggctgagtacaggaggctgagcctccatgtctctccaccaagaggtgagtgtggctccaggggaggggagtggtggtacagtgagactgtgggaaaatggatggagcagggtggtatgaatgagactgtggggatatggatggagtggggtggggtatgaatgagattgtgaggatatggatggagcaggggggatagaatgagactgaggggatatggatagagtggggggtatgaatgagactgtagggatatggatgtagtgggggggatagaatgagattgaggggatatggatggagcaggggggataggatgggattgtggggatatggatggagcagggagaaggggctagggaagagcagagctaatgggagtgattctggaaggagtagcacgccaaggctgattctgggcctggcagccccgggaaggctgcattaggcttcttgcagtgtgtggcttctactcctccatggggacctgatcctggactctgtggtcccccattggcctgctagcttaattagagtcccaaccttcatgccccccatcacatagcccagggttcggtgggaaacctgtgggtctgctgttcctgccaggcttcctgtccctgtcagtgtagatggaagccctccagcctggccatcatgtccctccccctctcccctgtcttcctgccccacacccacacagctctgtgctctttccctgaggttccagctctggctgctgcaccccctgtctcgtcattccagggaccccctctttcctccccggcaaactccctcagatctgctctgagcattcattttttttcgatcccaaagttccttcatatgtcctggcttccaagttgcttctcatactagccatctgcttcctggcctttctggggtaaggagcaatagtttggagtccttgcactgcctattctatctagtacagtggtgctgagctgggaacagttttgcctccctggggacgtttggcaaggtctcaagatatttttgggtcatcatactgggtatgtcaccacaggtgctaccagcacgcactcagccgaagccaggaagcctctgaatatcctccaatgcacaggacagggaccaagaataaaaaattatcctgcccaaaatgtcaatagcactgaatttaagaaaccctgctctattatatagctacaggtctacagggttaggtttggaaattgccaggtgctcatcctttaggcactgaacttccaggagtagctgctctttcccttccccacttgctggagggggactgggcatagccatgaaacagctacaacttgggcaggaatctatggagagaaaagtgaggggagattccccttacccaaatttaataccaacttttagagaaagcgttgcacttcaactgttaaatgcctttctgcctctgcaagatagtgccaggtttttttttttttttttgaaacagaatagcaacttattattctagtagtttatagaatgcacagttttatgtcgtgaaagttgatgcattaagttttggagtcttcccctcctctatttcatgttcttcaagtaatccttctttgaatattggaatatttgctgtgtcagcaaaatactgtagtggtggctctgtccagaaaaaccgattgcctttcttttaatttaaggttaatgaattctgaatttcttaagggtgtgcttatatatcagaaactggctcaaagagttgcttgtttctgtcgacctgagtttcttagggttcatttccaattaagcaatgagaatgcttgccaacggaattaattggtcgctctaatctctttttttccacccttgccagtttcttccacctgcacccagttgtcttcagcatgggggagcagaaccactctcccaggaaggagcttcagcacagaacacaagcagaggctccaggaaagaaaagctggcactcccaggcctatgcccttggggctgtttccaactctatgtctacttttctgacctttcctatctataaggttgtgtttcggcaacagatccatgccatggcagtgtcagaggctgtgagacactttggcacgaaggtcctcaatacttctaccggggaatctaccctcctcttctctccaagatgttgcaagggactcttctgtttgggacttatgatagcctgctgtgctttctctctcctgttgggccacacaccctgggacgccactgggctgcagggatcatgtctggcctggtggaggctgtggcactcagcccctttgaaagggtgcaaaatgtgctccaggatggttgcaagcaagctcgcttacccagcaccttcagcattcttgaggaattcaattcttatgggctttgggggcggctgtcacggggctactaccatggtttctggcctgtcctggccaggaacagcctggggagcactctatatttttctttccaggaccccatgcaggatggcctggcagagcaaggcctggcccattgggttcctgccttggtgtctggtagtgtcaatgaaacaatcacctgcctagttctgtatcctccgattgtgctggctgctaatatgcagtcccatattggatggcagaacatgccaagcctgtgggcctctgcccaggatgtgtggaacacttggggccaaaagcttctcctgatctaccgtggaggctccctggtcatcctaaggtccagtgtgacatggggcctcactacggcaatccatgacttcctgcagaggaagtcacactccaggaaagagctgaagactgactagctgcagaaagtgtggccatgccacctttgttattctgaatcttccctggttggttctatatagcttacttctttggctcggttgcctaatacagccatcttttagcatctgtaaactcattgcatgggagaagttcccaactaccaacctgttgagcaaggacaaagcccaaaagtattccttagtcaaaaagaaacgttcgccccagtctctccacagcttcagtagcctcagagccaggaggcctttaaataacatgtaacccagattaagtgtcattcctttaaggaattccttggcaataaacagaaacttaaaaagataaccttacttaggcactctgagctctgggacccctctaggtgtcctccagaccaaactgagtggaactccaatttcaaagaactgtgcttgactcttaggatgggaattccataaaacttctcagatggctacattttcatgatattgttcactgcctctaccaccacctctcacttctcaaggctgtgggtcctactttcagggtagcagctgtggctggaaatcctaaattaggcttgcatgaactcgtcaggtgccacaagaactagtggggctggagatgggaatgggaagaagtgtgacccatggatggaaatgataaaactttgaaagaagagatttaattacatgcaaaatagaaacatttgctatagtctgcttggtgttatctgttaggacatttctgagagcaaggtgataacattgcccagaaacgatttgagtttccccaagaaacctggaagtgaagtgaccatatctcttcacagataattgcatatttttaaaaattattttattttattttattttattattattatactttaagttttagggtacatgtgcacaatgtgcaggttagttacatatgtatacatgtgccatgctggtgtgctgcaccaattaactcgtcatttagcattaggtatatctcctaatgctatccctaataattgcatattttgttgatgtggtaaatgtagttagtatgacataaagatcagaaatcttagcctgtcattcagagccattcaaaatatgctccttatataactttcaacatattttcactccacttacataaaccccaaacactagccataatgaaccttgttctctccccaaacattccatgaactttcccatggccatactttggcccacactattctttccacctgcagtgctccttcttcacatgccagtctaccaaaatccttccagctcctcgaagcccagctcagaggtcaccttctctttggagcctcttgatttcccccaagtgaatgtgacattagtctctgtgatgcccctttctaacagcacttcatagatggtactgattctgttatgtcactaatctcatgtgaccctgtgttcttgtattcttcaatacctcccactagaccgtaaaacttattgaaagcagggattcttgtatgcattttaaaatcttccattgtgcctaggtgctcaataacattggtcgaattactgaattgattatcaagctctgatgtggtatagcctccggttgctgtcccttgcacatgaagataaagttattgactcactgtcagtaagacacatgccttggagctgtgtttttattttcttttaatagtggatttagttttgtgctaatgataatgatgctgttgataataataataataataataataataataataataaattactttcaactggaacatttgatgggtttgtgttactgatggcatatttgctattagcaccagttcaggaactgaaatttcacaaacagattcacaatatataacagtcccatttgtttcaactctgggattttgaggatttccaagatgacatgtgttatagtttccccctacagatatctcagtaatgccctccacttgcatctccttactgaaccaaatttgtcctgtatttgtcttaccaggttgtagttctagcagtgagaacttctcactgaatgccacagaaattaaagacacagttgttggaggtatgatgtcagacagcatttgtcaccaaggttggcagaaaatggctagtccaggagagttgaaaatgagcttccacatctgcaaatcgggatgtgttggaacagtactcaacttgtggattcaaggaagtatgaacacagagtctgcataaggaaaggaaaaagatgcatttatctcctaattacactggtgatttccacttatgtcactctgtacatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactgtgaattgcatacatcaattttcagtattcctcgattcaatgtttgcaaatccaaattcttttaaaaaagactgtgttttatctctatgacaatggaaccgttattgcagaatattataaaatgaaaagtcacatggtatatgtgatactgtgaaatatatatttgctcttcgatcctgtttcctggcatgcaactcttaaaatccttagaatttccaaagtgatatctttttgtatgctaataattgactgatggctggcagcctctggttgcttcaggatgggaactagtcaccagagagaccaaggcgccattagagggttgggacttaacagcctcattcccgacctccagggaggggagaggggtggaaggttaagtcgatcaccagtggccaatgatttaatcaatcatacctatgtaatggagcttccataaaatccccaaggaactgggtttggttagcttccagatagctgaatatatggaggttcctggagggtggtgacccaaggagggcatggaagctctgagccccttccccagtacctcaccctatgcatctcttcatctctatcctttgcaatatcctttataataaactggtcaacgttaggtatttccctgagttctgtgagcctttctgacaaattaatcaaacccaaagagggggtcatgtgaaccgaaacttgaagcccatctgtcagaagttctggaggactggatttgcgactggtgtctgaagggcctgggaacagtcttgtgagacctagtcctcagcttgtgggatatgacgctatctccaggtagatttgtgtcagaattgaattggagtacacccagctggtgtttgctgcagaactgattgctcacttagtgtgtgggaaaaccccacacatttgaacatggaaatattctttgttgattgccgtgatgtgaaagcaaaggaaaaagtttgtgtgttttcccctcagagcatattttaaagctaagttgctaataattgcttaaatttactatatttgcctttataaaaactttatgtatgtttaaagcttgaagctattcaattataatataaacgtggatttacaactgaagcatgttataatttaaataattgagttttacaaattggttcatataaaatcctaggcaatactgtaaaattatacagacttgtcaactttttccacttaaatcttctgagcaaaatttaagggtgtagtagttttcaagtaatttcaaatgtcaatattaatatttagttttgtgatgtttatgtgggcatattttctgatataaaaaatgacttttaggagttgagatcaataaaataaggaggtaataaatacctacatctgtttaaagacataaaatatacaatttaacactaaagctacttggtataaaaagtcaaaagaaaaagaataaaaagccatcacaaaacacaatatatgcatgatatatatttttgtctaaatataagctacatcagcttttctagagctcaagttgaaataataaataactaatgttttatgacaaatcattatatggtttatttagacaattttgcttttacaacttatttttaaacattaaatagcattataattttactgggataatgacatatagtgtagtacattaaagttatatataaaataatgttgcatatgagagaaaaagcataataaatcagaaactataaaaagctttcataaaataataggataaaaatactgtatttctctagtctgttcactctccaatgtctctggttctttcatatcatctttcttccctcaaatcttttaatataccctccctcatcatttccaactagtgaccttgctttctatttctttaagaaaagagatacgctcagacgagaattgccagtttaaagaacatttttaaagctatcacccatgtaataactagcccgggcaagaaatagagccctttaataacctactcctctccccccgccaatgatgatatcccttcttccatcttagggttagcccccatgctgacttttgtgataatcatttctttgcttttgtttataggttttcttccttataagcatccctaaccaacagttttgttttacagatgtttgaacattatatactttataaacttggaattgtgactatcttgtttcactccacattgcttgtgatactcatcgatattgcagatagctgtagttgatccatttttattgttgtacagtttaccattgtaccataatttattcatgataagtttgagggtcattctggttgtttgcagggttttcttttctttctttttctctcttttttttttttttacaattcattcgttttattgatgcataataattgtatatgtttctggggtacatttgatattttgatacatgcgtacaatatgtaatggtcaaatcaaggtaattgggatatccatcagctcaaatttatcatttctttgtgtgggaaacattccaaatctcttctagctattttgaaatacacaataaattgaatactatggtcactctgttgtgctattgaacgcagaacttattccttctctctaactctatttttgcacccattaaccaatctctcttcattcgcccctctgcaggacccttcccagcctctgttaaccacagttctactctccaccaccttgagatcaacttttttagctctcccatatgagtgaggacatgtgatatttgcctttctgtgcctggattatttcacttcacatttcacttcacataatgtcctctgagcacatctatgttgccagaaatgacaggattgcattagttttttttttttattattgtactttaagttctgggatacatgtgcagaacctgcaggtttgtaacgtaggtgtacatgtgccatagtggtttgctgcacacatcaatccgtcatctacattaggtatttctcctaatgctatccctccccttgccccccgctcccagacaggccccagtgtgtgatgttcccctccctgtgcccatatgttctcattgttcaactcccacttatgagtgagagcgtgcagtgtttggttttctgttcctgtattagtttgctgagaatgatggtttccagcttcatccatgtccctgcaaaagacattaactcattcttttttatggctgcatattattccatggtgtatatatgccacattttctttatccagtctgtcattgatgggtatttgggttggttccgagtctttgctattgtgaatagtgctgcagtaaacatacgtgtgcatgtgtctttgaagtagaatgatgtataatcctttgggtatatacccagtaatgagattgctgagtcaaatggtatttctagttctagatccttgaggaatcaccatactttcttccacaatggttgaactaatttatacacccaccaacagtgtaaaagcattcctatttctccacatcctgtccagcatctgttgtttcttgactttttaatgttcgccactctaactggcgtgagatggtgtctcattgtggttttgatttgcatttctctaatgaccaacgatgatgagcttttttgtgtgtgtgtttgttggccgcataaatgtcttcttttgaaaagtgtctgttcatatcctgtgcccactttttgatggggtttttgtttttttcttatacatttgtttaagttccttgtagattctggatattagccctttgtcaaatggatagatgtcaaaaatttccccccattctgtaggttgcctgttctcttggatgagagtttcttttgctgtgcggaagctctttagttagttagatcccatttgtcaattttggcttttgttttaattgctttttgcattttagtcatgaagtcattgcccatgcctatgtcctgagtggtattgcctaggttttcttctagggtttttatggttttaggtcttacgtttaaatctttaatccaattcgagttaatttttgtataaggtgtaaggaaagggtccagtttcagttttctgcatatggctagcctgttttcccaacaccatttattaaatagggaatcctttccccattgcttttgtcagatttgtcaaagatcagatggttgtaggtgtgtggtgttatttctgaggcctctgctctgttccattggtctatatatctgttttggtaccagtaccatgctgttttggttactgtggcctcgtagtatattttgaagtcagatagcatgccttcagctttgttctttttgcttaggattgtcttggcaatgcgggctcttttttggttacataggagttgttttttttttttttttttttgagacggagtttcactcttgttgcccaggctggactgcaatggcgtgatctcagctcaccacgacctctgcctcccaggttcaagttattctcctgcctcagcgtcccaagaagctgggattacaggcatgcaccaccttgcccagctaattttgtatttttagtagagatggggtttctccatattggtcaggctggtctcgaactccccacctcaggtaatccacctgcctcggcctcccaaagtgctgggattacaggcatgagtcaccgcgcccagcttccatatgaaatttaaagtagttgttttctaattctgtgaagaaagtcaatggtagcttgaagggaatagcattgaacctataaactactttgggcagtatggccattttcatgatattgactcttcctatccatgagcatggaatgtttttccatttgtttgtgtcctctcttatttccttgagcagtggtttgtagttctccttgaagaggtccttcacatcccttgtaagttgtattcctaggtattttattatctttgtagcaattgtgaatgggagtttgctcatgatttggctctctgtctattatttgtgtgtaggaatgcttatgatttttgcacattgattttgtatcctgagactttgctgaagttgcttatcagcttaaggagtttatgggctgagaccatggggtttctaaatataccatcatgtcatctgcaaacagagagaatttgacttcctctcttcctatttgaatacgctttattggtttctcttgcctgattgtcctggccagaacttccaatactgtgttgaataggagtggtgagagagggcatccttgtcttgagccggttttcaaagggaacacttccagcttttgcccattcagtatgatattgactgtgggtttgtcataaatagctcttattatcttgagatatgttccatcaattccttgtttattgagtgtttttagcattaatgggtgttgaattttatcaaaggccgtttctgcatctattgacataatcatatggtttttgtcattggttctgtttatgtgatggttctgtttatgtgatggttctgtttacgtttattgatttgcgtgtgttgaaccagccttgcatcccagggatgaagctgacttgattgtagtggataagctttttgatgtgttgctggattcggtttgccagtattttattgaggattttcacattgatgttcactagggatattggcctgaaattttctttttttgttgtgtctctgacaggtttttgtatcaggatgatgctggcctcataaaatgagttagggaggagtccatctgtttctattgtttggaatagtttcagaaggaatggtataagctcctctttgtacctctggtagaattcggctgtgaatccatctggtcctgggcttttaggttggtaggctattaattactgcctcaatttcagaacttgttattggtctattcagggattcgagttcttcctggtttagacttgggagggtgtatgtgtccaggaatttatccatttcttatagattttctagtttatttgcatagaggtatttatagtattctctgatggtagtttgtatttctgtgggatcagtggtgatctcccctttgccattttttattgtgtctatttgattcttctctcttctcttctttattagtctggctagaggtctatctattttattaatcttttcaaaaaatcagctcctggattcattgattttttgaagggtttttttgtgtctctatctccttcagttctgctctgatcttagttatttcttgtcttctgctagcttttgaatttgtttgctcttgcttctctagttcttttaattatgatgttagggtgtcgattttagatctttcctgctgtctcctgtgggcatttagtgctataaagttccctctacgcattgctttagctgtgtcctagagattctggtacgttttgtctttgttctcattggtttcaaagaacttatttatgtctgccttaatttcattatttacccagtagtcattcaggagcaggttgttcagtttccatgtagttgtgcggttttgagtgagtttcttattcttgagttctaatttgattgcactgtggtctgagagacggtttatgatttctgttcttttgcatttgctgaggagtgttttacttccaattatgtggtcaattttagaataagtgctatgtggtgctgagaagaatgtatattctgttgatttgggtggaattctgtagatgtctattaggtccactaggtccagaactgagttcaagttttgaacattcttgttaattttctgtctcgttgatctgtctaatattgaaagtgggttgttaaagtctcccactattattgtgtgggagtctaagtgtctttgtaggtctctaagaacttgttttaccgggtgctcctgtattcgttgcatatatatttaagatagttagcccttcttgttgcattgatccctttaccattatgtaattcccttctttgtcttttttgatctttgttggtttaaagtctgttttatcagagactaggattgcaacccctgcttatttttgctttccatttgcttgatcttcatccatccctttattttgagcctatgtgtgtctttgcatgtgagatgggtctcctgaatacagcgcactgatgggtcttggctctttatccaatttgccagtctatgccttttaattggggcatttagcccatttacatttaaggttaatattgttatgtgtgaatttgatcctgtcattaggatgctagctggttattctgcccattacttaatgcagtttctcatagtgtcgatggtctttacattttggtttgtttttgcagtggctggtaccagttttttctttctgtatttagttcttccttcaggaggtgttgtaaggcaggcctgatggtgacaaaattccttagcatttgcttgtctataaaggattttatttctcctttgcttatgaagcttaatttggctggatatgaaattctggtttgaaaattattttctttaagaatgttgaatattggccctcactctcttctggcttgaagggtttatgctgagagatttgttgttagtctaatgggcttccctttgtgggtaacttgacctttctctctggcttcccttaacattttttccttcatttcaaccttggtgaatctgacaattatgtgtcttgggattgttcttctcgaggagtatctttgtggtgttctttctatttcctgaatttgaatgttggcctatcttgctatgttggggaagttctcctggatattatcgtgaagtgtgttttccaacttggttccactctccccatcactttcaggtccaccgatcaaacataggtttgttcttttcacatagtcccatatttcttggaggcttttttttgttcctttcattcttttttctctaatctcatcttcatgcttcatttcattaagctgttcttcaatctctgatatcctttcttccgcttgatcgatttgactattgatacttgtatataattcatgaagttctcatgctgtgtttttaagctccatcaggtcatttatgctcttctctaaagtggtttattctagttggcaattcctcaaccttttatcaaggttcttagcttccttggattgggttagaacatgctcctttagcttggaggaatctgttattaccgaccttctgaagcctacttctgtcaattcgtcaaactcattctccatccagttttgttcccttgctggggagaagttgtaatcctttggaggagaagaggcattctggtttttggactttttagcctttttgcgttgttttttcctcatcttcgtgggtttatctacctttcgtctttgctgttggtgaccttcgaattgagtttttgcgtgttcgtcctttttgttgctgttgatggtattgctttctgtttgttggttttccttctatcaggccactcttctacaggtctgctgcagtttgctgggggtccactccagaccccgttcatctgggtatcactagtggaggctgtagaaccacaaagattgcttcctgctccttcctctggaagctttgtcccagaggggcaccagccagatgccagctggagctgtcctgtatgaggtgtctgtcgacccctgctgggaggtgtctccatgtcaggaggcacgagtgtcagggacccacatgaggaggcaatctgtcccttagcagagctagagcactgtgctgggagatccactgctctcttcagatccagcaggcaggaatgttaaagtctgctgaaactgcgcccacagccgccccttctcccaggtgctctgtcccaaggagatgggggttttatctataagtccctgactggggctgctgcctttctttcagagatgccctgcccagagaggaggaatctagagaggcaatctggctacagtggctttgtggcactgcagtgggctccgcccagttagaacttcccagaggctttgtttacactgtgaggggaaaacccgtctactcaagcctcagtaatggcagatcccctctccccccaccaagatcgagcatctcaggtcaacttcagactttcgtgctggcagcaagaacttcaagccagtggatgttagcttgctgggctccatgaggctgggatccgctgagcaagaccacttggccccctggcttcagtcccctttccagaagaatgaatggttctgtctcactggtgttccaggcttcactggggtatgaaaaacaacaacaacaacaacaacagcaacaacaacaacaacagcaacaaaaacccaaaactcctacggctagcttggtgtctgcccaaacagccgcccagatttgtgcttgaaacccagggcccgtgtggtgtaggcacctgaaggaatttcctggtctttgggttgcaaagaccttgggaaaagcttagtatctgggccagatagcacagtccctcatggcacagtccttcacggcttcccttggctaggggaggtagttcccccaccccttgagcttcctgggtgaggcgacaccccaccctgcttctgctcgccctccgtgggctgcacccactgtctaaccagtcccaatgagatgaacctggcacctcagttggaaatgcagaaatcacccaccttctgcattggtcttgctgagagctgcacactggagctgttcctattcagccatcttgcccaggagtctcgcattcctttgttatagctcaatgctattaaaatgtgtacatatacaacattttctttatccatttattgattgatggacacttaggttgattccataacttggatcttgtgaatagtgctgcaataaacataggagtgcagacatctcttcaatatacggtttaaaacattttttttttggaaacatacacagcagcaagattgctgaatcataatgacagtgctatttttagttttttgaagaacacccataccgttttccataatgtctgtaccaacttacattctcactaacagtgtatgagtgttcccctttctccacatccttgccatcatctgtcatttttttgtctttttgataatggtcattttaactggggtgagatgaaatccaatttttgactgttacaaaacagtgctaccatgatttttcttggtaatgtacataaacacagatatctctaggggatttatgtagaatttctggtttatggaatatgagcaccttcaatttaattggatgatgcctaacttttcctaatggcatgtaccagttcacacccttactagccaggtttaacagttcccatttctccacctgctggccaacacttggtattatcagacttcttaatttttgcctatctaatgggtgtaaatggcatcttataatttgattttcctgattactaataatgttgagcatcttttcacatgcctattgaacgttagtatttcctcttttgtgaagcatttattcaagacatttgccattttttcctgttgagttgtgtaactttttcaaattaatttgtagaagctgttttaattttagttctttctcctttatatgtgttccatatatctctccccactttgtcacttatttttccattttaatgatttcttttgataaacataaattctaattataagatagataccgaagttatcaatccttttttatggtaagtgctttttgtgtcttttcaatgaaatcgttctataccccaatatcatgaagatattcctttatactataataacatttaaaatttttatggttttgactttcacatctatgtttttaatatacttggaattgattttcatgtagaatatgagaatagaggtccaatgttttctttatgaatatccaattgccccaatatcatttgctgaaaagccttttcttctcccattcagttacaatgccaactctgtcaaatatcaagtgttcatatatttttgggaagatttctgacctgtctgttctattctaccagtttatttatctaatcatgtgccaatacagcattgccttattacctgtaacagtaatactaataaatgtcttgatatctgataggggaagtcttcccacctcattcttattcctcaagagtttcttaactattcttatcaatatgcacagaaatagatgctgaaattttcttttcacaaaattactgttgagattttaatttcagcaaaacttaactgttgagttttagtgtaaacaaaaataatggttgaaattctaattttaaatttctccaagtttcataatattcttcatagtgttcaacatatctttttttgggatttttatttgttgcttaatttttaaacaattactaatagtaaagcagattatcataaatgggattataatgagtttcttacatataatgtcctattttaaaagaaaaacatatatctcttaagaaatcagtttatatgtgttgatgcctcatgttgacatattcagtataacatatgtggattaatataatatactatgttattatctataaagatgctactaattcattaggttttcagaaagtaaacagcaaaccttaaaaaatttattatgataatggagatggagtacaaatgggacaactctgagatagagtacatgaaagctcaagacacctgtatccaactgcctacttgatgttttcactgacatataggcattccaaacttaatatgtcaaagattaaactatttattctccttaccaatctgtccctagtctttccacttccaatggtatcatcattttctggtactttcaacacaaaggatactatcatatagggaacgtgactctctcactcattactctatttccagtgcccagattgtcatgcacatagtaagtgctcaatagatatttgtagaatgaatggatgaattggccctgccctccaaacatgttcgattaaaaatcattcaagaatatacacaaagtagtatatgaaaaaatgacagacttctgtcctttcttttcaattattagacccacagccttagttcagtctttcctgattttatacctgaagaactgccacaactctttttattggctcttcttgtcaccttccaatgttaatagcttacaagataaaatccaaaccacttggcgtgacattcaaggtcctccataatctgacaccagcctacctttttcacctctttttcctctacttaaatattatgaatctcgatgtcccaactacacaagactactggatgtttcccaaatgtgccctacatttctctttgttcttcttttctcctcttcctggaattccattgcccccatttcttccttcaacaaatgctatccatttttaaaggcccaattcaaatgtcatttcctctatgcaggcttcttggactctctcagatagaattaggcttccctcttttccactttcccctggtacttatcaaccttgatgtaacatttaaaatcatagatgtctcagaattataatattagatttagaagtggtcttgttgatcatgtgatccgacttcttcatgttatcgagggcaagagctagaagaatccaggtcttttaatttgccttgacttgtgattatgtatgtatgtattttttatcctctacctgacatcactgggcagaaatagggtgttattcatctttgtgttcttattcatgatacttaataaaatctattgcacatagtggatatacaataagtatgtttcaattgacttaagatcagagggatggataaaatagaggtaccattcatagtattgtactctgtaccagggtactatgccaaagttttacaagaattacctgattgatcaaacaatcctatgagataagcaccatttgtagctttatttgcccaagacttcatagccagtaagttgtagaatctggacaaaaataaaattcctgtggctccagattctttgttcttagtcattgtgctatagtgcaaaacaacaaggtgggaactcaaacattttgggtttagaatacgactgatggatgaatttggcatgaaagactaacttttatttcctggaggacatagtagctgggtttgggaagatagtttgggacaatattgtagaaggctctgaatgccaagcatggtatgagaagttacctcccttccctagctctccatctgcaccagtctagatcaccgtatgaggcgcaactcaaacagtacttattgtttgaagacttccagaatcttccaagtcacaatgaatttccccttctcccacagcactttgttcatacctttgttataatacataatattactttctttcttttatgtttttttgagacggagcctctctctgttacccaggctggagcgcagtggtgtgatctcacctcccctgggttcaagcgattctcctgcctcagcttctgagtagctgggactacaggcatgcaccaccatgccccgctggcttttgtatttttagtaaaaacgaggtttcaccatgttgcccaggctggtctcgaactcctggcctcaggagatccaccagcctcggcctcccagagtgatgggattacaggcgtgagccactgagcccggccaatatgactttcttaacagaaatattttgtggctgtatctgttttcttcacattttgtaaattccttgagagcaggcactttatttacaattgtatacctctttttatttcacaactgatgcatagtagatgcttgtcttcgtccattttgtgttgctataagtgaatacctgaaactgggcaatttacaaagaaaagaggtttatttagctcatggttctgcaggctgggaagtttaagattgggcagctgcatctggtagcttctgatgagggccttgtactgtggcaaaacatggcagagaaatggaaggggaaccaggtccctgcaaagagagtaaaacaccaaacacgagatgcaacctcactttacaacaacttgcacttgcataaccaattcagtcccacaaagagtaagaactgactcactcccaccagactgctttaatcccttcatgagagtgaatccttaatgacccagaagcctgttaaatattccaccccctctcaacactgttacactggggaccaagtctcaatatgagttttggtgggcacaaaccatattcaaatcataacaatgctcaataaatattagttgaattaaatgtttccttgggagaatatagacataaataaggcatggtttctgctctcaagagaagccaacattctatcaagggaaacagtacattattccatatgagaagctatactagtgacatgtataaagcacgaggaattcagcgatcaattagaaaatgcaataggaaaaataacccattcatgattttcccaaaatctataaggcagctaggaagatagctaacagatgtataaaccattatacagaaaagtatgagattgtactaaaggaaattttataaaaatcagaaagtggaggaatattcttgtcaagaactacaaaaggtctagaatttgaccctatttacaaacttacaaattagcctgacacacacagtttcatgtattctgtcagaagacatgagaatcttgggtgagaggcaaaggactttattactcagaaaaagcagtagctagaacttcctgttggcttgtgttcgttcccaatgccccccaaatcccacaagggcaatgcaaaggaccaatgatggatggctgcacagtgggttgcattacaggaaagaaacaatacatttggaggatccactgcttttatagaacatggaaataaacctgctgtttgtgatgttttcccatccttcagggtttctcactgaaaacatggtcctgagaatggccaaggtgaagagtcatcagtgccttacctttttggcatactcagcaagagtacgcataaatgcttagggaccatgatgggttgtctttcccaacaatattccatttgtatgtgtggaaactttaagtcagcaaattggtaattcttctcaaattagtccataaatccaatattattccaatcaaaatattaacaggccaattttttgtggaatttgaaacactgattacaaaactggaaaaggcacatatagtacatacagtaaattgttatatgaaagaagtgacattacataggagtgaaaaatggatgaataatttaataaatgtgattggacagttgtttcccttctcggagaaaaatctagatccatgccttatacaaaataaaatccagatatataaaagaccaaagtacacaaccaaaatcttaaaactaataaaaaatcatgtcctcagagtagataatttcctaaacaaaatccaaaaacacaagttttaaaggaaaagattgatatatttgattcgacaaacattgtataataaaagacgtgagaagtaaccttagtgagaaaagacgagcaaagattggtacaggctttttggaaaactagttggctctatctactgaagctgaacctatgcattccctatgaccagcaactccacttcttggtatatacccaagaaaagtgcatatgtatattcactaaggacattatgaaaagcattatttgtaatagccccacactgaaaaaaaaaaccaagagcccacaagcagtagaatgaataaataaattgtagtatattcatacattaaaatgtagcacataaaggagaattaactacaaattcacgacaacatggatgaatctcacaaacctaatgttgagcaaaagaatccagacacagaggagtatatactgaaagatcccacttatttaaagcagaaaagaggcaaaactaataatcaggagagtggttatcatccttgggcatagtgactggaaaggagcacaaaagaagcttatggcagggaggggagaggttgataatgtactgtgtcttgatctgagagctggttatatgggtgtctttactttgtgaacatttatcaagatatacacttaagatatgtatgtatgtatattgtactaaaataaaacattttgaaaatctgcctaacaggataccttcttatatatggctctcaccagtagagttgcacgcatactaaaagtcatgtgtttcctcaaacaggtttatttcagttacatttgctgtaaatgaacataatatgtatgcaaaaaagaagaccagcaacagatttagagaaactttttgcaaaatatattgctgaccaataattagatacaacatatgcaaagaacccctaagaagcaatatttgaaaaacaaacaacttaaaggatgaataggtaaatgacctgaaaaggtacttcacagaaaaggaaatgtgtataaccaggaaacctataaaaaaatgcttatcctcgttcatgtcctttgcagggacatggatgaagctggaagccatcattctcagcaaactaatacaggaacagaaaaccaaacaccgcatgttctcacccataagtgagagttgaacaatgagaacatttggggacagggaggggaacatcacacactggagcctgtcggggagcggggggcaaggggagggatagcattaggagaaatacctaatgtagatgacgggttgatgggtgaagcaaaccaccatggcacatgtatacctatgtaacaaacctgcatgttctgcacatgtatcccagaacttaaagtcaatttaaaaaaagatgttcatcctcatgaaataatctgggacatacagattcaaacactagggagatactcactttcacccattagattggctaaacacgtctgaaaatactaaatattggcaagaatgtgggaaaatgggactcatacactgctggtatgaatgtaaattgatgcaattactgtggaaacttatttggcagtgtgtagtcaggttgaagatgcatgtactatgtcatctagtaatttcaattccaggagacatgtttatagactaagaggaggctattgcaagaacatgaactgccgcattgcttgtaatagaaaaaatggaagcaacttaaatgtctatgaggatggaaatgcattagtgagctatggaatattcatataacagaatattatacatcatttaaatgcacctctatcagttacagtataagcataggtaaaatgtttagaaattcataatgttgggtgaaaattcacaatgttgtgtaaaagaagaagttgtagaagattacacacagatgtgatctaacttgtcataatgcaaaaaatcaccagaaaatgattcatttaacaaatctttattgtaggcacaattctaggtacttgggatcagtgaacaaagcagagatcccttcccttgtagacattacatttccatgtgggaagactgaaataagataattagcataagtaaataaattatatagtgtgttagatggcgatgaagcaaaagcagaggatgttaaggggatagagaaaacagggtgggcagtttgcagcattaagtaggatggttcaggtaggtctcattgatacagtgagatttgagccttgaaaatgtgagagaatttaaacgagtagctctattggaaaagagccctccttcctggaggaacagacattgctatggtcctatggcaagagtgagcccgggctgtttgtagaatagcaagaaggccacagctgtggcagaatgaggagagcagatcagagatcagagatacaatggagaaccagaaaatgtcaggcttctgcagggactttgactctgactccaagtggaatacggtgtctttgcaggattttgagcagagaaatgtcatgatttgatttatattttaaaatgatctctttaatttttgtgttgagaatgtaccactgtaggcgaatgagagtggaagcagagaggcatgttagaaagctgttgtagttatccagatgagagatgatggtggattcaaccttacgtgtaccaatggagatggtgagaagtggttggattttggatgcattttgaagtagagccaaaacgatttcctgatggattggagagaaagaaagaaattgaaggtgatgttaaggtttttgactcaagccaatgtacagctggagttgccatcaattgaagtgaggaaggcagtaggagcaataggttttaaagaacagatcaggagttctgcctatgacattttgagtttgaaatgcccaatagacatctgagtggaagtgctgagtaggcagttgtatatatcagacaggagtttaggatgaagatctggcctgcagacatgaagttggaagttaacctagaaatattttgtattagctattggactggaagagatcaccaagggagtatacatagaaatgcaaaggacagggatggagccctggggcattctcattttaagaggtttggaagaagaggggccagtaaaggaaactgagaagaagcagtcagtgagatgagagagtgtggtgtcctgggagccaagggaagaaagtgaaccaaagaggagtgactcattagccgtgcccaatgctgctgataggttaagtaaggtgagaacttagaattgatcattgtattgaacaatgtgaagtcactcatgaccataaccatgacaggagcaatttcaactgatttgtggaggtggacccacaaatcaggtgggccctgattagaatgtgtccaagagagaatgggaggaggaaaattgaggacattgaatagagaccactattacaaagggatgagagagtagtcaaaataggtatctggaggaagaactttcctgatagatgaaacagacattccaaaggctctaagacaatagtgagtatggcttgtttgaggaacagcagggaggctacagctggggcagagtgagtgaggaacagaacaggcagagctagtgggagataggaaaggatgatcatctggggctccctcttggccccaaactaatgtaggtagaaggcctaagggaatgtagtcttagacaggaacactggttccaacgaagccttatattgtgtatagaaacatatttcatatgtatctgtaaaagagatttgcatcaaaggggagcaaagaaattgggtcatggcaggtgggaaagtggagccaagagaaaaatatatatatatatatataaaacaatttactatatatgctttttccaattttgtaatcaatgcttcaaattccacaaaaaattggcctgtttttatatatatgtatacagtgtacatatgatgaatatttgtgtgtgttatataataaagatgagaaataacagtataatcgaatcctgattgaaatgacccaatagagagcacaacattgataatgctggagttgggggagagaaagaaggtagtgatatcattcagttgatgggagaagaagatatctagtgggaaaggagagtggctggctttagagtgcagtctggaaatatcattatattaatttgctaagattgctataacaaaataccacacactgagtggcttaaacaacagacatttattgtctcacagggctggtttcttccgaggcttctctccttagcttgcagatggccatcttctccctgtgtcttcacatggccagccctcagtctgtattatctgtgtccttatctcttcttataaaggcaccagtagtattgggttaggacccatcttaatgacctcgctttgacttaagaggtaattatgtcacattatgaggtactgggtgttaggactccaacatatgaattttggagggacacaattcagcccacaataatcatatatgatatcaacaggaagaccatgtgtatggatgcgggtgcagataggtgaaatgatgtggtggtaggagtctgtagaagttctcttctgatggcttcaattttctagtgaaacaggaagcagtggaagaattagttaggatatggaggcagtattaggagtttgaggagaaagaagttgcaaaataataacttggaaaagtcagaaagttaagggacaggagacctgtagcatgattgcccagcagcattaaagtctggttggagttcatggtcatgaagttaaattaagattagtcatgtggttgtgaattttcccctagccagctttagctgtatgggtgcaggctcatggggatgtagctggatttagccaggggtcgtgcttttgccaagcaacacaaagtgcgagaggggcaggatagtggagggtatatgtagacgagtggttgtaaagactgagcatgacatctgagctaagaaaggagaagagagaggacaataaagggaagaagagatagtaaaaatctggtaagatcaatggattggagattctggtgaggttgaaagaaaatagggtccaaagtgagtgggctgaaaagagaggagcgtatggtcagaaagagggatgtttgaaattgagatcacagaggggtccccaaaattacagtgacaagagctagggtatggctacatgagtgagtacatgagtgagtaactgaagtggagttgaggacaatgtcatggaggagaaatgttcaaggaacagaaggggctagtttgtcagattatcagaatgattttgttttgagatgggggttttgctaggttgcccaggctgactcaaactcctgggtaaccttcccaacttagtcttctgagtaggtaggactatggtgagtgccaccatgcctagctttagaatgatcgatattgaactcactaacaattaagacaggacaactaccattgagaatgaccatgttctcagagacaaaatgcctgagaaatgaggggagaatatttctgacaacagcaataagagctggttggtgacactagctgtcaaaagctggaagtttttagggaggtgggagagggattgctatctaaaggcagcaatgaggagcagtaaagtcacttacacaacttttaggatctgtggtacagtggtggtaggagagaaaaatcatctgctccttgtgagtgggcttcaggggatccagagtcctaagggaagggggcattcagagaagaagcttagactatggaggattagcaagggtgcattgtgttttattagtagcggaggggtgagatactgacctaaagaggggacgtggacacaaccttatggaggttagaatgtagcagttgagaggtatcttaggatacttgtggtgactggcacaaatggagataaatgttatcattagtcgagttctaatagattcaaaggagatcagtgtgggagaattttgaggtttggtctatggagaggtgggtatctggagcttcttgtcaaccccaagggatgtggggggtgtggtcttagacttggatcactggttcaaacaaggcttcattttgctccttcgctgtgctcagaagtcacattaatctgtaatgacagaaaaacaggccagagggcaagatggccaactagaagcagctagtgtgcacggctgtcatggagtggaatggaaggggagagtaaatatagcactttcaatggaagcatccaggttctcgcattgagattaatcaaggaaataacttgacccatggagaatgagagaaaagcaaggcaggacgacggcacacccaggtgcaacacaaagccaacggaagctccccaccgaaagaagtggtgagtgaatgtgtggtcctcggaacccatgcttcttccatggatttttgcaacccacaggtcaggagatcccgtcatgagcccactccatcagggccttcagtctcacacacagagctatgtggagtgccggcaggagagcggacatgcatggagaaccaggaactttagaaactctggctatccgggcatcctagcaaaagtagctgcaactccagcaaagcaggatgttagacccctgtacctaccccaggaaagagactgaatccagtgggccaagcagccatggtctgtgggccccacttccacaacacctcacaggataagacctactggcctggaattacagctagccaccagtagcagtgctgcacctacttgggacagagctccaagggggaggggcgggccgcatgtttactgtttgggtgacttagcccttccagcctttgggatttggaaagtccaaaccaactcggggcagaagggatcccccagcacagcacagctgctctaccaaaacatggccagactgcttctctaagtgggtcctgatcctattcttccttactgggagggacctcccaaccggggcctccagccacccctgttggtgatctctggctgacagagatttgaaaattccctgggacagatgtcccagagaaagggcaggccaccatctttgcttctgcagtggagccgtccttgctaacttcgggctaacaaagaagcagagaccctaagtgccttctccacacctccaacaaactacagccaacccaaggagaagatgccagtttgtctctgaggggtccgacacaccctccattgcttgtcaccacacaggaaacccctggattgggcttacagcacaaaaactctatcctgggctaactgtactgagctattgctgactcacatttctctggtgtggagcccccaggagacaagcaaagtggtgaattggcaagatagctgatgtggagcctagaggttttgttgcaggagtatctgtagtagagcatggccaggcatggccacccctttaagctcaacatgccccataagagactttagcactatgggaactatcagacctgatcactgcagggcagtcttgcacatcagacggggctggtcagacctgagcactccttggtctgctgtcctctcccagggccccagcctggccacacctgcttacagggcagtcttgcgtgctctggggcccacaccatagcttctgtgctggtggatcatgactgacttgtggagagctccagtgaggcggatcctatggccgtgcaccagcctgcatgttaactccccataatatagcttccctcaagcccacagcaactccccacatcactctgcgggcacctgtctacatgggtgggttttgctttacttgccctgccagcatgtgggagtgcaataggcccccaacccctgccgattactgttggagatggagccttggtggccacagagccagcaagtcttgcctcaccagcgaacagtgaacaggggatctgcccataccgtgagtgatcactcctgcttgtggggcacagagaaggcacccagatctgagccagccagcactctgccccaagccaacattacctccgaagtaacagcctacacagtctccagcagtggccccctgctccctgctccccacagctgctttgcctctgctgcagtggtgaatgcccacagggaggcaggcacctctgcatccactagcacttggctgtagctgctgcaccttgatccccccagtacagtagactccaaacatcaaggagccagagaacaaagttggggcccaatacaagtcccccagagatacagcatgcagtccaggggttgggagctgaacattggccccctagtatcttccagaaacgaagccagatggatgaatccaccttataccacaatcaaacccccaaggtcatcaaataggataaaagaaaaaaaacatccaaaggtcagcaacctcaaaagttgaaggtaggtaagcccacaaagatgagaaagaatcagtgcaagaatgctgaaaactcaaaaaaccagagtaccttctttcttccaaatgactgcatcacctgtccagcaagggtttggaaccaggctgaggctaagatggctgaaatgacagatgtataggaaagaagttcactgagctacaggggtacattgtaacccaatgcaaggaagttagaaatcatgataaaatatcataggagctgacagacaaaatagccagtatagagaagaatgtaactgacctgatagagctgcaaaacacactacaagaatttcataatgcaatcacaagtattaattgcagaatagaccaagcagaagaaagaatctcagagcttgaggactgcctttctgaagtaagacgagcagataagaatatagaaaaaaagaatgaaaacgaatgaacaaaaacctccaagaaatatgggattatgtaaagagactgaatctacgactgcttggtgtacctgaaagagatgggaagaatggaatcaaattggaaaacatatttcaggatgtactccatgagaaattccccaacctaactacagaggccaacattcaaattcagcaagtgcagaccaccccagtaagatactccacgagaagttcatccctaacacacataatcttcagcttctctatagtcaaaatgaaagaaaaaatgttaaaggcagctggagagaaaggccaggtcacctgcaaagtgaagcccatcagactaacagcaaaggtctcagcagaaaccctagaagccagaagagattaggggccaatattcaacattcttaaagaaaagaaattccaacacagaatttcacatccagccaaactaagcttcataagcaaaggaaaaataagatccctttcagacaagcaaatgctgagggaatttgttaccaccagatctgccttacaagagctcctgaaggaagccctaaatatggaaatgaaagactgttactagccactacaacagcacattaaagtacacagaccagtgacactataaagcaatcacataaccaagcctacaaaataaccagctaacatcatgatgacaggatcaaatccacacaaatcaatactaaccttaaatgtaaatgggctaagtgccccaattaaaagacacagagtggcaagccagataaagaaccaagacccattggtatgctatcttcaagacacccatcacacatgcaatgacagacatagactcaacataaggggatggagaaaaatctaccaagcaaatggaagacagaaaaaagcaggtgatgcaatcctagtttctgacaaaacagactttaaaccaacagagataataaaagacaaagaaggacattacttaatggtaaagggttcaattcaacaagaagatctaactatcctaaacgtatatgcacccaacacaggagcacccagattcacaaagcaagctcttagaggccttcaaagacacgtagacttccacacaataatagtaggagacttactgacagtattagacagatcatcgaagcagaaaattaacaaagatatttaggacctgaactctgcattggatcaaatggacctgatagacatctacagaactctctactgcaaacaaaagaatatacattcttctcatcatcacatggcacatactctaaaattgatcacacaattggaagtaaaacactcctcagcaaatgcagaacaactgaaataataaacagtctcttggaccacagtgcaatcaacttagaaatcaagactaagaaattcactcaaaacgatacaattacatggaaatggtaattgtattacagttccatgaaagactctcctgaaagattttaggttaaataatgaaattgaggcagaaatcaagaagttctttgaaactaattaaaacaaagatataacataccagaatttctgagacacagctaaagtagcgttaagggagaaatttatagcactaaatgcccacatcaaaaaattagaaagatcttgagttaacaacctaacatcacaaccaaaagaactagagaatcaagagcaaacaaatcccaaagctagaagaagacaagaaataaccaaaatcagagctgaactgaaggagatagagacacgaaaaaccattcaaaagatcactgaatccaggagctgattttttgaaaaaaattaataaaatcaatagaccaccagccagactaatgaagaagaaaagagagaagattcaaataaatacaaccagaaacggcaagggggatattaccactgaccccccacggaaatacaaaaaactatcagagaatattatgaacaactgtatgcacataaactagaaaccctagaagaaatggatacattcctgacacatacacactcctaggactgaaccaggaagaaattgaattcctgaacggaccaatagtgagctctgaaatgcaggcagtaatagcctagcaaccgaaaaaagcccaggaccaggggattcacagctgaattctatcagatgtacaaagaagagttggtaccattcttactgaaactattccaaaaattgaggaggaggtactctgccctaactcattctatgaggccagcatcatcctgacaccaaaatctggcagagatacaacaacaacaacaacaacaacaaaatcttcaggccaatatccttgatgaacatcgatgcaaaaatcctcaacaaaatactggcaaactgagtccaacagcacatcaaaaggcttatgcaagacaataaagtaggctttatacctgggatgcaaggttggttcaacatatgcagatcaataaatttgattaatcacataaacagaactcaagacaaaaccacatgattatctcaatagatgcagaaaaggctttcaataaaattcgacatccattcatgttaaaaattctcaataaactaggtgttgaaggaacatacctcaaaataataagacccatatatgacaaacccacagccaggatcatactgaatgggcaaaagctggaagcactccccttgaaaacaggcaacaagacaaggatgacctctctcactactcctattcagtatagtattgtaagttctagccagggcaatcaggcaagagaaagaaataaagggcatccaaataggaagagaggaagtcaacctattcctatttgcagataacatgctcccatatctagaaaaggccatcgtctcagcccaaaagcttcttaagctgataagcaacttttgcaaagtctcgggatacaaaatcaatgtgcaaaaatcactagcattcctatacaccaacaacagtcaagccaagagccaaatcaggaatgaactcccattcacaattgcacacaaagaataaagcatctaggaatacagctaactagggaagtgaaagaaaaaaaaaagaactacaaataaaaaaggagaactgctcaaataaatcagagataacacaaccgttccacgctcatggctaggaagcatcaatatcattaaaatgatcatactgcccaaagcaaattatattaatagattcaatgctatgcctattaaactaacactgacattcctcacagaactagaaaaaatattttagaattcacatggaaccaaaaaatagccaaggcaatcctaagcagaatgaacaaagttggaggcaaaccatgctacagggctacagtaaccaaaacctcatggtactgatacaaaaacagggacatagaccaatagagcagactagagaagccagaaataagaacatatatctacaattatatgatctttgacaaacgtgacaaaaacaagcaatggaggaaaggatccctgttcaacaaattatgctggcataactggctagccatatgcagaaggttaaatcttgactctttccttacatcatatagaaaaattaactcaagatagattgaagacttaaatgtaaaacccaaaactataaaaccttggaagacaacctaggcaataccattcaggtacgagcaaatatttcatgaaaaagatgccaaaagcaattgcaacaaaagcttctgcacaacaaaagaaacttggtagagtagacagacaacctacggaataggagaaaagttttgcaaaccatgcatctgagaaaagtctagtatccagcatctataaggaacttaaataaatgtataaaagaaaaacaaaccccattaaaaagtggacaaaggatgttaacagacacttttcaatagaagacatacatgtagccaataatcatataaaaaaagctcaacatcactgatcattagagaaatgcaaatcaaaatgataaggagataccatctcacgtcagacagaatggctattattaaaatgtcaaaaaataacagatgctgtcaagggtgtggagaaaaagtatgcttgtacactgttggtggaagtataaattagttcagccattgtggaagacagtgtggcgattcctcaaagccctaaagacagaaataccatttgactcagcaatcccattactgggtatatacccgaaggaatagaaattgttcaattataaagacacatgcacaggtatgttcattgcaacactattcacaatagtaaagacatggaatcaacctaaatgcccatcaattatagactggataaaagaaaatatggtatatatatgcagcatggaataatatgcagccataaaaaagaaaaaggtcatgtcctttgcagggacatggatggagctggaggccattatccttagcaaactaatgcagggacagaaaaccaaatactgcatgttctcacttgtaagtgggggctaaatgatgagaacacatggatacagagaggaacaacacacattgggacctctcagggggtggagggtgggtggatggagaggatcaggaaaaatatctaatgggtgttaggctcaatatctgggtgatgaaataatctgtagaaaatacccatgacacagtttacctatgtaacaaacctgcacatgtacccccgaacttaaaaaaaaatacgctggaagctacacatcacattcaggataggactacccctagggaagtgggaaggtgaatggaagtggagggaaggtcaaggaaacctcaattattttttcggtaaagttttcattccttaaaagaaagacaaagtaaatatacctaatgttaacaacattgaaatctgagtagtggaaacactggtgtttattatatttaatgccagggacattgtaggtactcaattaatattatttgttgaatgagtatgcttttctgttttgaaagtttctccaacaaacatacacaattctcaaattaacagaaagtgctacaagagcaaagaaaagggaatgaagtgaggtggggaaggcttgagaaatccttgtggaaagaatgatttctgatctatatagatctataccaccatacatggggtgcaagtaaaagacatagttctacctccatcttaccttaaagcgctaaggttctgggtgagtatccagaaaatgatcttgaacgtttagtccttttaagtaactaccggatcctcaattttctcttccaacagacactgggtggtgctagtgtccaaaaattcctccctatcacggatttattacttcaatccacatacatctccacaaccaatgtgtcttgtgggccaaagtgctagggattggggatataaaggtgaatagcaatagcctcagttgttctgtgattataaactgactgctatcgtgttctgtggccgagaaagctgcaaatgtgacttttacatttcacaggagagcactactgtcacagaaatgtccagttgtaggggtgaatggccctgaactacccaccctcaccatgagcactcgtactccacgacgtggccaaggattagagcagacaacaccgagccccacttccaacctactgttaggttgtccttaggccccaatggctataaaaagcctagagagcctatataccggtcattcagcttggacctctgtgttacagatgttctaagctcactgggcaaaatgtgtctgcttattgcagaggcttctgttattgtgaaagagtgagtgtactttgttttttttttttaaaggtactcaaatgtcaactttattgtttctatataaacacctttttgtactgaaaactgtaaaaataacaaagtttgctgtgattgcagttcaaatttttgaaagccagaaaatctaattatgctatagccaaactacctaatgctttctttatccacaagtaactttgcttcaatttcttgatgttgggtttcatctcactgactttgggcttctaagacacatgggaatacttatatcgtcttggattctttgggtcaaatcaaacagtagagctaaagttattcaaatacattcagattacacagatcccttatgaattactagtatcatagtaggaagaaaaagatacaagaagaaaaatacatcctagaactcattatcaaaattattggtgtatagtctgttctagcatagattagctttctcaacctgctatataaaattaccagcaagaaaaaaaggtgcaagaataagatttatggctgaagtggcttggtgtcttgattctctattctagcattctcagaaggatcccatccgttagacacgcagaaactgcagggacatttgaatggtcttgattccttcttaactcccttaggctcctcgtttgttggtcttctttcatgcatacgaactctgccgagtaacatgtatctcgatcttgccatcttttctctctgcacagacagcaatgttcttactcctctcctgctgtaaagccactcatcttcgatttccctgaggacttctgctcctacagactctcgacggagtaaagcttccgatagaggggaaacagattcgctactagtgttgatagtcaagttactaaggttctttatcaacgtctcggagcagatttgagaggcccctgaatcgtcccgggaattttcttcggtgagcatttgtggagactctgggatgtaggttggattaaacttctgtgatgggtccatcggcgtcttgacacaacactaagcttctcctggatctttgaaacgtagcagaaactgatgacggagcctcaaattgctacaaggtagcccggaaagagcaagagtgagtgtacttcggatgaagggaatgtggaccctcaggactaaagcagtgggagaggcctgggaggtggggcctggggagggcgaggtctgctctgaagtcaccaagctcctgatcttagaagagatggtgggcgcaggctctggaggctcaagcggaggaggggaaggaggcgagtccggaaaccctcggccaatcagagagggctggggcggcgcctgctagaaggcttagcactgcagggctctgggcgggaaggctaacctggtgcggagccagcctgggtctcagccccgcgtacggcctttcacgagtcttcaagccttcaggtgagtacctgcggcctcgcaggagccagaggaccatggggacgggaaggcgtgggggtcgcgaggcgggggatgccgcgccttcgggagccagaggggctggggttggggctggtgcttggtgtctgcgccgccgccaggcccggcgagtccgagcctttgtctttctggggcgccgccttctgcgagcgatgccgagccctcccgggggccggtccctggaaagaaggccccggggagtcggggtgggaggcggtggttggaggggtaggggacccttaaagcggccagtccgcggtagctgcaggtcagaggcttcgaggatgaagagtttgggggccgcccggaatgggccttgtggggctgggccctggttcctttccctcccgtggccgttagactgggcgtctaacaacgctaatagttatttgaaaaagtatgcaaactgctcctgacagactggcctatgcgcccggccctgctattatttattggttagttccaatttcccagctccgagcttggcgtctgatcgcttggcagaggagggtcttagggtaacctcgacagaatggaggcatgttcgacacttctgactgcttgggggcctctgcattctacgccagggactagacgaagtgtcttactccaccagggtggggccgggcttgctcatgaaagctctacctggtatatcctattgtctcttctgaacaaactcgagactttcacagggcaccaggcatttcgtcaggtccacagctacgcacgtctgagcctcatctcctccctctctgcagtgaaaacgtgaaagaagacccacttctatttggtttattccgttctgctgaagtcctgggtctgatcctagttagctgtcccttcttacagcgtttacaaaccagtgccacaaggagctattatgagacgtgtattgtagtgccttaatgtactgtcgtctttggggatttaaaatagatagaaattaatacaacttatctcattctttttttgtgtgctgctccccatctcccaagaaaaatggcaaaaccaaaagtaaatagaaagtgaagatgctcaaatggtgctatgttctgtttcaaaataattacctggttaaaaccagtctttattttttcttctatccctgtctggtcttgtgcttctatcacctccattttatccttgctgtgattttaagagtcagacaaatggctctgtgtttctagagcatcttggtttctggtgcgttatgatccaatgacatttactgcctatcagaaacggcaaatgatgtggagttgaaattattctaacaaaaatataacttttctaatatctgttgctgtttttctgttgaaaatgagcaggtagaatatacattgataggaaatgtgaaaatttttgcttgtgatcccttagtccgaagatagttctgccaggtaagttttcttaaaaatgtttttttctgtcctggcgcggtggctcacgcctgcaatcccagcactttgggaggccgaggcgggcagatcacttgaggccaggagttccagaccagcctggccaacatggtaagacccccgtctctactgaaaatacaaaaattagccgggcatagtggcgtgtgcctgtaatcccagtttcttgagatgctgaggcagaggaattgcttgaacccaggaggcggaggttgcagtgagccgggatcgcgccactgcactccagcctgggcgacagagcaagacgctgtttcaaaaaaagaaaaaagttttttcttttcaggctttcttctagtcaagatgagtgataaaccagacttgtcggaagtggagaagtttgacaggtcaaaactgaagaaaactaatactgaagaaaaaaatactcttccctcaaaggaaagtaagtcatgtggggttctactggaaacaaacaatagaggaagttaataggttcagtaaataaacctatcttctagtaattttttttacacaaagtaagcaataattagagtaccatggtatttaatgcaacagttaaaactatcaaatagttttcttctggttctcacatgatgggcccagtagtgatgggggaataaaaaactagttttttgttggaaaattattaaaaaccacattaaaaccaatcttggaatattggatgtagcactaaaaaacacttagtttttgtctacttttgggtatttggcatttttctacatttaaaaatttgagtccataatattatccctaacgaaccctgtagactctgcagttttgaccttctatatctgatgaaaagataaagtgagaacaaatttagatcttagtatgcttaaagctctcagattcaagggattgattggttctgccctctggagttatagcctgctggagaaactctaagcatattcacaaaagccaaggggcaccttttgttatgtcagttttatttgagagttgcaatattagttaaaattatctgaaagtgtataattttctaactgtatagtgatagacaaatctgaagaaagtacttcacttactcctcagtcttgaataatctgaaaaaatgacaacagcatttggaaaaacaaaccctacagttgatgtagtttctaattggtagttcaggtacttaatgtgtgcacacatgcaggcacacaccccactctgagttttgtgtttaatgccttggcattctaaatttaaagcatgtatggcagccttcaatgacttacaaagagctcttttggaagaagctgaacttagtcttaggaaaatacttttgtaatttttggtttctttttccccagctatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgtt

SEQ ID NO: 3535 - DNA, 444 bp, human
gacccatcacagaagtttaatccaacctacatcccagagtctccacaaatgctcaccgaagaaaattcccgggacgattcaggggcctctcaaatctgctccgagacgttgataaagaaccttagtaacttgactatcaacactagtagcgaatctgtttcccctctatcggaagctttactccgtcgagagtctgtaggagcagaagtcctcagggaaatcgaagatgagtggctttacagcaggagaggagtaagaacattgctgtctgtgcagagagaaaagatggcaagatcgagatacatgttactcggcagagttcgtatgcatgaaagaagaccaacaaacgaggagcctaagggagttaagaaggaatcaagaccattcaaatgtccctgcagtttctgcgtgtctaacggatgggatccttctgagaatgctaga

SEQ ID NO: 3536 - DNA, 482 bp, human
atggacccatcacagaagtttaatccaacctacatcccagagtctccacaaatgctcaccgaagaaaattcccgggacgattcaggggcctctcaaatctgctccgagacgttgataaagaaccttagtaacttgactatcaacactagtagcgaatctgtttcccctctatcggaagctttactccgtcgagagtctgtaggagcagaagtcctcagggaaatcgaagatgagtggctttacagcaggagaggagtaagaacattgctgtctgtgcagagagaaaagatggcaagatcgagatacatgttactcggcagagttcgtatgcatgaaagaagaccaacaaacgaggagcctaagggagttaagaaggaatcaagaccattcaaatgtccctgcagtttctgcgtgtctaacggatgggatccttctgagaatgctagaatagagaatcaagacaccaagccacttcagccata

SEQ ID NO: 3537 - DNA, 3644 bp, human
ggctaacctggtgcggagccagcctgggtctcagccccgcgtacggcctttcacgagtcttcaagccttcaggtgagtacctgcggcctcgcaggagccagaggaccatggggacgggaaggcgtgggggtcgcgaggcgggggatgccgcgccttcgggagccagaggggctggggttggggctggtgcttggtgtctgcgccgccgccaggcccggcgagtccgagcctttgtctttctggggcgccgccttctgcgagcgatgccgagccctcccgggggccggtccctggaaagaaggccccggggagtcggggtgggaggcggtggttggaggggtaggggacccttaaagcggccagtccgcggtagctgcaggtcagaggcttcgaggatgaagagtttgggggccgcccggaatgggccttgtggggctgggccctggttcctttccctcccgtggccgttagactgggcgtctaacaacgctaatagttatttgaaaaagtatgcaaactgctcctgacagactggcctatgcgcccggccctgctattatttattggttagttccaatttcccagctccgagcttggcgtctgatcgcttggcagaggagggtcttagggtaacctcgacagaatggaggcatgttcgacacttctgactgcttgggggcctctgcattctacgccagggactagacgaagtgtcttactccaccagggtggggccgggcttgctcatgaaagctctacctggtatatcctattgtctcttctgaacaaactcgagactttcacagggcaccaggcatttcgtcaggtccacagctacgcacgtctgagcctcatctcctccctctctgcagtgaaaacgtgaaagaagacccacttctatttggtttattccgttctgctgaagtcctgggtctgatcctagttagctgtcccttcttacagcgtttacaaaccagtgccacaaggagctattatgagacgtgtattgtagtgccttaatgtactgtcgtctttggggatttaaaatagatagaaattaatacaacttatctcattctttttttgtgtgctgctccccatctcccaagaaaaatggcaaaaccaaaagtaaatagaaagtgaagatgctcaaatggtgctatgttctgtttcaaaataattacctggttaaaaccagtctttattttttcttctatccctgtctggtcttgtgcttctatcacctccattttatccttgctgtgattttaagagtcagacaaatggctctgtgtttctagagcatcttggtttctggtgcgttatgatccaatgacatttactgcctatcagaaacggcaaatgatgtggagttgaaattattctaacaaaaatataacttttctaatatctgttgctgtttttctgttgaaaatgagcaggtagaatatacattgataggaaatgtgaaaatttttgcttgtgatcccttagtccgaagatagttctgccaggtaagttttcttaaaaatgtttttttctgtcctggcgcggtggctcacgcctgcaatcccagcactttgggaggccgaggcgggcagatcacttgaggccaggagttccagaccagcctggccaacatggtaagacccccgtctctactgaaaatacaaaaattagccgggcatagtggcgtgtgcctgtaatcccagtttcttgagatgctgaggcagaggaattgcttgaacccaggaggcggaggttgcagtgagccgggatcgcgccactgcactccagcctgggcgacagagcaagacgctgtttcaaaaaaagaaaaaagttttttcttttcaggctttcttctagtcaagatgagtgataaaccagacttgtcggaagtggagaagtttgacaggtcaaaactgaagaaaactaatactgaagaaaaaaatactcttccctcaaaggaaagtaagtcatgtggggttctactggaaacaaacaatagaggaagttaataggttcagtaaataaacctatcttctagtaattttttttacacaaagtaagcaataattagagtaccatggtatttaatgcaacagttaaaactatcaaatagttttcttctggttctcacatgatgggcccagtagtgatgggggaataaaaaactagttttttgttggaaaattattaaaaaccacattaaaaccaatcttggaatattggatgtagcactaaaaaacacttagtttttgtctacttttgggtatttggcatttttctacatttaaaaatttgagtccataatattatccctaacgaaccctgtagactctgcagttttgaccttctatatctgatgaaaagataaagtgagaacaaatttagatcttagtatgcttaaagctctcagattcaagggattgattggttctgccctctggagttatagcctgctggagaaactctaagcatattcacaaaagccaaggggcaccttttgttatgtcagttttatttgagagttgcaatattagttaaaattatctgaaagtgtataattttctaactgtatagtgatagacaaatctgaagaaagtacttcacttactcctcagtcttgaataatctgaaaaaatgacaacagcatttggaaaaacaaaccctacagttgatgtagtttctaattggtagttcaggtacttaatgtgtgcacacatgcaggcacacaccccactctgagttttgtgtttaatgccttggcattctaaatttaaagcatgtatggcagccttcaatgacttacaaagagctcttttggaagaagctgaacttagtcttaggaaaatacttttgtaatttttggtttctttttccccagctatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgttgttgtctgactctgtggttcattctggtggtattctaaggaatgaaaagtacacaaaggtaccttttacactcaaacaaaatggttgaaggaaaacttttagcagattagtcctgggggaaaatactaaattctgtccaagtccagtggttcctgacttggggatggtaggtgctttttctttatagttggaatcacagagttagagaaccttgggagagaaggtcatgtggactaacctccttatctcagaatgaggaaatgaaaacacagggtctgaagtaatctgctcaatttgaataagggttggaattc

SEQ ID NO: 3538 - DNA, 3312 bp, human
ccagcctgggtctcagccccgcgtacggcctttcacgagtcttcaagccttcaggtgagtacctgcggcctcgcaggagccagaggaccatggggacgggaaggcgtgggggtcgcgaggcgggggatgccgcgccttcgggagccagaggggctggggttggggctggtgcttggtgtctgcgccgccgccaggcccggcgagtccgagcctttgtctttctggggcgccgccttctgcgagcgatgccgagccctcccgggggccggtccctggaaagaaggccccggggagtcggggtgggaggcggtggttggaggggtaggggacccttaaagcggccagtccgcggtagctgcaggtcagaggcttcgaggatgaagagtttgggggccgcccggaatgggccttgtggggctgggccctggttcctttccctcccgtggccgttagactgggcgtctaacaacgctaatagttatttgaaaaagtatgcaaactgctcctgacagactggcctatgcgcccggccctgctattatttattggttagttccaatttcccagctccgagcttggcgtctgatcgcttggcagaggagggtcttagggtaacctcgacagaatggaggcatgttcgacacttctgactgcttgggggcctctgcattctacgccagggactagacgaagtgtcttactccaccagggtggggccgggcttgctcatgaaagctctacctggtatatcctattgtctcttctgaacaaactcgagactttcacagggcaccaggcatttcgtcaggtccacagctacgcacgtctgagcctcatctcctccctctctgcagtgaaaacgtgaaagaagacccacttctatttggtttattccgttctgctgaagtcctgggtctgatcctagttagctgtcccttcttacagcgtttacaaaccagtgccacaaggagctattatgagacgtgtattgtagtgccttaatgtactgtcgtctttggggatttaaaatagatagaaattaatacaacttatctcattctttttttgtgtgctgctccccatctcccaagaaaaatggcaaaaccaaaagtaaatagaaagtgaagatgctcaaatggtgctatgttctgtttcaaaataattacctggttaaaaccagtctttattttttcttctatccctgtctggtcttgtgcttctatcacctccattttatccttgctgtgattttaagagtcagacaaatggctctgtgtttctagagcatcttggtttctggtgcgttatgatccaatgacatttactgcctatcagaaacggcaaatgatgtggagttgaaattattctaacaaaaatataacttttctaatatctgttgctgtttttctgttgaaaatgagcaggtagaatatacattgataggaaatgtgaaaatttttgcttgtgatcccttagtccgaagatagttctgccaggtaagttttcttaaaaatgtttttttctgtcctggcgcggtggctcacgcctgcaatcccagcactttgggaggccgaggcgggcagatcacttgaggccaggagttccagaccagcctggccaacatggtaagacccccgtctctactgaaaatacaaaaattagccgggcatagtggcgtgtgcctgtaatcccagtttcttgagatgctgaggcagaggaattgcttgaacccaggaggcggaggttgcagtgagccgggatcgcgccactgcactccagcctgggcgacagagcaagacgctgtttcaaaaaaagaaaaaagttttttcttttcaggctttcttctagtcaagatgagtgataaaccagacttgtcggaagtggagaagtttgacaggtcaaaactgaagaaaactaatactgaagaaaaaaatactcttccctcaaaggaaagtaagtcatgtggggttctactggaaacaaacaatagaggaagttaataggttcagtaaataaacctatcttctagtaattttttttacacaaagtaagcaataattagagtaccatggtatttaatgcaacagttaaaactatcaaatagttttcttctggttctcacatgatgggcccagtagtgatgggggaataaaaaactagttttttgttggaaaattattaaaaaccacattaaaaccaatcttggaatattggatgtagcactaaaaaacacttagtttttgtctacttttgggtatttggcatttttctacatttaaaaatttgagtccataatattatccctaacgaaccctgtagactctgcagttttgaccttctatatctgatgaaaagataaagtgagaacaaatttagatcttagtatgcttaaagctctcagattcaagggattgattggttctgccctctggagttatagcctgctggagaaactctaagcatattcacaaaagccaaggggcaccttttgttatgtcagttttatttgagagttgcaatattagttaaaattatctgaaagtgtataattttctaactgtatagtgatagacaaatctgaagaaagtacttcacttactcctcagtcttgaataatctgaaaaaatgacaacagcatttggaaaaacaaaccctacagttgatgtagtttctaattggtagttcaggtacttaatgtgtgcacacatgcaggcacacaccccactctgagttttgtgtttaatgccttggcattctaaatttaaagcatgtatggcagccttcaatgacttacaaagagctcttttggaagaagctgaacttagtcttaggaaaatacttttgtaatttttggtttctttttccccagctatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgtt

SEQ ID NO: 3539 - DNA, 47075 bp, human; identical to SEQ ID NO: 3534

SEQ ID NO: 3540 - DNA, 476 bp, human
ccacccttcccctgtccacaaccgtcattgtctgttcttgccatccagtggccactgcctccaccatggctgaggctttctctaagacaacctctgaggaagaccagagcatccaggagcccaaagaggccaactccatgacggcccagaagcagaagaagtgagggcttcgaggctcccgtaggcgccatgccaacagcggcggagatatcttcggggacagctttgccgcctatttcccccgggtgctgaagcaggttcaccaggccctcagcctttcccaggaggccgtgagtgtcatggattctatggttcgtgacatactggaccgcatcgccaccgaggctggtcacctggcccactactccaagtgcgtgaccatcacctcccgggacattcggatggccgtgtgcctgctgctgccggggaagatgggcaagctcgctgagtctcagggcacgaatgccaccctcagg

SEQ ID NO: 3541 - DNA, 741 bp, human
cacacagaaagcactcagtaaacgctgtttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcc

SEQ ID NO: 3542 - DNA, 3298 bp, human
agactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgcacctttgccgccttgggcccattccatgttgaggtctctggggaggagtctctgtcctttagtggtcaaaatggcagagagaaacatgaagttgttctcaggaagagtggtgccagcccaggggaaagaaacctttgaaaactggctgatccaagtcaatgaggtcctgccagattggagtatgtctgaggaggaaaaactcaagcgcttgatgaaaacacttaggggccctgcccgggaggtcatgcgtttgcttcaggcggccaaccccaacctaagtgtagcagatttcttgcgggcaatgaaattggtgtttggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataagggaggaagaggattgggatgatgcttttattaaacggaagcggccgaaaaggtctgagccaataatggagagggcagccagccctgtggcatttcagggcgcccagccaatagcaatcagcagtgctgactgtaactgcaacgtgatagaaatagatgatacccttgatgactctgatgaggatgtgatcctggtggtgtctctgtacccttcactgacacctacaggtgcccctcccttcagaggaagagccagacctctggatcaagtgctggttattgattcccccaacaattctggggctcagtctctttctaccagtggtggttctgggtataagaatgatggtcctgggaatattcgtagagccaggaagcgaaaatacacaacccgctgttcatattgtggggaggagggccactcaaaagaaacctgtgacaatgagagcaacaaggcccaggtttttgagaatctgatcatcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttcaaaaataaaggaagatacaaaaactaaagtacaaattacctgaaactcagcacccttttgtaaccattgtcagccctttggtgaatgtccttccagatatctccctgtacctgtgtacccagatagatatatgtatagataagagtgaccaaatataagtgctgttctatactgtgtatttttcaccaaataatgtatctcgtggacttctatgtcgatgaatatatataaatatctaa

SEQ ID NO: 3543 - DNA, 3424 bp, human
agccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgcacctttgccgccttgggcccattccatgttgaggtctctggggaggagtctctgtcctttagtggtcaaaatggcagagagaaacatgaagttgttctcaggaagagtggtgccagcccaggggaaagaaacctttgaaaactggctgatccaagtcaatgaggtcctgccagattggagtatgtctgaggaggaaaaactcaagcgcttgatgaaaacacttaggggccctgcccgggaggtcatgcgtttgcttcaggcggccaaccccaacctaagtgtagcagatttcttgcgggcaatgaaattggtgtttggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataagggaggaagaggattgggatgatgcttttattaaacggaagcggccgaaaaggtctgagccaataatggagagggcagccagccctgtggcatttcagggcgcccagccaatagcaatcagcagtgctgactgtaactgcaacgtgatagaaatagatgatacccttgatgactctgatgaggatgtgatcctggtggtgtctctgtacccttcactgacacctacaggtgcccctcccttcagaggaagagccagacctctggatcaagtgctggttattgattcccccaacaattctggggctcagtctctttctaccagtggtggttctgggtataagaatgatggtcctgggaatattcgtagagccaggaagcgaaaatacacaacccgctgttcatattgtggggaggagggccactcaaaagaaacctgtgacaatgagagcaacaaggcccaggtttttgagaatctgatcatcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttcaaaaataaaggaagatacaaaaactaaagtacaaattacctgaaactcagcacccttttgtaaccattgtcagccctttggtgaatgtccttccagatatctccctgtacctgtgtacccagatagatatatgtatagataagagtgaccaaatataagtgctgttctatactgtgtatttttcaccaaataatgtatctcgtggacttctatgtcgatgaatatatataaatatct

SEQ ID NO: 3544 - DNA, 57810 bp, human
ggaagcaaagaggattgtgggagctccgttgtgcgtcgcttaagtgagggcggcggatgggcgaaggtccggtgactgcgactgtcgctgctttctgaggccacaggaaaggggccgtcggtcgccgccatgacagcgagcgaggcggaggtttgtagcacttcttatgggctgagggcgtagacacatcctgcttccagcctagcaggcaaacgggaacggaagtgataggggatcagaagttgcgaggggatgaggagtaggggaaactgacaagcggacggacccggcggcgagaattgatggcgtagctgtaggattaaggggcgtgtcaactgtgttgtgtgtgttgacactgagatgtgtgaatcccctcattatttttagctggggacaggcggggtctatgggggagggggcggacggatgaatggaggataaaatcagggcgaaaacgtgttgtctgctgggcaccagtacatctgagtcacatctcagcaggatgattttattggaaagatctaggtccctggtttcagattctgctattgatgcgttgattgatttcccttaccaaaataccaagtacctgctctgtgctgggtactgcactagaggctccggatgaggaaaggaattaggctttttcctcgacatttacagcctgccggttgctatctgcatttggagacaggctattacaatacaaggagacagagatagatcctgtgttatgaaaatctattgggtgccaccgaactcatctgggagttgagatctgggacggctctttgatgcggtgatttaacatatattttgaagacaaaataagcagggcaaaaacgaagtgcaattttcctccaagcaccttccctccctgttgaggtgaactggagaactgagtagcatttaaggcccaaaattagtgtatttctttttttttttctttctttctttcttttttttttttttgataaggagtctctctacttctgtcgcccaggctggaatgcagtggcgtgatctccgctcactgcaacctccgtctgccgggttcaagtgattctcctgcctcagcctcccgggttgctgggattagaggcacccaccaccactcccggctaatttttatatttttatatttttagtagagacggggttttaccatgttggccaggttggcctcgaactcctgacctcaagtgatccgcctgcctcggcctcccaaagtgctggtattacaggcatgagccaccgcgcccggtccccacaactagtttatttctggtaagagcatttgcccatcacaatgggacttccaggcgcctctggaagaatcagtcttacgtgagtgcaaagcctgcaagctctgggtaggactacgatggaggtgctagttacttggttttccagcaaactcggttcacagcagggaattgtgcacccaccagaaatcctaagcaatatttctctgaacaagaaaagaagcctctttgtttaccagagaaacaacagtatagcagtctaagtcagtggctctcaaactttcctgtgaatcagaatcagatggagcgtttcttaaaaccaagattgctaggtcccatccacagagttgcccctacagttggtcaggagtggacccccgaatttacatttctaactagttcccaggagatgctgatactcctggacatggggccatacttggagaactataggtctaaacggagctgacaataaattggaaagaatatctcctggaatctcttagaacccgggaggcagaggttgcagtgagccaagattgcgccactgcactccagcctgggcaacagagtgagactctgtctcaaaaaaaaaaaaagaatatctcccctagggaaggctaggcacactcctaaacgtcaggcatgtctgaattcagacacagtagatatgaaataaaatggacttatttgacactgcttagaaaatctttttatttttatatttgtataattttattgtatatttacaaattgtatacatttatagagttcaaagtggtattttatatatatacaatgtagaatgattaaatcaaggtaaataacatattcatcacctaaaattttatctttttttacacaaaaatgactcaacatggaatttaatagtttttttgtggtgctaacatttgaaatgtactcttagctcttttggaatatgaaattttgaaatatcaccaccattctattctctgtgtttgtgggttccattgttttagattccacatacaagtgagaacatgaagtatttgtctttctgtgcctggcttatttcacttagcataatgttctccaggctcatcaatggacagattttcctgatttttgaagactgaataatatttcattgtgtatgtatagcacatttgctttatctgttcatccactgatggacacttaggttgatcccataacttggctattgtgataaatcctgcaatgaacataagagtacagatatctcttcgacatactgatttcaaattctttggatatatacccagaagtgggattgctggatcatatagtaattctatttttagttttttgaggaacctccatacagttttccataatggctgtactaatttatattcccaccaacaatgtatagggttgccttttctccatatcctggcctgttatctttcacctttttgataatagccattctggaaggtgtgagataatatatcattgtgattttaatttgcatgtccctagcgattagtgatgttgagcattttttcttatgcctgttggccatttgtgtgtcttcatttgagaaatgtctattcgggtcctttgtccatttgttaatcaggttgtctttttgctacttagtcatttgagtcccttatatattttggacattaacaccttattagaagtagggcttgcaaatattttctcccaatctgtaggctgtctctcccctctgttaattgttttctttgctgtgcggaaacattttagttcgatgtaattccatttgtctagttttgcttttgttatttgagcttttggggtcaaaccccaaaattcattgcccagaccagtgtcctgtagtttcttccctaggttttcttcttgtagtgttatggtctcaggtcatatatttaagtctttaataaaatggatgtgtttttgttgtttgtatgttttggatggtcgagcaaaggtcatcttcctgaactaaacaaagcaaattgtttttctccattgtacttgtcacagtgacttataccataaattgtttaaaaacacaaagtagcagttttctattcaaatcccttgctgatttttatatattcaagtagttgtttacagtggagttcacacctccactgtatcaacaacgaaaaatgaagtgttcctaatttctggtaataaattatgtttgaggttaaaaattaaaaagacaatgtgacaagctaattgacagacaaagattagtataagaagtcagaattggtaggtagttccacccccaccaataaaactctccctttagaagaaatacagttattcactgcatagtggcattttggtcaacgatggaccacatatattatggtagtcccagaagattataatggagcatatatagaaacctgatatacagcacttgatattggcattgcagatcagttgcggtaatgattgatgttcattattggtactggaacattttgttttccatatgagaaaaaaaaaatatatatatatatatacacacactctaggtttgtgtaagtacagtctatgatgttctcacaatgaaattgcctaacgatggatttctcagaatatattcctgttgctatgcaaggtgtgactgaaatcattttatttactctagaacacagaatcagaaatctcattttgttacagcttaatttgaagccttcctttagggggtggccctaaacagactcctggagggtggcagtccacagttatacctcccgttcaaaccccctcccatgaccctgaaaaaggctaggacacattttcagaaatttcactaatcattctagactcttgtcaatgcttcatcccaaatctcgctaggccagttacaaaacaaaataaatgaaaccccaaaccaaacactcagacacacataaaaagacaaccaaaaagtccatacaaactggcctgagtctattgtgagtctttgtaggggccagcaaggtgctagaatggccagtgccttggatgtttcagaaatctgttctcaggctgggcgcggtggctcacgcctgtaatcccagcactttaggaggccgaggcaggtggatcacctgaggtcaggagttcaagaccagcctggtcaacatggtgaaaccctgtctctactaaaaatacaaaaattagctggacgtggtggcaggtgcctgtaatcccaggtactcaggaggctgaggcaggagaatcgcttgaacctgggaggcagaggttgcagtgagccgagatcgcgccattgtactccagcctgggcggcaagagcgaaccaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttctcactcacaggtgggaattgaacattgagaacatatggacacaggaaggggaacatcacacaccagagcctgtcatggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataaaaaacaacacgaaacaaaaaaaacagaaaagaaatctgttctctatcatgtccatattccaaaggagtcagcgagacaaccacatatgactcctgaaaattaatcaacttttgcacgtgattggtgagcctctcacttaatgcttgtgcacttaccctgcacctccacagtagtcctcatctgtctaaatccacacctagtcttacaggtagtgttattttccgtgaaatgtgaggagataaaacaaacttatgtaagtttgaactctgtagctccatttcctaaatgatgcctgagtagtaatgatttaattttgttgcatgaacattcagtatctcagggaccctgagagtggacagatggttgtgaaggagaattttgggctatgggtgtcaaagcagcaaacgcgattactccagaattcaagttcagatgggattgttcccagtccatattttctgtgtgctacagctgattccttaaactaaactttaaatcaatatgtgtctctgacctgaagtggggtggggattctggtctggcactgaactactaggttatggaggtcggttttttctttggaatggtttttctgagggtaagagtccttgcatcaagtgagtgagaactgtaaaggagaggaggaaaagggtaatgataatgtcacgtttttgctttgcaaaataagattaggagaaaaatgaagaacacactaggaggaggaggaggaggtggcagaaataggattgtgaatctgggatctgcaactgagatgtcctatgcctacctattgcttttcccaaagcagaggcttaagcaccctgtgtgtgaagccagatttcctttaggtcctgtgactgtgctggggacagggcagctgttgccattgttattggaataacctttctgcacttgataaggtgataaggaggaaacctgggggaccagatctcatatacacatatatttaagatatatatatataactttaggggcattttaatagcttctggcagtctaaggatttatataattgtctgccaaaactgcagtgtaaaagagccaaatcgaaagtctgactgaaagctagaattcaggggatgggaagtgacctctgctaggaacgagttttcttatgcgaggtccttagaggagtcgtcactgccctctagcccaagaccaccaggaacacacctgtggttgaacaggttgggttgattgctcagtgcattacatggagggagagcgcacaccatgggcgctgtggtgcttctctgttggagggtgtcagaaaggacttattacgggatttgaatctgtgttaggtgaatttggggaagatttaaagaagtgaggctttgccctggattggactctgttaggaaatgggaataattctgtgattgtgtatcttaatgactcttatccagaaggaggctaattggtaaagtagcaccggtcactgttagcaaggatagcagagtgtttggtcatttttatggcttagtcaaagttcatgttttgtttcttcagatacagttatgaggtggtcttgcttttttattggtcactgtggtcacatattggccttgtctgatagtggcagtttatgaaattgttatgttcatcgggagaacaccaaggcccagctgtgagtgccaagccagttgccacatgtcagtggttgctttttttcctccagagtgatcagcactgggtccagcagcttattggaggccagatttcctggccatttatagcagataaatagtcagatatgctgaacaggaaagcttggggctggatgtggatgaaagcatttggttaccttcttttttttttttttttcttttttgagacagagtcttgctctgtcacccagactggagtgcagtggtgcgatctcagctcactgcagcctccgcctcctgggttcaagtgatcctcctgcctcagcctcccaagtagctgggactacaggtgtgtgccactacacctggctaatttttgtatttttaatgaagatggagttttgccatcttggccaggctggtctcgaactcctgacctcaagtgatcctcccgcctcggactcccaaagtattgagattacaggaatgagccactgtgcccagccctctggttactatctaacagagcttaggagcctcagttaaaatattagtctcctgaggtggtttttccctaaaaaatcagatcaaagtatacttaagcaggagaagtacatgggagaaagtggcagattgtatttttcagagatggccaccgtagtacctgtcatcccacactctcttctgtaatgtgaccttgccacccttccattgagaagtagggtcaaatgtctcctctcctttgaatctgggccaactttgattatattaaccaatagaatagggggcagtgaaactgtgacttctgaggctaggttatgagaggcagtgtagcttctggctcacctgcagtgacattcacctttagagccctgagctgccatgtacaaagtctgattaccctgaggctgccatactgttagaaggcccaggcctatggtaaggccacctataggtcctctgatcaacagccctagccgaggttccagctaatagccaacatttaccagtagcctgtaaatgaaaactcctaaaggattacggcccccagccttctggttttcccaggtgaggccccagacattatgaagtagaaacaagctatctctgctccatgatgtctcaattcttaaaccacagaatcctagaacaaagtaaaatggttgtttaatgccactaaatttggattggtttattacgaagcaatagtaattcaaacagaggtggggagtttggttaacataaaaggattgaagtaaaaggagcaaggaaggcaaatagttggtagagaagaaacaggctggtacacaaagcattttgctttgctgctgatgaggggctttttgatcccagagacttcagagtggacagaagtggacagtagaggggaaaatgggaagataatttatccattatgctaaatgaaactgctgtggataaatgaaaaatctatagataattgtgcctccttttaaaataagatcttgaactatttattttttaactgaacatcttgattaaaactaacagaagtgtgtggagttttttgtaagtaaaaagtagtaataatattaacagtggccaactattcagtgagtaacaagatttttttttcttttttgttattatactttaagtactggggtacatgtgcacaacgtgcaggtttgttacataggtatacatgtgacatgttggtttgctgcacctatcagctcatcatttacattaggtatttctcctaatgctatccctcccccgtcctcctaccccatgacaggcccctgtgtgtgatgttccccttcctgtgtccaagtgttctcaatgttcagttcccacctatgagtgagaacatgcagtgtttggttttttgtccttgtgatagtttgctgagaatgatgatttccagcttcatccatgtctctacaaaggacatgaactcatccttttttatggctgcatagtattccacggtgtatatgtgccacattttctttttattattattatactttaagtttcagggtacatgtgcacaacgtgcgggtttgttacatatgtatacatgtgccatgctggtgtgctgcacccattaactcgtcatttagcattaggtatatctcctaatgctatccctcccccctcctcccaccctacaacagtccccagagtgtgatgttccccttcctgtgtccatgtgttctcattgttcaattcccacctatgagtgagaacatgcggtgtttgattttttgtccttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcacgtgtctttatagcagcatgatttatagtcctttgggtgtatacccagtaatgagatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgctattctaactggtgtgagatagtatctcattgtggttttgatttgcatttctctgatggccagtgatggtgagcagtttttcatgtgtcttttggctgcatcaatgtcttcttttgagaagtgtctgttcatgtcctttgcccactttttgatggggttgtttgtttttttcttgtaaatttgtttgagttcattgtacattctggatattagccctttgtcagatgagtaggttgcaaaaattttctcccgttttgtaggttgcctgttcactctgatggtagtttcttttgctgtgcagaagctctttagttaaattagatcccatttgtcaattttggcttttgttgccattgtttttggtgttttagacatgaagttcttgcccatgcctatgtcctgaatggtaatgcctaggttttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgccagagatcagatagttgtagatatgcggcgttatttctgagggctctgttctgttccattgatctatatctctgttttggtaccagtaccatgctgttttggttactttagccttgtagtatagtttgaagtgaggtagtgtgatgcctccagctttgttcttttggcttaggattgacttggcaatgcaggctcttttttggttccatatgaactttgaagtagttttttccaattctgtgaagaaagtcattggtagcttgatggggatggcattgaatctataaattaccttgggctgtatggccattttcacgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagctgcttatcagcttaaggagatttggggctgagacgatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccttgtcttgtgctggttttcaaagggaatgcttccagtttttgcccagtcagtgtgatattggctgtgggtttgtcataaatagctcttattattttgagatatgttccatcaatacctagtttattgagaggttttagcatgaagggctgttgaattttgttaaaggccttttctgcatctattgagataatcgtggtttttgtcgttttttctgttcatgtgatgggttatgtttattgatttgcatatggtgaaccagccttgcatcccagggatgaagccgacttgattgtagtggacaagctttttgatgtgctgctggattcggtatgccagcattttattgaggattttcacattgatgttcatcagggatattggtctgaaattctctttttgttgtgtctctgccaggtttttgtatcaggatgatgctggcctcataaaatgagttaggcaggattccctctttttctgttgtttggaatagtttcagaaggaatggtacccggtcctctttgtacctctggtagaatttggctgtgaatccgtctggtcctgaacttattttggttggtaggctattaattactgcctcaatttcagaacctgttattggtctattcagagattctacttcttcctggtttggtcttgggaaggtgtatgtgtgcaggaattcatccatttcttctagattttctagtttatttgcatagaagtgtttatagtattctctgatggtagtttgtagttctgtgggatcggtggtgatatcccctttatcattttttatttcgtctatttgattcttctcttttcttctttattagtctggctagtggtctatgtattctgttgatcttttcaaaaaaccagctcctgggttcattgatttttttgaaggggttttcatgtctctatctccttcagttctgctctgatcttagttatttcttgtcttctgctagcttttgaatttgtttgttcttgcttctctagttcttttaattgtgatattagggtgttgattttaatcttcctgctttctcttgtgggcatttagtgctataaatttccctctacacactgctttaaatgtgtcccagagattctgatacgttgtgtctttgttctcattggtttcaaagaacatctttatttctgccttcattttgttatttacctggtagtcattcaggagcaggttgtttagtttccatgtatttgtgtggttttgagtgagtttcttaattctgacttatgatttgattgcactgtagtctgagagacagtttgttgtgatttctgttcttttacatttgctgaggagtgttttacttccaactatgtggtcaatcttagaatatgtgtgatgtagtgctgagaagaatgtatattctgttgatttggggtggagagttctgtagatgtctgttagccctgcttggtccagagctgagttcaagtcctggatatccttgttaattttctgtctcgttgatctaatattgacagggggtgttaaagtctcccactattattgtgtcagagtctaaatctctttgtaggtctctaagaacttgctttatgaatctaggtgctcctgtattgggtgcatgtatatttaggatagttagctcttcttgttgcattgatccctttaccattatataatggccttctttgtctcttttgatctttttataaacaactcaagataattggctgaaaatagttagtgagacttccccaaaggctcgtcagcataggcaactacaatattaaatcttgttactctgatttccagcaagatggccgaataggaacagctctggtctgcagctcccagcgagatcgatgcagaaggccagtgattctgcatttccaactcaggtaaaccgggtctggagtggacctctactgcttaagatctgttttatcagagactaggattgcaacccctgcttttttttgctttccatttgcttggtagatcttcctccatccctttattttgagcctatgtgtgtctttgcacattagatgggtctcgtgaatacagtacactgatgggtcttggctctttatccaatttgccagtcttgtcttttaatttgagcatgtagcccatttacgttcaaggttaatattgttatatgtgaattttatcctgtcattatgatgctaactggttattttgcccgttagttgatgcagtttcttcatagcgtcgatggtcttacaatttgtcatgtttttgcagtggctggtaccggttgttcctttccatgtttagtggttccttcaggagctcttgtaaggcaggcctgatggtgacaaaatctctcagcatttgcttgtctgtaaaggcttttatttctccttcacttatgaagcttagtttggctggatatgaaattctgggttgaaaatttttgtctttaagaatgttgaatattggcccccactctcttctggcttgcagggtttctggcaagagttttgctgttagtctgatgggcttccctttgtgggtaacctgacctttctctctggctgcccttaacattttttccttcatttcaaccttggtgaatgtgatgattatgtgtcttagggttcttcttgaggaatatctctgtggtgttctctgtatttcctgaatttgaatgttggcctgccttgctaggttggggaagttctcctggataatatcctgcagagtgttttccaacttcgttccattctccccgtcactttcaggtacaccaatcaaacgtagatttggtcttttcacatagtcccatatttcttggaggctttgttcttttcttttcactcttttttctctaatcttgtcttcttgctttatttcattaagttgatcttcaatcactgatatcctttcttcctcttgatttatttggctattgaaacttgtgtatgcttcacgaagttctcatactgtgtttttcagctccatcaggtcatttatattcttctctacactgggtattctagttagcaattcgtctaaccttttttcaaggttcttagcttccttgcattgggttagaacatgctcctttagcttggaggagttcgttattacccaccttctgaagcctacttctgtcagtttgtcaaactcattctctgtccagttttcttccctgctggtgaggagttgtgatcctttgaaggagaagaggcgttctggtttttggaattttcagcctttctgcgctggtttctccccatctttgtggttttatctacctttggtctttgacgttcgtgacctaccgatggggttttggtgtgggagtcctttctgttgatgttgatggaattcctttctttgttagttttcattctaacaagtcagttggagtttactggaggtccactccagaccctgtttgcctcagttggaaatgcagaaatcacccgccttcttttttttttttttttttttgagatggagtctcgctctgtcgcccaggctggagtgcagtggtgcaatctcggctcaccgtaagttccgcctcccaggttgacgccattctcttgcttcagcctcccgagtagctgggactacaggcgcctgccaccatgcccagttaattttttttttttgtagttttagtagagacagggtttcaccatgttagccaggatggtctccatctcctgacctcgagaaatcacccgccctctgcctcggtcttgttgggagctgcagaccagagcttttcctgtttggctatcttgccggaaatcagagtaacaagatttaatattgtagttgcctatgctgacgagcctttgaggaactctcactaatcattttcagccaattatctcgagttgtttataaaaaacgatttctactttgctttggttatgtgaatgtttgcctcagtatatcttatttgaggtgtttaacatatgacacgtggctagcgttagtgttgaaactgtgaagacgtttagctgttcaatcttccttggtaatagtacttagttatcagagattgaaaagacatttgctcatctctgtctcattgtgtgagaggaaaacacagtgttatttccaatgacatgtatggaagtttcattcttttaatctggcagaaactggttcagttttttttgaaacagggtctcactgtgttgacagttggagtgcaacagtgagatcatggctcactgcagcctcaactcccaggctcaaacaatcctcccacctcagcctcccaaatagctgggactacaggagactgccaccatgcccagctaatttttgtgttttttgtacagacagggtttaaccatgttgcccaggctgatcctgaacctttttcttttaaaagactagtcaagcatagtagtgagaaggctggttcacttttaaagtctccatatgtggccacattttagattttatatacatcaatagtttttgctgggtaacctattctatctgtaggtaagaatggaagtcctaggactgggtgtggtggctcacacctgtaatcccagcaatttgggaggccaaggcaggtgggtcgcttgagcccagtagttggagaccagcctgggcaacatggtgaaaccctgtctctacagaaaattcaaaaattagccaggcgtggtggtgcatgcctgtggtcccagctactcgggaggctgaggtgggaggatcgcttgagctgaggcggtggagactgcagtgagctatgatcactccagcctgggtgacagagtgagactctatctggaaaaaaagagtagtagaagtccttgtactgttggaattgtttaatcagtgagcattcagagatattggttataaatgttgagtatggctaccaactgaccacatggttatgggccaaggtacaaaatgtctgagtcacttgttttattgtaaaaattcatgtgaatgtctaaggttttgaagatttacacctgtgttttctaggagttttacatttttctttcctatgcctttgttttgttttcaggtaagtttggcatgtggtgtaaagtaggagcccagctttgttttccaggcgcatatccagttgtcccagcagctggatttcacagcttactgcgattgcgaggcttctggttttcaaggctatcactgagcaaaagagagggggatgtgaatagggcaagttaaaaggccacaaagatcagtgttcttgctaagattcagttgttttcttgaataaatgctccttagatcgctgcaagcttttgggtaatttccagaatattgaaaaacttgattttaacaatttttgccaatattctctttgctgatttgaggagcagattttttggaggttcttactctgccattctgaaaatgcctactcataagtttctgttttgcctggggcataatcagatctccgtatgaaataataattttgatatatgtgtatatttgggtcagaacttcttagcggtgggcaggatttggactgaccaaaaaaaatgcttaaggtggccttctcctgtctcttcaggactctaaaagactgtcctgggtggaggctgggctgtgttcacaagcaggccagtgggtgagaactatgggcagccagtgagaccatgtcatttttgtccctgccagactgtttctgtgctcatagacatatgaaaacatctggagatacgtttgagctcatttttttccccagagatggacttccaatttcctctactgtttatggtattccccagaaaatttgttagacttggacctctcctttagaatgaatttgggagagaccaatgttaaagggggtaattggagagaccagggaaggcttcttgcaggagctatgagttttaacctagttctacagagtgagcaagaggtgattagttgaagaaaataggtggtaagaagtagttcaatttaacacaagccatggagattatatgtaattaaatcccctcactgaaccaatgcaagaataaaagccaggcttatccctgggagaaagccagaaactatgctgtgatacacacacacacacacacacacacacacggaatcctgtctctacaaaaaagacaaaaattatcagggtgtggtggcacatgcctgtagtcccagctgcttgggaggctgaggtgggaagattgcttcttgagcttgggaggtccaggtggcactgagccttgatcccactactacactccagcctggggaacagagtgagactctgtctcaaaataaataaataaataaggaggggaggctgtatatcatagtcataaaaaattcaagacctgatgtcagacaacttaagttcaaatgccagatcttctgcttattggctgtgtgaccctgggaaacttactttatctctttggtcctattatatttgtaaaatgggaatatctacctgcttcacaggtttggtgagaagtttaaatgagagaatgcatcaatagtgcaaagcacaatgtcttgcatagagtgtttactaaaagccacattttattttatttatttttattttatttatctgtttatttatgtatttatttatttattgagacagagtcttgctctgtcgccaggctggagtgcagtggcacaatctcggctcactgcaacctccgcctcctgggttcaagcagttctcctgcctcagtctccctagtagctgggagtacaggcacacaccaccacacccagctaatttttgtatttttagtagagatggggttttgccatgttggccaggatggtctcgatctcttgaccttgtgatctgcccgccttggcctctcaaagtgctgggattacaggcatgagccactgcacccagcctatctttatttttttgagatggagtttctcactctgttgtctaggctggagtgcagtggtgcaatcttggctcactgcaacctccacctcccaggttctagcaattctcctacctcagcctcgcaagtagctgggattacaggcatgtgccaccacgcccagctaattttgtagttttagtagagacagggtttcaccatgttggacaggctggtgttgaactcctggcctcaagtgattcactgggctcagtctcccagagtgctgggattacaggcgtgagccactgcgcctagccaatttttatttttgagacagggtcttactctgtcagccaggctggagtgcagtggtaccatttcagctcactgcaactgatagggaaggggaaagggaagtactgggaagggaagagcatgatccctttaaatgatatggaaggagggaagagtgtggtccctggctaggcctctacccccgggcctatgcccatggacctgggtgaggacaggcatttttgttttcctgcccaaatgttgcatttcccaagaccaccctggcctgccataccaccatcctgtgcctataaaaaccccgagacgctagcaggcagacacacatgtggctgggcattgagaggagcacatcagtggaggaacacacaggtggctggatgtggagaggaacgcatcgacagttaccagcacgccggcaggccattgagcggcagaacgacacggagtttggctagggcagtcagaaaaaacctgggccgcaagcagcctgactccagaggaaaaccatctcccttctggttcccccgtctactgagagctacttccacttaataaaatcttgaactcattctccaagcccacgtgtgatctgattcctccagtacaccaaggcaagaactccaggatacagaaagctctctgtccttgcaataaggcaggggtcgaattgagctaacacaagctgcctacaggcagctaaactaaaagaacaccctgtaacacacgcccactggggcttcagctgtaaacattcacccctagacactgccgtggggctcccagcccatctgtatgctcccatagaggtttgagcagtggggcactgaagaagtgagctacaccccccattgcacaccctgcaaggggtacgagagaacttttcctttttcacaacctctgcctcctgggcttaagtgatcctaacatctcagcctccccagtaactggaagtacgggcacgtcaccatgcctggctaaattttgttttttttttgtagagacgccgtctccctgttactcaggctggtctcaaactcctggcctcaagcaatcttcctgcctcagcctcccaaagtgctgggattacaggcgtgaaccactatgctggctggtgggcagccacatgttaaatctctgagtctagccataaatccaaatatcaaatgcacaaagcctaaaaaccgtgtgagtgtggtcaaaatagaaactttttgaatgcgttctgaaatttatttctgttctgttcacttttagaatttggtagcatcttgaaaatgccaacttgtctccatcatgttaggaagaatcatatggagtgttttgttttttttggtctatatttgagacagaacatctgtgaacaaaaggtctctgaaaaggagactggaagaaagagacttccagtgaacagttgcaaacccaggagtcacagcctccagtgtaaaacaaaagtacatttataacgaaggattgaagcatggttagttctgattggtcaatgcagctgagttctggttggtccatatagcatagccctgattggtcaacacagctgagctctgattggctgaggaagatgagctctgattggttggttcagggaagcactgaaagtctgaaagataaaagagtgcaggttttcagggaactcagagtatgtgtgtgacccctagtcggcaaatggctcgttggctttattttacatttaggcccagtgagctgctcaagatccatcttgaaggattggctttttcaggtttatgtttgttcacacatgaaaggaggagcactcactttggggcttggggggtgcagggctacagtagaggcagggatcaagcagagcgtatctccaggggttaggtgagattcagagggatggagtcaagttcctgatcagctaaacctcctactaggagattctactacctgaacttttatctccttgaatttgggaggtacaaggtttttatttattgaatcatcaaacatgcattgaggcgggggttacagtagtttgtttgtttgtttgcttgtttttaactattgcatgagttctggacccagggcaggcttgaatctgagctctagcatttcctggctgtgtgactatggacaatttacccaacctttctgttcctcttttgcttcatctgtaacacgaggataatcatattatctacctcactgagttgtgagcattaaatgggataatacagatacagtattcagtgctcaacaaatattaaatattataataattattttatagtggttggaaatatggctattttaattctctgtgtacatgtttaattctttacatggtcaactggttttgttcatcattgtttctcctctgcctgtctgttctaggtacgacacttacaaatttgttgggtgcatgaatgaatgcgtacaggtaaacatttataatacaatgagaggtgctataatagagcttgagtacaagacactttgcaggacatggagaaggatatgattaactttgagcagttccgaaacagttcactgagcgaggctgttcccttctagaattttcacagtgcagtgggctgtcagagcaaactgcactggggaattaagtaaagggatgctagatagccaccaggtggcgatattgcagaaggattcaagtagcggaggaaaggagcagccctcttccagccaggagtccatgttcctgtccacgtcagattttttctcctgtccacgaaagttcaagctgtgatttctttccctttgttctgatggtcttggagcactgccgttcctgcccaaggctgttttggagctgcctagtgctccagccattctgtcattaccagacagaggacagaaatgatgctgtttccagttcttcagttgttgggcttctaattcttacatcactgacctgccgtttcctctgctatgcctcccatgatggagttaaaggggtgaggggagaagcaaaactgacatcttttgagacttccggcactatgtcagacatatatacatatataatatgtatgcatattatatacatatataatgtgtatgcatattgtatacatatataatgtgtgtgttatatgtaacataaatacataattatatattttgatatgtgagttgtgagccattttatatagtgggaagctgaggctcagagaagggcatcttttcagtattcaaataaaattctctagttaatcaaagttggtatcagatattggagatacaaagattaggaagatgtggttcctacccctaagtcttgtgctcctgtaatactctgtgggtgtgtctatcacaggacttattgcatcatgttattagtggttatttatatgtctgtcttctcagatagatggtaaattccttaaaaggcagcagccatttcaagcattcctcatacttagcataggctccagtacatagtagatatttaactactgtgaggcacagaataattgtgtctgattgagcagtgggaactagtgaagagtttcaagcagggcagtgacatgatgagtttttcgctggaggtgggtaacaggttgcccattggattggagcagtgagtggaggcaggcagggaggtgactgtggcagagtctgtgctagaggggatttaggccagaacgagggcaatggcagtgagtatggagagaagacaggttggagagttattgaggacatgaattaggatttggtcgtttcttagatgtggagatcgaagaattccaggcttgggtgatggtggtgccagcaacaggttcagagtaaagaggggaagtgggtttggggtgggaaacacgagttcggttttggacatgctgaggttgaggtgtctattcagggggtgtgatatatcaggatgtgtgaaaccaaaactcaggaaagaggttaggagtgaaaatctggggatcatgaagctgtcggtggagcttagaagcttgccaggggatgccatcactcaggggcaggacatgcagtgaaacaggaagtgggctaaggatggaacctgggaaccttgacacagatgggctgaagaatgagaaacccatgagaaagatggaaaaagaatagccagggagattggaagcaaaccaggagggtgtggtgccacagcagccaagggaggaaagagttcaggagggagggaacacgggagtggttagtactttagaggcaggtaggaagttgaaggtagagagtaattcagtgtggctgggctttggggcatcatggaggagtggcaggagatgagcccagaaagtccattcgggctcttatgcaaggaaccttggtcaccaggctaaggagttaaggctttattttgtaggaaaggaagaatcattgaagggtttccaataggagtaacatggtcagatcaaggtgtttcagaaaggtcaggctgaggcaatgtggaggacgctgtggaggaggcagtgactcattgaagtgatggaaagtggcttttgggctgtgaaagaaggcacagtcttccaagatctttagtaggtaaaattgagacgccttgaaaatggtagttaacactcattgagcactgttctaagtgcttacgtgaatgatcttaattctcacaacccacctatgaggtacattaacatcattttatgcctaaggaaacaggaacagagagataaagtaatatgctgaacagaactagtaagtggcagagcctagattcaaactcaggtggtttggctctaacccacactcttaacttcagtgttgttttgccttgattagatgtggggagtgagggggttgtcagttagcatcaggttcagctgtgagttattagccatccaaaataacttatggactttctgtcctatcgtctccaccgtgtgacacttgtcctctggtcattgcatttatgtttcaagcagtaaaatactgggtagggggaaggggagaacagatgttggggaacaacagaagtctctgctgtaagagaaatcccaggacactgacatttgcgtggaggatgatattgccacacattgaagtggcaaccacaggaaacctgttagacctttatcatttgacagtttcttttcccagaatccttcctttgccttggaaatgaacccctctgtgactctggtgtgctgctcctctcctgtctagccattcagtgctcatgagagcttccaatcatagtacctgtctccctggccacagttgattcgattggttgaggtgtggcatgtggtctaggtcaggacaatcagaatgtttttcttcaatttttaaaaatttaattgagggaaaatattgcctcttggttttgtggcacagctaggagatgtgtggccagaagctgctggtggccctttttacagccacggggaggaaacttgtttcagagaatgaagtgaacttacaggaggagcaattgaaagattcctgttcatgttcgagtctctgattgtacttgtccttgaggctcatctacttatgattatgtgaaacttcgggtaaattgactctgtggcccaaatggtgtttctattacttggaatcagtaaagtcctaattaaatctgtgttcaaataggtaattctggaatcaatgcagatgtgtttagggtttctgtgtgtgctgggggtcatagtaaatagtaaccagaagcagggaggcaatttttgagactgttttaatggtctacatgaaaaacaataagaatctgaactaagacagtgtcggtgggtgctgtaggtcctggccaggcttgccactcccagtctcttctaccttctagactgtgaaccagccacccacctctatagggtgctcatctttacatggttgcagtacagctggtaactattcattatgagcatattttcctctgtgtccttgggaatcattataatagctggttaaaaattcctgtctgctaattctaacatgtcagtcatctcagggtcagtcttcattgattgccttttttctttggtataggttacatttttctgtttcccataggaaacgtgttcaatcattttgacttttctcaaaacaatgttcagtcattttgacttgtctcctggctattgcagaggacatgttctagagaatctggattccattatatccctctgaaaagtattgacatttttgtttcagcagcatttaacttgactaaactcaaattccatgctctgtctccctcatggcaggcagcaactgaagtctctagtcagttcttttagccttatacagactgtttggagactgtcccatgaatgcataattcagaggtcagccagtgatttggtagagtttatacacagaattcagggctctgcctatctggctctctccattccaagattttatccccacagttttcagctgctgtggaaactctgaactctgtcctcttgtcttcaagtcagtaaggttcacccatcagggaattgattggggcctaccctgtggttcaaagtcttaaaaatgggaatctcatttagttctgatctcttcttttaaatgtagattctcctccagtttctgcctgccttgggttgcttgtcaatacttgcaggtaattaaaaaaaaattttgtccagggtgtatagttgttacatctgaaggaggatggatttgataggagctatttggtcatttactagaagccagaatctgtctggtcactgtgatgtaacctgtggtgtgtgtagccacgatgtgctggcaatgtattaagaaattatacacaatctggatgtgagatccagatgatgaggcttgataaaggcagtttttataatcacactaaatgcaattgatgtttcaggacggcatgttcaggggcataaggagcttgattagccagtaagcccccagttggggcttcccaggaactgaagtaacctcaccctagaggttaccgaaaggcaacatgccattgctaccaacttgagtgcctctccccatgtggagtttaactcattaaatatctcctatcctgatatctctggatcacctctgctttacaaaaaaatgtgtttgagtgtattatagtaaatgttaatttctatatggtttacagatcagaatgatgaactgagacccccatctagtcctctgccagagacctagtatttaggatggagaggaatagataaattgacaagctttttagcaagttgaatggtcggggatcagtgacagattgtattcagtataataggagagatggtagagttaaggatgacgtccaagtttcagccttgtgcatctaggcgggtggtaaatacaggagagaaaacacaaggaagagagcacgtgtaaggaagacgaattaagctttggctgtttgaagtacccgctggacatctaggtgagtacatgagattctggatcactggagagaagtctgggatggcgatatatattgaggaatcaccagtagataagtgatagatgaggctataggtgtagttgatataactaggtagcatatacagagtgagaagagaactgatagcaaaacccagtagataaggggagagcctaagaaataagtcactttaggagactgaagaaaagacaaggaaaggtgatatacagaagctaggggaggagaatttcaagaaggaatttagtggtcaatagggtccaattccaaaaacaaaaacaaaaaacaagcaaaacaagtactgacaggcatctattggatttaacaactaagaggtctgtctttacctcaaagattacaatttcaatggagtgatgaggaatgcagtggtttgaggagtacatgggggcggtagtctgtaacatgtggctcctatcaaccaagcctccaagtaactgtacctctgtgtagtccccctactgctcaatctggtgggccctgtacaaaagtttaactgaaagaatgcagggaattaatgctgcttgacttccaaggataggttgtaagaatcctgtaacttttgccttggtcttttggatccctcaggaaccatgtaagaagtctgactgccctgctggagaaatcaaatggagaggtcaagagacaacatggagagagaacgcacagcccagctgagcccagctttccagttatccccaccaatgcgccacacatatgacggaagtcattttggtccctccaaaacaacctagccagccagctggataccactgagtgacctcagtagatgccacgtgggacaggagaattctctagtgagctttgcccacattccttacccacacagtcatgagtataattaaatgattattgttttaagccccaagttttggggtggtttattacacagcagtatataactggaacattgggcactgaagtagtggaaaccatacatgcacgttatatttccgttaaacttggaaagggaaagatctgatggagtgggaggatcacataagatcaagggagaatttttatgaagatgacagagacttgggagtgtgcatatgctgatggggaagagttaggagaaagagaatgttgaagataggggagagaggagatggctgatgcatgaggtttatgagaaggtaagggaagggatgagatgcaaaattctgctggacagactgatcttgcttacaaggatagtgggatgcttcgccttgtaaaacaggaagtgtctgcccacctcctgttctttaaaaatgtcaagcatatccatgtactagagtcgagagaatatatgaaggttagttggacagtactggatctcctaagaattgtttgactgaagccctttctctggattgctgactcaacccaggctggagttaagtgattggaatccacaccctcggaccagaatccaagttaccttctgctaaagccatacatacacattaaaaccacacttccacagagtcagcttgtctgggctcaatgggctctcaaaataatacagggttccattacctctgacccagaggttctctccaagagaaagagctgttgatgttacaattctgcctgtcactgtccctgttatagcagggagtgcgtactggattagtactccccagaaggatgtatggtcagttggattggtggtggatggcagtttgtaccaaaacgtcacttgaacttcacctttgacagctgcagacttccgcgtgctgataaggaattaaagaaagtggaaatgcaatgcagtccaagataaactactttacaaaactttgtcttatggaaaatcacaaacatacacaaagttagactagtaaaatgaatccccatatacttatcatccagcttcaacaattacagtgtctgctcatcatttgaatggcacacacacacacacacacacacacacacacacatacatttgtgtggatatatatgtgtttgtagttttatatatataaataaaactacatatatatttatatatatagttgattcttatatatataaatgtagttatatatatatacatatataaaaagtttattattattattcacagatttcatatttgcaagttcacttacttcagacttatctataaccccaaatcgatacttgcagtgctttcaatagtcattcatagacctgcacagagtggcaaaacaatttagttgtcaggcactcagtgttcccagctgaggttagaaaaggcaatgttcttgtttctgctctcatactgtaagcaagtgttcttttcgtagtcgatctagtgccatatttttgtggcttttttggtgattttgctgtttaaaatgtcccccaatcatagtgctgaagtactgcctagtgtttctaagagccagaaggcagtgatgtgccctgtagaggaaaatacatgtgttagataggcttccatcaggcatgagttataacgctgtctgctgtgagttcaatgttaataaatcagcaacacagtacatccagaaaaaggaataggaaaggcttgccagtctatatgtgaagacgctctgtatggtgctaaaataacatctttagtgtgtgatgaaggtatggaataaatggaaaagcagcaaaatttgtggattcataactactgattagaaaaagcatagtggacagcatggttgtgaggcttttgaaaaccaaagaaatttatggttatgttaacccaggatcaggaaaatgttaaacccttcttggctaatgttttactataaaatactgcatataatttattattttaagaaatatatattaaagaaggtgtctttagacagaagcatacataaaacaaggttgtgtattgatcattttaaggaatgcaaccagaggctcccaggaatctaaacctgtatttccactaggagcagtggcttggtatttggtaattcattgcttgaggtgactttatagaatataactaccacaaataatgaatcaactatacatacatgggtgtgtgtgtgtgtgtgtgtacgtgtgtgtgtctgtgtctgtttatgtgtgtgtgtgttttggagtactttagtgcaaattgctgacatcttaacattttatctgaaaatgtttcattatgtctctctaacatattggttcttaaagtgtagtgtgaggagtcctggagacacctgagacagaccctttcaggtgactgggaaatcctttttccaactacatatctccatgaggttggatttgtcttcatatactttatccaaaacagcatgttacaacattaaatgcagaagcaaatatgggaatctagctgtcttgtactgaggcagacatttaagagattttcagaaacgtaaaacattcctaaattctttgtttctgaaaatgcaattattttaataaaattttatttacgataatcagtggatttattttaaatacattaatacaaattttaaaatttttcagttttgatttctaatataataaatattgatagatctgtaacctacattagcaaaagctctttagggtctaaaagtactaatattttcaccatctgtatataatttttatttgtaaatatattattaaaataactgtcactttagaaaacataataatgctttttacaaagaagcactgatacacttctttttagcactgtttgtaaaacttgtcaaaaggaggaggaatttttaaactaccccagctgtgcacggaagacagctaacacaggaaaaacaagtctagcaaagaaattcgccaaggctactttctgccaccctggaatcccacactagttttttttttgtttgtttttttgttttttttgagacagagtctagctctatcacccaggctggagtgcagtggcgtgatctcagctcactgcaatctccacctcaccagttcaagccattcttgagcctcagcctcctgagtagctgggattacaggcatgtgccaccatgccaagctaatttttgtatttttagtaaagactcggtttcaccatattggccaggctggtctcgaactcctgacctcaagttatctgcccaccttggcctcctaaagtgctgggattacaggcgtgagccaccacacccagccccacgctagttatttttaaaaattattttaaggtaattatagactcacaaggaagttgcaaaagtacagagtcccatgtacctgaaaccacgcttcctctaacggtggcaccttacgttattatagtacaatatcaaatccaggaaattattacaagattgttaactagaatatagacctaatttccaccattttacatgcatttttatgtgtgtgtgtttttctgtgtggtcttatcccatgtatagatttgtttaacaaccaccacagtcatgatataaaactgttcaataggacctcccttgtgcttccccttcataatcatacccaccctgccccatccttgctccctggcaatgattaatctgttctgtatctctaaaattttctaatttcgagaatgttacataaatagagtcctatacaatgtagtcttttgggattgacgttcttcaccaaatgtaatccttttgagtcatatctgggttgttgtgtgtatcagtaatttgttccaactgagtagtattcccttgggtggatagaccagaatttctttatccaattactagttgaaggacatttgggttgtttcctcgttttgcaattacagataaagttgctgtgaacatcagcatgcaggtttttgtgtgactataagttttcatttctctgggataaatgcccaggaatgcacttgcagggtcatatgataagtacatgtttagtctcataggaaattgccagaatgatttccagagccttaccattttatattcctaacatcattgtatgagagatccattttttctacatccttgtgaacatttggtattactgttttttattttagccattcttataggtgtacaatgatagcttagcttattgtggttttaatttgcatttccttagtgactaatgatgttgaacatgtttttcatgttctttgccatctgcgtattctttttggtgaaattctattcatgttcatgctcattttctaatggaatctattttttactttttttttggagacagggtctcactctgtcacccagattggagtgcagtggcacaatcatgtctcactgaagctttgatgtggactcaagtaatcctcctgcctcagcctcctgagtacccaggaccacagatgtgcaccaccatacctgactaatgttttaattttttttagagatggggtctcactatgttgcccaggcttatctcaaacccctggcctcaagtgatgctctcaccttagcctcccaaagtgctgggaatacaggtgtgagccactgtgccaggccttctaatggaatatttatgtcttttttactgttgaattttgagagtttcttttccttttctatctcctcctaacaagtgcttttgcccagactggagtgcagtgatgtgatcgtagctcactgcagcctcgaactcctgggctaaaacgatcctcccacctcagcctcccaagtagctaagactgcaggcatgtgccaccatacctggctaatttttaatttttttgtatagagactgggtcttgtaatgttacctaggctggtctcaaactcctggcctcaagtgatcctctcgcctcaacctcccaaagtgctgggattacaggcatgagccaccatgctgggccagcttgtgtgtatctatgaaaaatccctctgggattttgatagtaattatgttaaatccatagataactgtggggaaaattgacatctttattatattgagttttgcagtcactgagcactgcgtgtatctccatgttttcagatctttgctagctttctttcatcaagttttacggaaagggatggatgtacttacgaactctcagtggcttcatcctggcagagaacaggaatgctgcttgctctgtgaactctgcagcctcagtgtcctcatttgtggtgacagctccctcttaaggtcattgtaaagatttaaggagatgctgaatgcccaagtcctgcctccagtatatgtgcttttctccttaacttcccactcattaccttttgggccttgagttttcatctgtgaacccacataggataatagtgggactgacttccaaggggttgttgtgaggaatgggtatgagaattcaagtaaagcaccaaagagactgccagacacagtaggggtaccataagcagtagctgttattacgatatgattgtagtgaggtgaaactataatttcttcctttcactgacagaaaactctcaagcagctggtccaaagagcataaacagcacaaggcaagtagcaggatgttgctgaaggtttgggacagtggagagggtttattttagcacagcagacaatatgaaagagagtatcagaaccacgtacctgctatgacccaacttttatagaaaaagaacaagaatagatatgtttgtgtttgtgtaaaagccgaagaacaccccagaccagactgtgggaagctggggaactttcacttctacttattcccctttctgtgtttgaaagttgttttttggcccggcgtggtggctcacacctgtaatcccagcactttgggaggctgaggcgggcagatcacttgaggtcaggagtttgagaccagcctggccaacatggcgaaaccccatgtttctactaaaaatacaaaaattatctgggcatggtggtgtgtgcctgtaatcccagctactaggaaggctgaggcaagagaatcgcttgaaaccaggagatgggggttgcagtgagccaagatcacgccattgcactccagcctgggcgacagtgagactttgtctcaaaaaaaaaaaaaaaaaaaaaaaggaaaaaagttatttctttttagttgagcgtgtgctacactaaacaatgttacaatacatttttaaattgaatgtattttttttttgagacaaggtcttgctttgtcgcccaggctggagtgtagtggcatgatcatagctcactgcagcctcaacttcctgggctcaagtgaccctcctgcctcagctccccaagcagctaggactacaggcatgtgccactacgcctggctaattttttcatttttattttttgtagagatggggtcttgctgtgttgcccaggttggtcttgaactcttggcctcaagcaatcctcctccagagcctcccaaagtgttgggattacaggcatgagccactgtgcctggccagaaattgttttgaaaggctaaccagtaaaacattaaccaatttacaagagaaaaacagccccatcaaaaagtgggcaaaagatacgaacagacacttctcaaaagaagacatttatgcggccaaaaaacatatgaaaaaaatctcatcatcactggtcattagagaaatgcaaatcaaaaccacaatgagataccatctcatgccagttagaatggcaatcattaaaaagtcaggaaacaacacatgctggcgaggctgtggagaaataggaacgcttttacactgttggtgggagtgtaaattagtgcagccattgtggaagacagtgtggcgattcctcaaggatctagaatcagaaataccatttgacctagcaatcccattactgtgtatatacccaaaggattatacatcattctgctataaagacacatgcacatgtatgtttattgcagcactattcacaatagcaaagacttggaactgacccaaatgctcatcagtgatagactggataaagaaaatgtggcacatatacaccatggaatactataaatatataaaaaaagatgagttcatgtcctttgcagggacatggatgaagctggaaaccattgttatcagcaaactaacacaggaacagaaaaccaaacaccacatattctcacttataagtgggaattgaacaatgagaacacatggacacagggaggggaacatcacacaacggggcctgttgaggggtagggggctagaggagggatagcattagcagaaatacctaatgtagatgacaggtcgatggatgcagcaaaccaccatggcacgtgtatacctatgtaacctgcacgttctgcacatgtatcccagaacttaaagtataattttaaaaaaagggaaaaaaagtaaaaaaaaaaaataaacaaatcagcaaactacacagaagaatattagaacaatttctctcaaatttctcttccattgagcttcctgcctgaccctagagctccctcacctctttggcttaccagctcccatccttcaaagtttctgagttattctgtggggaatttgagctactctcttcctttaggtccaggccatctcagctaggtccagagagcctcactcacctccccaactaagcaagcatccctggaggtatgttcttcatgcaagggcagttcctgagagaatttatttggttagctcataaagggattatattgttttcccctgcacatgagagagagtagctgaagtctactgactttaatgaaattctctgtgaagagtctgggagggacggtttaggtaatccatctacaagggtgctcagagagtttggagcgaagcgattggtgtcgttatgatggcattctatggcacagtagttacagtgcaccaggcactcttttaaagacttctcaagtgttcattcatttaattcttaccacaaccctgtgagggacttcctgttattgtctccgttttactggtgaggaagctgaagcagagaagttaactactttgcccaagttcctttcctcctttgaggataaggagccaaaggttcaggaatgcccaaatcacatccctcttcttgtccaaccacccaacctctccacaggcaacctgatcagccacctttatacaaagtacagtattcagattggaataaaaatatatctccttgactccctgctctgagaggtatttcttctcagactcccaaaagctggattgaggaacatggcttagttggtacagtatagcaaaatgtcctgcttgttgaaactgaatttgtgattatcttctttttcctcaagaagtcattgagggctgttgtatccctataaaaggagaatttagagtagccaaataaaagggggctgaagtagtctcattacggaaaaagagagtgtgagcagccttttagtaattgattgcctcaagatgtggtattcagccagggtgaagggaaagtagttggggctgtggatctggaggtttacagaagcctttacccatcctgagactcagttctgctgttggtcttcagagaagtgtctgcacctgctgagaagaaatcacaccactgcactctagcctgggcaacagagcgagactctgtctcaaaaaaaaaacaaaaaaaaaaaacaaaaaaaagaaatcagacatctaaatatgtacaaaaaactaataaacctctggaaaaatggactcagaataaagacatatacaaataaaaaatatttggaatgcgtactaaatgccactgaattgtacactttaaaatggtcaaaatggtgaattttttgtaacttttaccacaatgaaaattttggaacaaaaaggggggatagaactatgggtagaatacagaagaatcaggccagggatgatggttcacacctgtaatcccagcactttgggagactaaggcgggaggatcacttgaggccaggaatttgagaccagcctgggcaacagagtgcgattgccatctctaccaaatatatatgttcatatatatatatatatatatatatatatatatatatatatatatatatatatgaatcataccatttgatgtgatgtctagtaattgctttaaaatacttcatcaaaatgtgggggatgagacaaattatgcaacatattgataattcttgaagctgaatgatgagtacatggggattcatcattcattttctataatttcatgtgggtttggaaagttccattgaaaatgttaaaaacaacccgctcctcctgccaaatcatttgaaaacttaatttggggagtttcttagagctgagttgacctttaaatattattaagtattaaagtctctagtagctcagagttaaagggtattcccagcaagtttaagagatgaggaagggccctgaatgtgagccagagctactaaagtaggatgtgccacaggccacctctctttctgctctggttcctgtgaaacatagtgcttgttccagtaacgtcacctctaggaatgtatcctcaggaaataatcgttcacatgtgcaaacctgtatgtgaataaggatgcttttctcagtgggtttataacagtgaaacaaggaaacaaggtaatgaatggctctaaagaggctggtttaataaatcatggatacaagtaaataattggatttaatgcagttatgaaaaataatctaaacaccttggacctcagttgcctggtttttaaatgaagaaagccaaagaagaattgtattcctcaactagttttaggaggccagcaaacctttgataccaaaatctcacaaagacattatacagaaaggaaaattacaggtgaatctctcttacagacatagatctaaaaatcctaaacaaaatattagcaaattgaatccagcaatatataacaattgtaataaatcaggaccaaatcttgtttatttcaggaatgcctggttggtttattattagaaacccaaataatgtaatttagcattttaactaataaatgagaaaaaagcatatataatagatacagaaaaagcatttcataaaattcagcatccattgattattttaaaaacttatggtaaattaggaatggaaggaaacatttttaaactgataagtggtatttactaaaaacctgcagcaagcatccacttaatgttgaattgctcaaagtggtcccttgagttcaggaataggacaagaatgtctcttctcactagttgtactctaggtcccagtcgatgcagtaaggtaagaaaaagaaatgtatatggattgggaaagaagaaataaaactaccatcattcacagatgacatgcttgtgtatgcagaaaattctaaggaagctacagattaaaattattaagagattagcaaagtcagtgtacaatatcaacatcaaaagaccagttatatttctatataccatcaacaagcccttagaaaatgaaatttaaaccaatatttaatttatagtagtatacacaattaccttgaactaaatgtaataatagacgtacaaaacctcaagcaaaagttatgaagctttgttgacaatgtcaagtgtttgtgaggatgtggagcaacaggaactctcaaacattgatggtggaagtgggaattggtacaactttgatatacagtttggtggtatctagtgaagttgaaaatatacacaatctatgagccagcaattcctctcctacatatataccttgtgtgtgcacatatgtaccaggagacattaaaaacatgttcttagcaacatttttcataattgtccccaactggaaacagtccaaatgtccaccgacagtaaaaggataatttcttgtaaagtcgtagaatggaaagctgtaacacaatactgagaatgatgaactgatgccgcatgcaaccaggttgaatctcagaagcataattgtaagggccatgagctggatatagaaggatatatgcattatagttctatttatataaagctccagaaacagtagtgtttgggcatctatatttgagtggtaaagctataaaggaaagtaagaaagcaacagctaaaactgtcatgagagtgttttgttttgttttggagagaggaaagaggttgtgattgggcaaggacttatgggaatttctggagttctgatctgttctgtttcttgatctttatggtgatttgctttataataatttgttaagctgtaaatttatattttatgcactttcctctgctccccccgccccccgcttaaagagtgttttagaatgtggaaattttaagataagatctatctcagggcttgttgtaagaatgaaatgaagtataaagccatgtagagcttgtagaatatgcctggcactttgtaagaccttaataaatgttaactatctaaacacaatacagatttgctgttattattgcttctcttatttgttgccagccctgccccctttccatgatatttgttgccaatgtttctcagcttactgttggtattttatttctgttaatgctgtcttctgagttatcagtcttttcttttatactttctttcattactcttaaccatagaaagttctctccaacccagaggtttaacatgtattgtgttgcagctttaaaaggggttgcttttgaacatttgattctttttattcattttataacaaaatatacgattaaagaagaattaatacataattgcataaaatctacatttactgctcaaatgtatctgggattcatatttagtgtcatgggagaaaggaaactgaccttttttccaatcaggtaatgaagttccccccagcaccatgaattgaacaatttatctctcctccactcattgttgcagctgtctcctcttgcatacatcaaattcaaaaccatttgcaccaaaagcatagactggaaacttgatacctgaactgaatgtgataatgcaactctgaagggggaggggatggttgccaggcagcaggaaggatagctgcaacaagaggatgtgaaagaaaggtggcctgtgtcacacaagtattccttaaaggctgcatccttgtgtatggcgcacaagccacttgctgctatgatatttggctaattatgtctgttgaccttgctttcctcatgtatcatctttatataatagtaacacctacctcatggggtgctgtgcacatgatggctaactcaagtaaggaacacagactttgggatcagtcagtccagtgtcttatccttgactgtaccactaaataattacatgaccctaagtacgtttcctaacttcccagcctgtttcatcatctgaaatatgtgtcaattaatagtaattaaattaatagcaagttagaaatagaaagtcatgcttatcttaagggagttgctatgaaaagctaataatgcattttaaaggcttggcactgggtgcctggcatgtaataagcttggaataaatcgcacttgcagtgattttaatttttattgctattgtggaaggatcaggaagggaaagaatattcggcaaaagacactgagaagtaggcatcaaaaagatctgggagagggaaaccatgagatggatgtcatggaaacaagggaaaatagtatcaagaaggagggagatattgcaaaaggaggtcattcaaaggctggtttctcctgacaagacaaaagagcaattttcatctcttggcgactaatgagaatgaagggagaaaggaaaggaaaaacaataattataaatgaagggtatcaaacacaaaattttttaaaagccttctttcacttaaccctgtaatcactccaagtcttctttgtcttccaattagggaaaatacatacttcttgaataaaggaaagccagtgtgacacaaaatgaaataaaaagtctcacttttgcatcattttggtgaagtaaaaatttagacagtttcaggtttacacaacagaggacaggatgggggggaaggaaaggggatgaattacacagcagggtttcaaagtaatgatcttgaacctccaagctaactccagtgaaaaggaggatgggggtaggtgtagcatttattcctcttttcactctacctggtttcagaaagaaattatgacagcatatctaggtaaatcattcaatagcatttatagagtgaatttgagaaaaggtgagcagcaaggggaactatattctaatcttggagagatgagtgggcaaatcccctccaaggatagactttgggagaggtagggaggaatagggggctgtaagagccaggtagtgttgggggaccctgtggctttgggggcttgatgaagctgcctcctgcgtgggtggtggggtcctctttgcctgtggtgagatggaggtggctgccaggagccagaggtgccccagagggatgcaaaaagtgggtctcttggacctttactcctgctcagttctcagctaaaaggtcagaggcagaggggccctcccagtctactggccatgagcattaaggaggctgaggcttaaggccatcatggaatgcggaggagggggaggtggtgatgggcagagcacatgaagctgagcctccatctccctccaccaagaggtgagtgtggctccagggaaggggagtggtggtaaagtgagactgtgataaaatggatggagcaagggggataggaatgagattgcggggatatggatgaagcaggggggatctgaatgagattgtggggatatggatggagcaggggggatatgaatgagattgtggggatatggatggggcagtggggatctgaatgagattgtggggatatggatggagcagggcggataggaatgagactgaggatacagatggagcaggaaggatctgaatgagattgtggggatgtgcatggagcaggggggaactgaatgggattgtggggatatggatggagcaggggggtatgaatgagactgtgaggatatagattgagcagaggggataggaatgtaattgtaggtatatggatggagcaggggtgataggaatgagattgtggggatatggatggagcagtggggataggaatgggattatggggatgtggatgaagcaagggaaagggcccagggaagagcagagttggaggtgattctggaaggagagcactccaaggtggattctgggcctggcagccccgggaaggctgcattgggctccttgcagtgtgtggcttctactcctccctgggggcctcagcctagacccttttgtccccatcagcctgctagcctaattagagtcctaacctccactccccctacaacatagcccagggttctgtgtgaaacctgtgggtctgcagtttctgccaggcctcctgtccctgtcactgtagatgggagcccaccagcttggccatcatacccctccccctctcccctgtcctcctgtcctccacctacatagctctgtgctcctttccctgaggtgccagctctggctgctgcacaccctgtcttgtcagcccagggaccccctctttcctcccaggcaaactccctcaggtcctcaggtctgcattcatttcactccactccttgccttaaatgaaatcattcccccctgctccttgccagttttgacctcttcgtgaagatagggactactgtacctaccagaaacttgggaccctcagggatagaggtcacatgtcatcttttatcaccctctaatctgaggtcaagagatcgggcaggagtagttgtcccttcccaatacaaacaggaatggagcctctggaatacccattttcaatttttgtcccccccccgttccccatctgatgtctcatgatatgttcaagaagaaaacattggaacattattaactcatgggtgcaggggttggctctatgacctaggagacaggtcagttgtgttaaggggttgtatgggagatattcagtccatttcagcttcctttctcctttcctataaatgaggtcgataaaaacccctcctcatggtatgacccccccttatagcttctatatttagtttcatttttctttatctttctaaaagtaacatcacacagagacatgaagttagatatttatatatattcatcgacatagaagtccacgagatacattatttggtgaaaaatacacagtatagaacagcacttatatttggtcactcttatctatacatatatctatctgggtacacaggtacagggagatatctggaaggacattcaccaaagggctgacaatggttacaaaagggtgctgagtttcaggtaatttgtactttagtttttgtatcttcctttatttttgaaggtttaatgaaaagatgctcctttcataaaaagtataaagtcatcaaagaaatagacacatggagaatagacccttaagccagcagagaagagagcagggacagaggtcacaccattccccatccactgtgctggtatgcaagacctcttctccttcccaaaggaaaactgctttgtggattaattcatgcagttagaaacccacccccctctcctgttattcccattaccagactctgaatacagtcaaggactcatttagggctggactagatccttactgtggctcagaagcatcactgtgttctccagggacctcttttgacctctcctctgtatgtgtcagctcctgcagggtgatgatcagattctcaaaaacctgggccttgttgctctcattgtcacaggtttcttttgagtggccctcctccccacaatatgaacagcgggttgtgtattttcgcttcctggctctacgaatattcccaggaccatcattcttatacccagaaccaccactggtagaaagagactgagccccagaattgttgggggaatcaataaccagcacttgatccagaggtctggctcttcctctgaagggaggggcacctgtaggtgtcagtgaagggtacagagacaccaccaggatcacatcctcatcagagtcatcaagggtatcatctatttctatcacgttgcagttacagtcagcactgctgattgctattggctgggcgccctgaaatgccacagggctggctgccctctccattattggctcagaccttttcggccgcttccgtttaataaaagcatcatcccaatcctcttcctcccttatcatcttgattaactccaggaaattgggaagccgctcctgcttatttgcatacatcctgagaagatgcttaagcctgaagcgcaggtccctattcagctcagcgcctaaaagaagctgttgcaagcgagtctggtttgcatctttctcagctaggatgcctgcctgaatagcattctggagctgcacctctaaacggatcacataaagggaggctttctccccttgtgcctgcagggtgttaaaaaatttaccatgggcagtcacactgctttcagactccccaaacaccaatttcattgcccgcaagaaatctgctacacttaggttggggttggccgcctgaagcaaacgcatgacctcccgggcagggcccctaagtgttttcatcaagcgcttgagtttttcctcctcagacatactccaatctggcaggacctcattgacttggatcagccagttttcaaaggtttctttcccctgggctggcaccactcttcctgagaacaacttcatgtttctctctgccattttgaccactaaaggacagagactcctccccagagacctcaacatggaatgggcccaaggcggcaaaggtgcattctgctgcctgctgttacccacacacgcagtgatgctagccatgactgacgacgatagggtatctgaatacaacaagatgctcgcgctttttggaaaagccttatctgcaggattctccaaagcaacgttcctgggctgtgcctgccttatatttcagtagggattctaaggaaagtaaaaaaggttaataagatagtgggctgtggggaagcagtctgcagtagcattctctatcttcctgaatagccttgcagtgcattttatatctgcccagtgccttaacaataccctgcaggagactggcaattacaacattccagagctagcaggtgtccctgggctagtaggtagtttttcagagccacatccatcccctcctgcctgtactccaggaggggcgacaactgttgcttctaattctagatgacatagtgttgggagctgatactgggccctcaaaacggaactcaatggttgtgtgtcacagatttatgataataagaaaccattaacctcatggcctcaggtctcaatcacacccccttgtcaacgtttcccccgttatttctcagattcttacatgagctcggaaactagcgttcgcctttattttacgtgcagcctctgcaacaggtgcctgccgtgagaaaattagcctctggggtacggccgacttttgtccactgggtgtcgcagatcccagtcctcagggcctcaagactgtgccgcgaaggagggaaaggaagggttggaaacagcttcatctgaaaacctgatacctcccctccaccgcctccactgtcgccaggcggaaaattccctctcccatcttctgaacgcaagccaaagtgcctcctgccctcccgcgcatcccccttacatttcctccgggagaccctcgccctaccagctctgcaatccgccgcacagaattcaagttcggattcggctttgatgacctgccagggagaaagagactagaagttggataacctcccaccctcatattccttcccaggaagagatgaggagatgcaaaaggggttcaagacagcttgcgatcgtctcctcccgccccttgccacctccccgaacacaccccgcccccgacacccaacaacacccccgacctacgacaacacccccacccaccttaatccaggcaaatcctaaatcctatccagtcggcagcatccagatgaaccacaactccttcctcagcgcaaccaggccaagggagtgctccatcccctgcctcgcagttactgattctccaagccgggcgccgcccagtcctggcggggcttcccccacccctctccgcgccgggcaatcgcgcgttctttctttacttgtgctccactggtgggcagcatgtgctcccgcgtccacagctctgtttcgccttccggtccccgtagctctgcaggggaacgggatctctgccgcctcctcggccgctaagcgacccggggctgcccgacctagcgagtgcgcacgaccgcccagcgaggggtagccgagtcgaggcagcacggttcccaaggcagccaaggctgcgcccaccctccagttcggccctccgggcagccgcggttgctttcagtctctggcgactgagacaaaagagcgtgacgggccgggcgacgcggccaatcagcggggcgagggggcggcctcgccgcacagcctccggccccgaagctactgctagcaagaagggggagcgggccggctggccggcgggccggcgggcgggggctgcggcagacaggcgcgggaggcggcacggcgtcagcagctcggacgcacggactgggcccatttccctttcatccgtgagtttgctgctaacccatctcttcccttctccctatccccttacacctcggctctcctccgggcttttagaccggataccttaaacacgaggtgggacagaaaccaagtgaacaatgagagttcctcacctttgtatagggggaagcggggaaacagcgtttactgagtgctttctgtgtgcagaggcgcctgcatggacatctcctttcctcttctcagcagccgtgtgaaggaggtagtagtgtgcccatttaacaggaaaggactgaagcacccaggcagtacagttaggaagtgcagagttaagagctcacacccaagtcaccatgtctgacttcaaaggctgccccttgccagcactcctctattctgtcagattaagggatagtggagaaaaaccaaagccagatgggaggaccaacttgggattgcatagaattggtgagcaagaaccattatctccatttcacagatgaagaaactgagccagagagagacaggttactagttttggcctgtatcctgcagcaaataagttacagcatccaacctagcaccgtctgttgctctctagatgctaattcgttgccctgcagcgctgcctggagagtatttttgcacaggtagtctcaaaccatctcaacagcagtctcaatgtgataatagtgctgagggagggggtgaggaggtagtggggagagggctgagggaagatgagggcaacctttatggtgcccattgtacagaagaggaaactcttcttggtacttttctttctttcattttttttattaatctttttttcttttcttctttttttttctttttacacaacaagctgcctgttttataaaagcaacataatttcgacagccctttgtgaccccaaagaggccaggctcagagaggtaaaatgatttgtctgaaaatacaaggtgaagccaaaatttgaactgagtctctgaatccagaactcatgctattaaccaaagtgtgagtacaaggtgagctgcctcagaatcattttggagagcttgttataaatgtagattattgggccttacccctgggggattttgatgtagtaggactaggggtgaagagtgtgatttgtagttttaaccagccctgtagttgattctgaggtgtagagagattcatgaaccacttttctaaacaccaccacgtgatgctgaaggttataagtaaatgggcctgccatcagtgtatctgtccatggcatatctgtcatgaaatgtaactccagagcacaggttcctacccgaggtccttcctggaattgtatgcaaagaatctggactccgtacattcttctgagcccacagctttgcagattttcaaatgggtctgtcataacgtcttccttcttcaagccatgcttgatgaagaagtgtgagaaataaaaccccatttaacctaacccccaaaccacagctctctgttgctgatatggctctttcatttcctggctcaaggacaggttgctaggttgcccttctgtgagctcttcagggtacttctcctttgctggatttggcatcactggccccagagaaggagcaactccatggaaacggcatgcagggctgtccaaagtgaatggccatgaaggcagtggctggaaaacctgctccatttttccctgacttagagagcaggtattacttcctttatgtatagtgtggctaggaggcttctgtggggcttgttcttgactcctgatgtttagaagcaagtaaacagtctgatgcccttccgctgctgttggcttcatcttcagtctgccaaggtacttcacttgctcctttccgccctcttatttacaaccccaagatctagagttccttggagtaaacaataaaaatttggagataagcaccttccatctcaggatcatggtctgtggatggaacagtggggtagtggtggtggaggctggaaagtgtggatgtatggagaaggcaagttgctcacctcacacacttaggggtgatgctggcagttgctcttaggtttccttcagacttttgcttctgctcccccatcccgtgacatctgacccttacctcccagaagagtcttgttcagtgtttaaattggctttatcaccaaattaggtatttgcagctggacttggtagggatggaatcacataggaccaagaataggtgtcagagctcagacaaaaataatgacaggaaatggattgtgtaaaggtgccagggttgggctactagaacaaagcgagggactcttcatgcagggatgggggtagtatttgcaacctggcttcaattggatacaggacatcctatctctggcctcacatgtatgagtgtgttccaactgatgcctctaatgagaccacattttctaatttcaacaaataaaccttaaaagcttgaaggtttggagataaagctttcagttgaaacaataatagctgcctttggctgcctgcctcctttgtgccaggaactttctgtctgttatctcttttaagcttcttatcaaccctgttgagacagctattgtatcccattttgcagaaagggaaactgaatttcagggacattaagtaacttgtgtcaggcttcacaacttgtaagtggaggcactgagactgcaggccagggatgtcgaactccaaagcccatgaaaactcttctttgctgccttccaaacaagcagtccaaaatgcattctgtagataacccagttcattagaccaattgcagcctttagaacaatttaattgttatcttgcctttattcctattatctcatttttaaaaaatgaaactgctaatataacttatgaagcaacttatataccaggtgctgtgctaagcactttccatactttgtctcatgcatccttcatgacaatcattttacatataaggatactgaggatcagcgagatgatgaaacttggccaaggttataaagctaggaagtgacagagtgaaattcaaacccagggctgcctgtatccagagcccatctctgtgccctacaacacaatgcagcggagaagacaaatgtggtcctcatcttaaatgggcttctctctgtcaaccacagctctatttccttctcaccacatggggtaggccagccccatgcacaactcacactcttaagcctatgtgccttaggccacttcctcagcctagaatgcttgccctcactcccctacctaacaacagcctattctactctactcaattaaggattgagtcatatgccccttctcaggtggaataaattgctgttgtctttttgcttccaccttcattactgtaccctttattttgtctttctgtagagtttagcacactgttgacctgtctcccaagctagttgactagatttctaagcacttgagggcaggcaccaagttctattcactctagctctatggtggtttacccacaatgatttagtggatgatcaatacatgtttgtgagcagaccaaaggactggctgagagatgccctgaatgaacagacaaatgcattcatttgtggctggatcctggggcagtcacacagtctacccatgtggactagactggctgggagagtctggaatcctctgggctcattttactaggctgtaaacataggaggcaggtcatagggtacaggtgatatctgcttaaggccaactctaggtccattctgtggtctatactttgaattcatgtgaaggggccaggctctcctagattgcttatgttgcaccttcctatttgtggaagtaagggcttccctgcctcccttgggaacagaagatttgttcccaaatgcccctgtatctggttatggctgtcccgagagcatccagaaggagcatgcgttctgtggagacagatagtgaagtccagaagcatcttttttgatccttcttatcaaggccaccatgttatggattctcaaccactttgtctcattttatgttattaatctctgccacaacgttttgaggtggatcttaatacccctgttttgtagctgaagaacctgagactgaatgaaatgtcttttccaaggtcacacaactaagtggcagaggcagaattcagtctcgggtctgtctgccctttccaaagcctggcatcttaacagaaaatacatgggagaaacacgaactcccctcccataaaatggaaaggattggatttataaaatggattacatattaaggttagatgtttctcaattattgttcacctttattcccccaaaatgatttacaaaaatggcagaaggagttggggattgaaaagtacaattcctctatcaactattgacctgaatgcccaatatcacccccctctgacagatacagtatggagatgactaaaaattattttgccctttctgctccatttacagctcagatgggtaaggctccaagatgtcactgaatttctaaaggtcacacatcaagttgataataaaactcacttagaatgctggtatctcatactaccccacctgcttcctggcctttctggggtaggtgcgatagttgggagtccttgcactgccaaatcctagcccagttttctttctgctaaatcatcctgcctcatggtgtcagtgaacatgtttataaatggtagggaggaaatggaacattattgcactctgaggtagaagaaaggacaaatatttacttcaccacctgtccttatttaggtgaaggtaagactttggaaagaagatctttgataggagagctgaggactgttgggggcttctgtagatttagcagcctgggtatctgggaggagtcccctttggctctggagaaatggaagtggggcttccaggggccagaggtggcccaaagggatgcaaagagtgggcctcttgagtttttactcctgctcagttctcagctaaagggtcagaggcagaggggtcctcccagtgtactggctatgagggtaaaggaggctgaggctcaaggccatcatggaatgtgggggtagggggaggtggttatgggcagagtacaggaggctgagcctccatctgcctccaccaaaaggtgagtgtggctccaggggaggggcgtggtggtaaagtgagattgtgagaaaatggatggagcaaaggggatagaaatgagaatgtggggatatagatggaacagggtggggttatgaatgagattgtggggatgtggatggagcagggtggtatgaatgagactgtgggatatggatggagcaggggggatagaatgagatcgtggggatatggatggggcagggagataggaatgagattgtggggatatggatggagcagggggtatagaatgagattgtggggatatggatggagcaatggggataggaatgggattgcggggagattgatggagcaatgagattgtggggatatggatggagcagtggggataggaatgagattgtggggatatggatgcagcagtggggataggaatgggattgtggggagatggatggagcagggagaaggggctagggaagagcagagctgatgggagtgattttggaaggagtagtacaccaaggcggattcttggcctggcagcctcgggaaggctgcattgggcttcttgcagtgtgtggcttctactcctccctggggacctcagcttggactctctggttccccattggcctgctagcttaattagagtcccaaccttcatgcccccatcacatagcccagggttctgtgtgaaacttgtgggtctgcagttcctgccaagctttgtgtccctgtcactgtagatggaagccctccgtcctggccatcatgcccctccgcctctcccctgtcctcctgccccacacccacacatctctgttcctttccctgaggtggcagctctggcttctgcacaccctgtctcgtcagccagggaccccctctttcctctctggcaaactccctcagatctgcactgagcattcattttttttctttagatcccaaaattccttcatatgtcctggcttccaagttgcttctcatactagccatctgcttcctggcctttctggggtaaggagcaatagtttggggtccttgcactgcctattctatctagtacagtggttctaagccgggagcagttttgcctcccaggggacatttggcaaggtctcaagatatttttggtcatcacactgtgtaagtcactactggtgctactggcacgcagtgagccgaagccagggagcctctgaacattctcgagtgcagaggacaggcgccaagaataaaaaattatcctgcccaaaatgtcaatagcactgaggttaagaaaccctgctctattatatagctacaggtcttaaaggttaggcttagaagttgccaggtgctgagcctttaggcactgaacttccagaagcagctgctctttcctttcctcacttgctggaggggggctgggcgttgccatgaaacagctacaacttgggcaggaatctatggagagaaaggcgaggggagattccccctccccaaatttaataccaacttttagagaaagcattgcacttcaactgttaaatgcctttctgcctctacaagatagtgccagatttttttaaacagaatagcaatgtattattcaagtagtttataaaatgcacagtttcatgtcgtgaaagttgatgcattaagttttggagtcttcccctcctctatttcatgtttttcagtcgtaatcctttgaatattggaatatttgctgtgtcagcaaaatactgtagtggtggctctgtccagaaaaactgattgcctttcttttaatttaaagttaattaattcttaatttcttaagggtgtgcttatatatcagaaactggctcaaagagttgcttgtttccgtcgacctgagtttcttagggttcatttctaattaagcaatgaaaatgcttgccaacagaattaattggtcagtctaatctctttttttccacccttgccagtttcttccatctgcacccagttgtcttcagcatgggggagcagaaccactctcccgggaaggagcttcagcacaggacgcgagcagaggctccaggaaagaaaagctggcattcccaggcctatgcccttggggccgtttccaactttatgtctacttttctgacctttcctatctataaggttgtgttccggcaacagatccatgccatggcagtgtcagaggctgtgagacagctttggcatgaaggtcctcaatacttctaccggggaatctaccctcctcttctctccaagacgttgcaagggactcttctgtttgggacttatgatagcctgctgtgctttctctctcctgttgggccacacaccctgggacaccgctgggctgccgggctcatgtctggcgtggtggaggccgtggcactcagcccctttgaaagggtgcaaaatgtgctccaggatggtcgcaagcaagctcgcttccccagcaccttcagcattctcaaggaattcaattcttatgggctttgggggcggctgtcactgggctactatcgtggtttctggcctgtcctggccaggaacagcctggggagtgctctatatttttctttcaaggaccccatccaggatggcctggcagagcaaggcctgccccactgggttcctgccttggtgtctggtagtgtcaatggaacaatcacctgcctagttctgtatcctctgattgtgctggttgctaatatgcagtcccatattggatggcagaacatgccaagcctgtgggcctctgcccaggatgtatggaacactcggggccgaaagctgctcctgatctaccgtggaggctccctagtcatcctaaggtccagtgtgacatggggcctcactacggcaatccatgacttcctgcagaggaagtcgcactccaggaaagagctgaagactgactagctgcagaaagtgtggcatggcagctttgttattctaaatcttccctggttggttctatatagcttacttctttggctaggttgcctaatacagccatcctttagcatctataaactcattgcatgggagaagttcccaactaccaacctgttgagcaaggacaaagcccaaaagtattccttagtcaaaaagaaacgttcaccccagtctctccacagtttcagtagcctcagagccaggaggcctttaaataacatgtaacccagattaagtgtcattcctttaaggaattccttggcaataaacagaaacttaaaaagatgaccttacttaggcactctgagctctgggacccctctaggtgtcctccagaccaaactgagtggaactccaatttcaaagaactatgcttgactcttaggatgggaattccataaaacttctcagatggctacattttcatgatattgttcactgcctctaccaccacctctcacttctcaaggctgtgggtcctactttcagggtagcagctgtggctggaaatcctaaattaggcttgcatgaactcgtcaggtgccacaagaactagtggggctggagatgggagtgagaagagcgtggcccatggatggaaagaataaaaactttgaaagaaaagatttaattacatgcaaaatagaaacatttgctatagtctgcttggtgttatctgctaggacatttctgagagcaaggtgataacattgcctagaaaccgtttgagtttccctaagaaacctggaagtgaagtgaccatatctcttcacagaaaattgcatattttgttgatgtggttaaatgtagttactatgacataaagatcagaaatcttagcctgtcattcagagccattcaaaatatggtcatcatataactttcaacatattgtcactccacttacataaaccccaaacactagccataatgaactattgttctctccccagacattccatgaactttcccatggccatactctggcccacactattctttccacctgcagtgctccttcttcacatgccagtctaccaaaatccttccagttccttgaagcccagctcagaggtcaccttctctatggagttcttgattttccccaactgaatgtgacattagtctctgtgatgcccctttcttttttttttttttgagacggagtttcgctcttgttgcccaggctggagtgccaatggtgtgatctcagctcactgcaacctccacctcccggattcaagtgattctcctgcctcagcctcccgagtagctggaattacaggcgcccaccaccatgcctggctaattttgtatttttagtagagatggggtctctccatgttggtcaggctggtctcgaactcccaacctcatcaggtgatccacccacctcggtctcccaaagtgctgggattacaggcgtgagccaccgcgcccagcctctgtgatgcccctttctaacagcacttcatacagggtactgattccattatgtcactaatctcatgtgaccctttgttcttgtattcttcaatacctcctactagactgtaaaactcattgaaagcagggatttttgtatgcattttaaaatcttccattgtgcctaggtgctcaataacgttggtcaaattactgagttgattatcaagctgtgatatggtatatcctcagggtgctgtcccttgtacatgacgataaagttattgactcactgtcagcaagacacgtgcctttgggctgtgtttttgctttcttttaataattgatttagttttgtgctaatgataatgatgctgctactgataataataataacaataataaaaattactttcaactggcacatttgatgagtttatattactgatggcatgtttgctattagcaccagttcaggaactgaaatttcacaaacagaatcacactgtacaactgtaccatttgtttcaactctggaattttgaggatttccaagatgacatgtgttatagtttccccctacagatatcttagtaatgccctcctcttgcatctccttactgaaccaaatttgtcctgtatttgtcttacttggttgtagatttagcagtgagaacttctcactgaatgccacagaaattaaagacatggttgttggaggtatgatgtcagagagcatttgccaccaaggttggcagaaaatggctggtccaggagagctgaagatgagcttccacatctgcagatcgggatgtgttgggacagtactcaacttgtggattcaaggaagtatgaacacagagtctgcataaggaaaggaaaaagatgcattcatctcccaagtacactggtgatttccacttatgtcattctgtccatccatgtccctttcttcattttaacttcttatttaaaaataatttcaaacatttaaaaatgttgcaagcataaataaagcttaaagaacacccatgtcccctttaccctaattcccctattattaatgtttctccccatttgctttattatttaagtgtgcactctgtctatacacacacaggatattttttccctgaactatctgagagttgcatacatcagttttcaatattcctagattcaatgtttgtagatccaaattattttttaagagaccgtgttttatctctgacaatgggacagttattacagaatataataaaatgaaaactcacacaatatatgtgatattgtgaaatatatacttggtctttgatcctgtttcttggcatacaactcctaaaatccttagaatttccaaagtgatatctttttgtatgctaataattgactgatggctggcagcctctggttgcttcaggatgggaactagtcaccaggaagaccaaggcaccattagagggttgggacttaacagcctcattcccgacctccagggaggggagagggatggaaggttaagttgatcaccagtggccaatgatttaatcaatcatgcctacgcaatgaagcttccataaaaaccccaaagcactgggtttggagagcttccagatagctgaacatgtggaggttcctggagggtggtgacccagggagggcacagaagctctgagccccttccgcagtacctcaccctatgcatctcttcatctctatcctttgatatatcctttataataaagtggtaaacgttaagtatttccccaagttctgtgaccctttctggcaaattaaacccaaagaaggggtcatgtgaactcaaacttgaagcccatctgtcagaagttctggaggcttggatttgcgactggtgtctgaagggcctgggaacagtcttgtgaaacctagtcctcagcttgtgggatatgacgctatctccaggtagattgtgtcagaatggaattggagtacacccagctggtgttcgctgcagaactgattgctcacttagtgtgtgggaaaactccacacatctggacatggaaatattctgtgctgattgccgtggtgtaagagcaatgcaaaaagtttgggtattttcccctcggagtatattttaaagctaaattgctaataattgcttaaatttactatatttgcctttataaaaactttatgtatgttgaagcttgaagctatgcaattataatataaacatggatttacaactaaagcatgttataatttaaataattgagtttttcaaatcggttcatatgaaatcctaggcaatattgtaaaattatacagacctgtcaactttttccacttaaaagttgtgagcaaaatttaagggcatagtcgttttcaagtaattttaaatgtcaatgttaatatttagtttagtgatgttaatggagctatgttttctgatattaaaaatgagttttaggagttgagaccaataaaataaggaggtaataaatatctatatctgtttaaacacataaaatatacaatttaacactaaaattacttggtataaaaagtcaaaaaaaagaataaaaagccatcatacaacacaatatatgcgtgatatatatttttctctaaatataaactacatcagcttttataaagctcaagttgaaataataacgttttatgacaaatcattatatggtatattctgacttaattttgcatttacaatttatttttaaacactaaatagcattataattttactgggataactatatatagtgtagtatattaaagttaataaaatgacgttgcatatgagagaaaaagcataataaatcagaaacaatataaaaagctttcagaaaagataaaaatattgtatttctctagtctgttcactctccagtgtctctggttctttcatatcatcttcctttcctcaaatcttttaatactccctccctcatcatttccaactagtgaccctactttctatttcattaagaaaacagatacattcagaagagaactgccagtttaaagaacatttacaaagccatcacccatgtaataaccagccagagcaagaaatagagccctttaataacctactcttctccccccaccactgatgacaccgctccctccatcttaggtgtagcccccatgctgacttttgtaataataatttctttgcttttgtttataagttttcttccttataagcatctctaaacaacagttttgttttacagatgttcaaacattaaatgctttttagacttggaattgtgactatcttgtttcactccacattgcttgtgagactcattgatattgcagatagctgtagttgatccatttttattgttgtacagtttaccattgtataaatataccatgatttattcatgataactttgaggaacattctggttgtttgcaggttttatttttacagttcattagttttattgatgtataataattgtatatgtttatggggtatatgtgatattttgatacatgtgtacaatgtgtaatgattaaatcaaggtaattgggatatccatcagctcaaacatttatcatttctttgcattgggaacattccaaatcttctcttctagctattttgaaatacacaataaattgaatactgtggtc

SEQ ID NO: 3545 - DNA, 1200826 bp, human
tgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctgggactggggtccattttcccactgacatcctcatctcccaccccaccgcagcagccgacccaaggttttggcttcatctctgagccgacccgtacggtgtgaactctctaatttgcgggccgccctgggctagatagcccacaattacccgccgtggaagcagattatttggggcactagtatccatgcattgttgtaccactgggctctttgccagcagggtctcggatacttaggcttccaccccttcttgccgcacagaacgcgttcttctccatgcttccggcttccccaaagatagcaattgggcaactaccctgggacttagggagggtgaaattcccaagtattcctgagccgaggcttcagcagaagtgcctatcttcgccacttgcatcccttctactcctctcctccgtggagcaacccctgctctatggccagtacagtcgcaccgtgaggctgctggacccgatgcggagactccagtttgaaaccacctgcttacagttagctctccaatttgagggctgccctggggtagacagcctgcaattactgaggtggaagcagctgatttaaatagcgtttaaatgtggataaagggctgtggcatcaaaggctcctggcttgcccactctaacctcagctggtctgaaggagaggcaagttgcgaccaaagctgcctccgtgaacagacagctgcagccgcttctgcttctgccctataggtcaaggccagacctttggagcagtagggttgaggatttaaatccggctttgtggaatagcctctgcttccctctctgatatctggccagtcttaggttgagcaattggccatttttagtttctgcggggcttctaccactttgacctctctgtgcagaggctaaaggtactggtcaggggtggtggatagcagggtgcccctggactgtggcatttacaggtaaaatcaagtctgaatcttgatttacccattcatttcctgagaaatagttcctcaatgttgtagaacattcttgtttgccaataactggcaatagagtccatacacacatatgctgcttattagggtgaactgatggtgagataacctggagaacagccccttataaccatctggaacatgtctccacagctgcaaagcccattgaaattttatttagctttaaaaagacatgctgtaaagaatctgaccatataaaaaagatgaattatgaagtgactatttcagttttgtttaaaagaataaacttcactttatcaaatacactggcttccatagtttattgaagtgtctcagtgcaaacatttgctatttgggaagaaggggaaagattgggaaggtgaaatgagttaaaatatggttgaaatgatcgtatactttggtaaaacagaactttgtgttcacatctgtgccttaaataaaatcatcacgatgtgatgtgaggccctgagtagattctgtgacaggttgtagcactatgatgaaaccaaaggggaacatatatttatcctttgtatttggaaatttcctgtaactgcagcagtaatgattacagctgggactgttggaagacaaatgtacacactgccttcttcgtttgagaagtaccataacctcctttgtgaaaatgcactgtaatcaagtggaagagataaaaagtcccaagtttgaggtcttcactaataatatataaaagaaaaatcattgccaaacctcgagatgtagactaacagggttttttcaaggctggtttctagctgtagtcagaaactcacaccttttaatctctgagaactgtcccttgatcctaggtcagaaagctgtgattggagccaacttggtagagaaaggtaaatgtggaatgtgcaatatgtgctttaattatcctgagctaggacttgaaaataagcctctcattatctttagacttggagctgcaagtgccaaggaatttgccaaaataaaatgtgtctgtccaggctgggcatggtggctcacatctgtaacaatcccagcactttgggaggctgaggcgggaggatcacttgagcccaggagtttgagattagtctgggcaacatagtgacaccccacctctattttaaaaatgtgtctaatgtaaggcctgatgcaaggatgtaacacatggatacatctggccaaagctaccgctatttgggctggttcactttgagttatctcctaatgacatcagaggcactagagtgagtccactgtggggcagtttcttttgggcttccccagccacagacatggttccaaatcttttgtcaaatgatctaaatacatattccctgtgccaagaagcctagatttagtagccttcttgctttatttttcccattaatctcacagcttcgtgtagctataccttggcttctctcttgagtttcaaaatgctttttagctggtttgctttattcctgtatttgggtgttctgttgtcatgaaaatgtattaagacactgacttgacattttccccaagcaaacttttgttttttttttttatcccttccttttaatgaggtccttattctctaaccctagcacctctgatctcattcatctgtgactgctcctgtgtgcctcatccatcactacctcgtgcatcctgtcttttattaaatgccctgaattctgtctctagaataggttttctcctttgcatttgtactgccaccacttgcagttaggtcttctagattcttgatctggcctgctacaaaagccttttcttgctgtctttgatctgctctctaattcagtatatcctacatgttaggattaatcttcctgtagctcatgtagttctttatttaaaagtgttacttagtgagtggttgttaagtcatacagattgttattgaatctaaaataatctctaaccatttgagttgcctgatgcattaaataagttgcattgtaaccttaggaagtgatatggtttggctgcgtccccacccaaatcttaccttgaattgtaatagtccccacgtatcaaggatggggccaggtggagataattgaatcatggggatggtttccccactactgttcttgtggtagtgaataaatctcacaagatctgatggttttataaatgggaattctcctgaacaagctctcttgcctgccgccatgtaagacatgcttttgcttctcctttgccttctaccatgattgtgaggcctccccagccatgcggaactgtgagtccactaaacctctttcttttataaattacccagtcttgggtatgtctttattagcagtatgagaacaaactaatacaggaagttctctaacattgcaggtgagtacacagcacggccaaccatttggtgggaactcaaacatcagatttgggacatttgttgcctaacccagagagtccatatcatcctttcaatatccagggacccaaatagtgtgttgtttcctatcagttggcctgctgaaattacaccttttaaaaattattagaactgtgttttatagtcttttgtttgttaacagtctattgctatgcccaaataggtcattttgctctggcttacttgggtgtgcatcactctaggaatcatctagatcattgtattatgttatgaatttttaacatttatgttgtgcttgctttatactttggggaatgcccttcccctttctttaccttgcttaatatttataattatttgtgaggcaggtggtctgtccaaattgggaaactttgttttattggtatcacaaagctattattgctctggggtcctggctcagatagcactagactaaagggattttattctctcctcattagctgtaaaactaagtccaaattctttagccagaagtttaaggctctttaatatttagcctcagtgtacctagtaagccatatttcttactaccttcctgttcacataatctagccagactggatcactcaccattatccagttataacctttgttatatatcttttgtgcccttgcttatgccattcttttccctgaagtatttttcctcccaatttccatctctacttctctgcctgttgaaaacaaaccatattcaagaaacagcttaatgcaactctccctaatttatctctcatacctcatagctaaaataatctgtcccttttctttttctttcttttcttttagacagggcctcactctgccacccaggctggagtgcagtggtgtgatcacagctcactgtagtcttgacctcacaggctcaagcaatcctctcacctcagcctcccgcccccagtagctgggactacaggtgcatgccaccatgcccggctaatttttgtatttttttttgtagagatatggttttgtcatgttgcccacgctggtcttgaactctgggctcaagccatctgcctgccttggcttcccaaagtgccgcggttacaggtgtgaaccgctgtgctcagcaatctctcccttttcataactctcttggcacattgttgatcccccttttatgatatttaccttgttctgcaaacattattgttatttgtgtatcactctatctcctctactaaattttaaacttttggaaggctgtcttttgttctgcagagtgccaagggtataggaagcatctgttacatacttatttaattgagctgcctttgagatctcagtattagccttagcattttactatgtaaatgatagtttcaggttaagtaggaaattgccaaatctattatttgccaataatgtcatgaagcagtataatagggcactgatttttttaaaacagctatgctctagaagtgctctattcaataaatatgcagttgtataaatttaaactgattacaattaaataagactaaaaatttcggttcctcagtcacctagccacatttcaagtacttgatagccacatgtggtcagtgaataccatattggaaagtacagctatagagtattcccatcaccagagtaagttctactggacagcactattatacaacaatggttctcaacacttgtttccaccaaaaacacgttcacaaaggtgactgctttcatgggtttatgcagaattcccagtgccatagtgctgccacttttcttccttctcagaacacaaattagtaacattacaggaatcatcttgactctgtttgggagacaaattagatatttatgtcatatcaaacaccagaataaattccagataaaactctgaagaagaaaaaattataaagaacttgatctatcacgtataacttatattggaaattataatgattaaaatactatggtacttgtgtaggatcagacacattactataacagaacagtgtccaaagaaataatcttaagtatattatggattttaagaaatgacaaagatttcaaattcatgcgtttgagggaaaagatagatttttcagtaaatgtgattaggacaacagctggtcattgaggggaaatttaataaagctacatctatacccactatttaaaccaaagttaattccagctttctcaaagatttaaatgtaaaaaaaactataaagacactcaaagatattttagattatttgaaaatctatataattacaatttaacattttattttatgatatgtttatagtcttgagatggagaaggtttttctaattatgaagactgaaggcttaaaggaaaagattgatacatttaaccttcaaaaaagtctttatggtaaaaaataccataatcaaggttaattaaaaaactaggaaaaatatctgtgacacataacaatgggtagttattcttaacataaaagaacttccacatattaattacaaaataaatctcatagaaaaaatggggaaaattcatgaatagaatactcaccaaaaaaggaataccaaactcactttgcaaataaaaactaatagttttcacatatcagattaagaaggcttcaaaaccaacataaaacatggttttggcaaacctgtgaggatatggatgatccaacgtactgtttaaattggtccatttccaaagattgcattggcaatctgtataaaaatgtaaaataccttctatgacttagcaatttcactaagtatttattctaagaagataaatgcaagtactaaaacatgtatacacaaggatgttcattaatgtttcatttatactggcaaagctttgaaaacaatataagtggctctaatagtgtattgactaggtcaattgggatgtatcattttaatcagttacttggacacattaaagacaaagcagacctacatttattgatatggaaatatatccataaatataatttaatggaaaaggtagcttacaaagaaacacaattcaattttttcacttgtttatgtatttgtgtacatctatgtgtgcatataagcatatgaaatgtatagaaagtttttcaccaaaatgttaattataggtgaaaagactgaattttctttaaaaaatcagcctgtgcttttgtttatttacagtgagaataatacaagcatatattttataatgcatttaaaatgcttatggtactcaatactctgcttaaagcacagtggcagttattatgcttatataatttataagataagctagtcaaagttaaatgtgaacttcagaaggattcaagtgttaaatgtaaaaaaaggaaagtatataataactaaaatataataaaagtaacctgggagcaggactttctaataataataaaagaagaaatcagaaaaatcaatagagcattttacataaacatagaaaatgtatatggataaacatataataataaagataaattggaacaaacaaacaattgtaatatttgatatgtaaaggtttatattagctcaaaaatataactttccatcagctaaccacccacaaataataaggtgttatttggactcttattttttatattataaacatattgtatatatcctataaatatatagagttattgaagtattttacatgctagctctggtaacacttgcagtgattctagaggaatatggattggggaatatggggaaaggaccatgtagtgtaattttctgctctaactagacaaggataaagcctcataagatagtggcagatgctgcatatcttggcatgaacttacctgctccattgttctctatagatttacagctgccagtgccactatcggtacagggaatggtcttgccagtgccactatctatacagggaatggtcttgccagatccaaaaatacagctgactttttcccctatacaccattagttttttaatattcagcatctatgtcaccatatttccatttaaggggatgtttagaactaacagctctcctggttcttgaaccaaactcagaatcaaaaaggtcacatcctcatctgaggaaagaaaaccagatcagggcccagatatcctttagtgaaatatctgctttaaactttctagaaaatggaaaaatcaatttccctaacgtctatttcctaggtcttatttaatgcccctaataatgggtagttgtgacacagaatttagactaagggctatgaccacaaataatgatagctaacattcagtggagactaattatattctgggttctattcttagtacagctttatatgtattaaatcatttcatattaataattattttactgggaggtaggtggtatttttattacaatttttagatgaggaaactgagacacgagttcagtaatttgcctagtcacaaagctattgaaatggctgttctggggtgagaacccagccagtctcgctctaaaatccatgcatttaaacgtgacacaaaagtatgtatactaagagtagtaacagatactatttagctcagttatgtagctttcaaattttctacaattaagatatgttacttctataatcacaaaatatatgatattaaaaattaaagcttcagatggagccatagacatagccctctcaactcttcaattttgtctttatattcttttttacaaaagtatcctaaggcgttgtaccataggatatatcatttaaaaagcctacttaatatttggaggtggtaattgcaatctgttgaccaaagataattgcattttgcaaccagaagggatgatggggtaaaacctctgaaacttttgcttcagagtctaaaatgtacaattatttcccaattgaacctaataactgctttataatatcatttcctttgttatccagcctaaactttgtagtattgtccttttgctaatatcttcatctgattctagactcattatcttgtcactaaatctgcctacaacacctccctctccgtttttggatcaatctaaccaccactttctctgttccaacatctctatggctgaactctagagaagttcatacctgtgccagaaacagtacatggtctaaaacctcatttgggccctgcagaggtgctaggaagaccttttacatgtacatattcagctttctttcccatctgtttcccatggtagttatttcaaacacccactgctcatctcagactacatttttccattcaggcagttgttcttgcctttgactttactttcagacttgactttctaactccattcattctcttgcctcctccccttccgttcccatactcacccaattccctagtgttttgttcaaagtgagtaattccattggatcctgtgtttaagagttccatgtcctcagttatcctctgttttctctgggaagtagcagtagttgggaaggaagtctgaatagccaattggagcattggagcttgggggaaagaggtcattaataaatgcagaagaatatttaggtaagagtgagagttccaatgaggttagggatcatgactttataagtgaaaatagtctacacagctgtgcagttttttcaagctctgctcaggtgtaagaatggaggaagtggacagttgtgttgatccagaactgagttttgccaggatccatcacagggacaaaagaatgagaaggtgaagatattagtacaagttgtggaagtgatggattatgaattgaaactgtatagggaaggaagcatcagggactgataagtaaggtaaaaactggttgtgaggtgggaagaaagtacaagggtggtcggggactgataattaaggtaaaaactggttgtgaggtgggaagaaagcacaagggtggtcggggtctgtatgaggaggacacaagagcagggtgatgatgcagcccagcagtggctagggcttatgtcaggagagtatatgagggatggtagccttgcaggggtcaggactcatacagagtggggtggcagtctggcaaggccggatagttgactacatgctgggagaatgagcaaataaatatattaagagtaataggagtgggcttctcactgtcatagaaggcagttacaaatatggaaaggcgggaggctagaagggactctgtggttttgaattggaattatcagagtcattcatggctatttctgtctccatctatgtatatatttatgtttctatttgtctatgtaaatgattatatatcttacacatatgtatatttcctaactttgtccactgagagggccaggaatagcaacacattagtagtgataaacataacaaacacccacatcttagtttgtcaatagtaatcttcactaaaagtaatcagagttctttgaagaaattgcttatctcaggcctggggcagagaagcaaaaagatgagggtgggcacatcttgtgctgccagaaagtaagaagtgctcaaacaatgataggggcatgtgaaaagacagaaagagagtttgaaggggctcctactagtgctatctccaagaatagagagaatgctaaagctgaatggcatgagcctcaaagaggcagaggtttttacatgaaggcagtgatagaagtggcagtgtgaagacaccttacacatttcctgatcctgagctggatctaccagagagggccgaagggggttcttttaatgttgaatcagtcccaaggcagagatcacgtgcagaatggtggtaagggatctggaagggcacacagaggggatccagcacagtagtaaagagatacaggcaacagggaatacaacaaagataagaggtgaagagaaactctagcatttcagttgtgcaaataggtcaagggaacaacttattgagattttcagcaggaagagagagggctccaggagggatgttccaggaaaattattttcatgagtttttaatgatctgttggaaagtttgggggcacttggttatagagatatagaaaaatgagtcacgtgaaaatgagacaattttcatattataactgcaggaaaaacaaaaagttcaagaaaggaaatgaaatcataatatactatttggctcacaacttaatattcataataatgtaaaattatcacatagctatatttgaataattgagagaggacaactggttattatcttctgtattaggaactcaatagataatatgtaatattgactaagaagcagaaatatgaacatattgtttataaacatggagatacataacagatgaaatagcttaaaaagttgaagttgtctttaagaaaaaggacttggggtaggggcagagaactgctgttttatatgtattatagaattatgtataaagatacatgtcaaaaagttatggtgcagagaaatcaaagacctaaaagcaaaaataccattcaactcagcaattccattactgggtacatgcccaaagaaatataaatcactctatcataatgacatgcatatgtatgttcattgcagcactattcacaatagcaaagacatggaatcaacctaaatgcccatccgtggaagattggataaagaaaatgtagtacatatataccatggaatactatgcagccataaaaaagaatgaaatcatgtcctttgcaccaacacagatggacctggaggccattatcctaagcaaactaatgcaagctaatgcaggaacagaaaataaaatcccacatcttctcacttataagtgggagctaaacaacgagaacacatggacacaaagaggcgagcaacacccgctggggcctacttgagggtggagggtgggagaggatcagaaaaaaatactcatcaggcactagccttagtacctgggtgacaaaataatctgtatacgaaacccctgtaacacatagtttacctatataacaaacatgcacatgtatccctgaagctaaaataaaagttagaaaagaaacttagggcaagaccaaagtgaggaggactattttaaaaacagaacaatctactggggagttttgaaggggggagccaaaggagcaagaggaaaaaatatgcatgtcaaaatctattttaaccacttttctcaaactagagctcactctgtgctgccctcagcactatttatattagaatcttccccacccctatccccacacaaacatccattgatgtgcaggactcctaattaattgcccaaattacctgattctactcttctgccacagtttcagttacattctacagcacttagagccacaaaataccaagaggaaaacaaagcaaaacatgtttatattacctctcactatattcaggattgatgtattgattaaacctctctgtcacttccatagtgaaaggttgtcctgccattggtccattgtattattttcttcccccagtactttctggcttcttacattgcaaatactcactgtcatccttctcccactatgtcaccttctatatagacatctgtgttctgtcacagcttttacatttgaacaactattcattttatagacattacaagtaaaatacattgtcctgcaaggaatattacagttgtacttcaggcacgcctgctttacaatgtcaacaagagggatccattaatttatagttttgtgtttggtaggggaaccatataatattctacatatatttagttctccagaatgtagcttaatcaatatggcacctcaggcaacctgaaatactgaaggcaacataagattgtcagaccaagaaattttatgtctgctgatgggggtttaactcttttggaggctgcagaaggtatatatatttagaagattatagtaaagtcgatgataggaaagaatcaaactgatgtgtataaaaggtactgagggagagagaagtctgtatttaggaccccaaggcagaaacttccaggttctaatccttgcctgccaaccttgagcactgtagaggtttcaataatattttctatctctgagtgtcattagacatttataaagggaatgcctcatgtaggaaaacctgcagtaccaccttgagccaaccactgacctctatgcctgagtttggcacctgccaagtgagatgggcagttgaactatgtgcctttaggtgcctttgaatcctgtggttctatgattttagtaccatgctctgcttatctcaaagagctattctgaggctcaaatgaaatacttgacatgcaaatgccacaaaagtttcaagtgctatacgaatgaatgtaaaagtgttttaaattatgcatctctaaatataaccaacaacttgcacatgctctcccaaacaaagcaaatgggcttctgggcttcgattttcaattagtctcaaaacatatgattttacttgttccaattttcagaagcaaaaggagcaaaagattcaaattatgatctttattaagaaggtactaagccacttagaaatgctgggcacattatgtggctcggccaactttttcactgttgtattgtgtgggtctcccaaatagcttttactgtgaagactaataaaaatgataggaaagttaaaactgagcagaattagattaaatctcaatctgtattctgcaagggtttttatttgtgtgtgcatacttttctatatgcttctaatctcttcatatggtttatagatcagctattagttaataggttctgacatgtgattaatatgtaggtatttgaaaattcatgtggtgcatgcctatgtctatggagcaaggtgctgaatctgcacattcacctcaggaacattggggatggaaagtcaagcccagaattatcttttgcatgaaggatgctagctagggcctttctaggtccccaagggagacactgaagatcttttttcattaaataaacatccactaagaacccgataggcttcatatactatactattcgctgggaacttctgacctcaagtgatttgcctgcctcagcctcccaaagtgctgggattataggtgtgagccaccatgcttggcccagctttttctttcagataaaaattttttctttcagaaaaaaaattgctccttccttaaaagttcatcatgaattctcaaagagagacacaatggtcagctcctatgacactaaaatttagataccagaataaagaatggaaggtaaaaactgcccaaactctttctggggtggtggtcaggaggatcagtccctgagaagacagagaacttaaaggatatacttgaaatttttatttaatgcaaagtataacactttctgcctaaatactgctgcattagaagcattttattgtaaaatctctttccaggcacatacactccgctgctatgtacacaactacaaaaacaggcaaggccaagagcagtcacaccagctactatggtttgttagtggacagaagtgcttgaatttgattaaagcaaatgcaacaaaggtttacatactgtgagtaaaaaaaatgcttcagagcacccaactagcaaacaggatgtgcacacctcaggcctacctgaaatggagagcaaacagtgatgtaaagtgtgtttgcatgaaaaaaagactgctaaaaccggcattaggctgattttcaatttatattaagggttggtatacttttttctaacttggtgaacagtcaacaagtaatcatacagctttttcttttctctctctctctctctctttctttctttttctttccttctttccttccttcctccccttcctcctttctcctctttctttctttttctttctttctttctttttctttctttctttctttctttctttctttctttctttctttctctctttctttctttcttttttttcttttttctttctctttctttctttctttctctctctctcctttatttctttctttctctctctctcccttccttccttccttccttctttctttctttcttttttctttctctctctctttctttctttccctctctctctttctctcctttctttctctttctttctttctttctttctttctttctttctttctttctttctttttcttttcttttcttttctttcctttcttattgagatgatggagtattactctgttgcccaggctggagcacactggtgtgatatcggctcactgcagcttcgacctccaggttcaagtgattctcctgcctcagcctccctagtagctgagattacaagcatgtgccaccatgcctggctaatttttgtatttttagtagagtcggggtttcaccatgttggtcaggctggtctaaaacttctgacctcaagtgatctgcctgcctcagcctcccaaagtgctgggattattggtgtgagccaccatgcttggcccaggtttttctttcagatagacatgcatatacacatatattatcattattgaggtacaatttacataacataaatttatccatttaaagtgtataattcaatattttttagtatattcacagagtcatgcaaccatcaccacagttttagatatttttatcatctcaaaaaggaacccaataccaattagcagttacactccatttacccaacatgatgcctcaagcccagacttacgcaaccattaatcaacttactgcctctatagatttgcctattctaagcaattcgtataaatggaatcatacactatgtggcattttgcatctagctcccttcgctctggcatgatgttttcaaagtgcatccattttgtagcaggtgtattttattcctttttaattgacagataatatttcatagtatctatatatcacaatttgtttaccattcatcaattggtagacatttaggttgtttccacttttttgctatcatgagtagtcttacagcttcttacatcagtttctaattagcatgcacatcactaagcactgatccagatattaaaagatactagtcttcataagctggccatcccccaattccttgccaaatcaccaaaatcagttaaacatatttggaaaactagacaataggtataggcagataataggcacttaatgtttcctgactcaggaattaatggatgagaaaaatcattccttcagttctaattctccttacaataacatccctaccagtgccacctggatattgtgtcaaggtatgctagagctggaatgaacgtggagtcccgggttcctcaaagtgtgggtcaagaaccacatgtgtcagatccaccaggggagcttattaaaaatacctatttctgtacccccaccccagagaatctgattcaataaatctcggggtgaggccataggaagctgcctttgtaataagcaccccagataatacaaatgcatgttagagtttgagaatcattgatttagtccaacctccctactctataggagaagaagtttaggacttgggtggggaagggacatgctcaaggttacagggcatggtaaagataatgcaacagggagttgaggttatgaatcctgatatagcactttccattaccttgggtactcttctttatcacatctccttcttttcctggtgaatacatgcctccctcacagacttgctccataagtgtcagtgtctgacataccctaagtgctcaataaatagtttttttttttttaagcttagtcctgtgtgaactgaatgactaaaggatctccttttggggcagtgtttgctaaaagtataaagtaacaagtataaggcttaagaaaagaataccagacccaggagggagatctcagtggttcctgacccaaatgttgaaaagctcctaagtgaaaaactgttcaaccatgggtttttggtgaacccatgaagctatgtagtgacatttcctatccaaggtccttaaaccactctatacacccactgtgatctatttaaaggagccaggtctttttagaaaacagtttctgccaagttttctatcagaggaaaatcataaagtaggtgagctacagccatgactaaaaggtagtggaaatttttctaactgaaagttgttatgcctgtcaaaaagatagactcagtaaaaacccattactgtgcagcagaggaaaaaatcatgggagctattttaaaattttttcttttatagttttttaaattacaaaagtagtgatttgttgtaccgaatcaaacaaaacaggagtgaataaagaaacattcagttatcttttctttttccttctggtcttcctctttaaaatggattcatttggaatcaatccttccacactttctctatctttatataaaccatacataacatatgcacaaaaagacatatatacacacacacatatatatacacacatatgtatatatacacacatacacacatgtatatgtattatatatacacatatatgtatatatgtgtatatatataatatatgatatataatatatatataatatattatatatattatataatatattatatattatatattatataatatatattatatataatatatattatatattatatatattatatatattatatatattatatataatatatattatatataatatataatatatatataatatatatataaatgaaatcatgcccccttcagttctctgcaccttttaagttcaggggtacatgtgcaggtttgctacgtaggtaaacttgtgccatggaggtttgttgtacagattatttcatcacccaggtgttaaacctagtacccatcagttatttttctcatcttctccctctttccaccctacaccctttgataggccccagtgtgtgttgtttccctctatgtgaccgtgtgttctcatcatttagctcctacttataagtgaaaacgtgttatttgtttttctgttcctgcattagtttactaagaataatggcctccagctccatccatgttgctgcaaaggacacgatttcattctttttttatggctgcatagtattccatggtgtatatgtactacattttctttatccaatcttccattgatgggcatttaggttgattccatgtctttgctattgtgaatagtggtgcaatgaacatgcgtatgaatgtgcctttgtgatagagtggtttatattcctttgagtgtgtacgcagtaatgggattgccgtgttgagtggtatttctgtttttaggtctttgaggaattgccacactgttttccacaatggttgaacacatttacactaccaccaacagtgtataagcatttctttttctccacaacctcaccaacatctgttattttaaaactttttattaatagccattctgactagcgtgagatggtatctcattgtgggttctgatttgcatttctctaatgatcagtgatgttgagcttttttttcatatgcttgttggccacatgtatgtcttcttttgaaaagtgtctgtttgtgtcctttgcccactttttaatggggtttgatttttgctttaaaatttgtttaatccttatagattctggatattagacctttgtcacatgcatagtttgcaaatattttcatttattctgtaggttttcctgttttttctgttgatagtttctttggctttgcagaagctccttagtttaattagatcctatgtttcaataaacaagattttcaggccaatattttgagagatgttgcttaaattcatctaaattcactttgtctatggctccacccagctcttaaataattgctaccaaactaaactgctacttggactgtgaaattttatttcctgcagtagccagctgtcagatcacaagcaactttactgaacacccacaagaattttctttgggttgtaaagtcaagcatcttagttatcatgtaagcattaatttttaatgctttaatttgaccaaaagcattgtgttgtttgtgaaaggcctcccacttcttttgctgtggaaaaaatctggagtctgagtccaagcttttttcctttcttaattagaaaagcaattttctcaccttattttctttctcctgagaaggactgaaagtgtttgactaagaaccttgtgcacctcttctttttttagttgctttttgttttattcattggctcaatccttcttaggttgctgaaaaacagctcctcaattctgaacccagtgaagggaagggcagcatcattctgggatctgtaagccttgcaatttgggaggatcagagtacttttaagatgtaggtgccctaaaataaatttctaggacaggggtactgaaccagcttcacagagcatcaccacttactagctctgcagctctgggtaagttgcttaacttctttgaccttgtcccagttattatacatgtacaatgaagacagtaatgatacctacctcaaagaattgtgtggggaataaatgaggtgaagcgtataaaggatttagggcagtgcttgctttgctattatcacattatttgtcttctgcaaccaccaccacagatggccaggcctgccctcagaagacatcttgacatagtagtcctggaactgtggcacaggcatgtgcattctaagaaatctccttggggattctgatcactatagacagtgattctcaaactttaatgtatattggaatcaccccactcttagaaattgtgctactttagttctggaagtgggggcccaagaatgtgcatcctttgggaaacactgctatagaggaatcgcatgagcacccctccttctctactgtatatatctattgtgataatcttttaagactgctgacatattgttggaatagacataccacacaggtaatgctgccaactcactttcagtgggacaaaaggcataaactacagagtgttttctttttcaatcatagtaataaattagcacagatacacatcctctatctcctgaacaaaggcatgtagttgcaaagtgactgcatggggtatagttgtatagccagtttaccatgtgggaagatcacctttgacaatagaaataataactttgaccattatcgatagccagccagcagccacaagtaactgtaggaagaagggagcaggattgcttagagtttatgttaggtattcattatgtaactggtgcttaatgggcctggtgattttttttgttttagtggaaaaatgttttatctgatttgtttgaaatatttttccattctgtcacacctgaaaagagaaaaatgagggctttgaggaattttgaaccctcatttgttcttagcccatgctgcgtatcacctgcctctctactcattgtagaaatggaacttttcattcagtaattttctagatttctatagcattttgaaaacccactaaccactaagttgtgcgtgacttaatgactgcactcccctccccgcccctccacacactcactcatttaagtttatcatctctacttcttgagccctgttccttttcaagtcaacagtaccacccctgaactttctgagcagcatgtacaaggcaggagtttctggaggtatttatcccccacttgcacattcttatgattcaagtcatatctaggatcatcccctggctgtgttggtgctaagaattgaaaatagggaaagaacattcttgaaagttcatctttttgaaacttagtagaaatctccagtcttaaacttacttctagaacttagaaaaccaaattatcttaatgcccattaagtgttgtttactctcagattttccaagtgttgcaaaaaaaaaaattgtttagaggtttggagaattaactcttgcttttaaaggatgatctgttttgaatagtataccaagcaaagtttaataaagtaagtgagattaatgaaggatagtctcctgaatataagcaaacaagttgcttgtttatacagatctctatatttcttaagtccagtggaaaacttgacttctgaataatcttcactgtggctttcacagatagcagcaaaccttgctttctcagtgcctgaatgtttgctttggggcaatcatgtttcttgaagtatgcatgcaatttgagttttaagaggtgaaaaaaagattatgtccaagacatggtttatataaatagaaaagattggttgtttagtttcttcatttttgtaatggtatgaaatatagctgtccaaccatcttgtttttggaggttgtatcagtcagggttctgactgggatagaattaatttatctatgacggaggttgcaaatttttttgtgtgaaaaatcagactttggcgatgaccttgagcagcaggatataaataactcctacaagtttagcattccaataatggaacactaggcaaaaatggattaataggctctgcatataaaggggagttcattaagcagtattaactcacatgatcacaaggtcccacaataggccatccgcaagtttagaagcaaggaagccagtccaagtcccaaagctgaagaatgtggagtctgatgttcgagggcaggaagcatccagcacaggagaaagatgtaggccgggaggctaagccagtctatccttttcacgtttttctgcctgctttatattctggctgtggtggccgctgattaggtggtgcccacccagattaagggtgagtctgcctttcccagcccactgactcaaatgttaatctttggcaacaccctcacagacacacccaggatcaatactttgcatccttcaatccaatcaagttgacactcagtattaaccatcacagtggtattgagaaaacactttgaggttaattatatatttttgcgacatgtaggcataaccttatctcttaataccatttgattttatgatgtctttttttcactttgtgacatggggaggggatttgtataattgttagtagccgatgttatgtgtaaagactcaaaaggggctaacctgacacattttgtgtcagcactttgttttgagaaagcgaaccacatgtttgccttagtaagaccctctaatttgagaccagttatcagattgaccctttgttcctagagtgaaataaaagactcagtgaaattttaacaagttagcatttgctcacttacactgaagaaggcaggaggctttagttgaaacaaattgttagcattgacaataggaagaaaagaaaattctaattaatataatagttaccctttctaccatccatagtagcctaagttgggttttttgtttgtttgttgtttgtttgagacagagtcttactctgtcgcccaggctggagtgcagtgacatgatctcagctcactgccacctctgcctcccgggttcaagtgattctcctgtcctggcctcccgagtagttgggattacaggcgtgcgccaccatgcccagctaatttttgtatttttagtagagacagggtttagccatgttggtcaggctggtcttgaactcctgacctcaggtgatccatgtgtctcgatctctcaaaatgctgggattacaggtatgagccactgtgcctggcctaagttggctctttatccttgacacacttatcagactagttttgaatattttatcacatgatttttgatgacattcttttgaaaaatcacagtttcttgaatgaatgaacctattgttcttatctagatggaacattctcaaaaagatgatgggcactctaaatcatagtctttcttcccctatctaaatagaatccaaactggtaccaacaacactcaggaaagaaacatctgcatgtgactttcttgtgtgtttttatcaaagtgcagcacctatcaagagagacaagctgtgatctgcatcttaccagtaaccagaggtgctgggctatgggtcaggaggtttgtgttctaggctggcctttgctgctgacctcctgtgtgacttatcacagatcatttttggcctcggttttctgacttgttttcaaaaagaaagattgttttagatgactacttaggtccctcacagtactaaaagcctatagtctgtacttttaatcacaatctatgagatgattcgattgtcttaatttgttcatactctcttcctttaatcccactgagtgtccttaacatacaggtaatggaacacattgacctttatttttgaagttagtcccagatcaggaaatttctcataatgccaatgatttcttagaatacaggactcttctgcatcccattaccagtaaaggtacacatacacaggcaaggaaaataagtatattcttcaggctatgggggcaagtgtctgaaattattctgatctacctagaaactatcttactttttttccttctctgctttatgagttgagagagcctggttgatctgcttcctttcgtttgactttgtaattattgttcaggcaaatataaatagtactagtattggactagtaggtagccaagaaagagaaactggaacagctatatgtgcccacctccccactccccactcccataaccaacagaaagtatagcaacaaaaaaaggaacaagcactacagtggatttccatgccccgctagcatgcatgtgtaatatactatagcctatcagatggtttccacatttgtcctagctgtaagtcacaaggcattttgatacaaataatacttgcgaataagctgtataaaatactcaccaagcaacactgaagctgtccctggaagtgacagtttgcagtcatgaatgatgaaatatcctttgtgtataaggcaattgtgttggttatagaaaaagaaatgagacttcctaggtttcttccttctgtggcttttttttttttttttggaaacaggaaagcttcctatacaatgatgttaggacctatatttcatttcatttcaactttcatttacagttgttgttgtaaagggaaaacattttaatcagtttctgcatgaaggtcagataacactgtgaacaaaagtaatttctttatgataatatcaaaacaaaagcattgctacacttaaattatgaagcatgtttcccttatctgcagtacaattgtatgacttaatagaatctgggagcgtatctcatttatgctactggtaaactcaagaaattctcttccttttaaggtctgaagttgtgatatcgcctaagaatgagaccagataatattatgtcctgggtataaattaagttactttgaaaaggcatgagaattattttaggtatttgtttgtttgtttgtttgtttgtttttgtaaactgaagcagtgttgacattttctatccttttgtggcttagaagatgccatatgattttttttaatgcccgtatatgtgtgtgtgtgtgtgtgtgtgtgtgtgtgtgtgtgtgtgtgtgtgtgttattggaggtaatgaagtggggcagaggtattcataataaagtcacttttatctggttttggagtgcaaaaagattcacatttagtagatacacacaaacacgcatatcctgaacttctgcctgtacacgtcttcttcccaacctccttctacattgtgcttatcagttgcctgcaaaggaaaatttgagactgtctactccaagatcgtggagaaattgattagagttgcaaatgcagactattgcctgaagtaccttcaggaacatggtatagagctaggtgatgtatagtgataatacaacatatgcatccacccacccacatccatactttcacattctccaatatcctttctggtccatcattttaagaagttccataaatttaggctgcagtctaaagcacaagaagagttttaacagtcgcacaggatgtcacaaaaattgtggtacttctaagaatttaatccaggagaattattccatcccattcttaaactgtaaccacaaggcatttccccagaccctcaaattcttatccatatctttatggcaccatatatgtttctagaagtaagaaacatagccggttccattttggaagtcttcttaagcattgtgacttcatattttactagtgagaatgctggggaaaagtaacatttcatctttcatgaacatttctaggattatgtagagaggaaagaatatttgaaatgttttctagccactgaaaagtactgtaacactcagacaaatcccatctcccatgatatctaaaagtgatccagagacttattacagtaattttagatggggtctctgaaccacattgatcagaaagaaagattatctagtaacataggcaaaacaaattagctgtccttaatatctagttgaaatccttaaaaaggagaattactgtctttcagtatctgcagggctgctaacattggaaattataatggtgactatatacatctttataatattatatcaccaggtccctgggctactctatcactgagcttcttaatctcctttgaccaaatagcaatttaaaagggaattggtagcattcaggcatctgctaccctgtagaaatattttaaagcattttcatcttgccttcaaggatccaatgtaatgacttaaaaaaatattttggggagaaaccattgctagaaagagcactaaacttcaacttcagaaaacctggattccatcaataagcagttgagtaaccttgagaaaatcacctagaaatttgaacttcaatttctttatctgtaaaactgagtaactaaaactaggtgagttattgtgataaccttctaattgaactgtctgcttctgggctcagccccatcccctattttgcatccctgttgtcaaaaataacatacaagtctgaccatttcatctcttccaaggactgttacaaatttctccccatccttctttcacttccagttttatttcctaccacacccatttttgttttatgctacagttataccaaaaaaattgaaattttcttagtttaacatgctgctttacctttccatgcatctgcacatgtgttattccacctgcgtggatgacccttcaacagtgtcctacactctggtattcccaataaatttcctttagtctttgaaatcccagctcagattgatgctccctagcgaagccttttctatctaccaaagaccctactgtggactatctttgtgattttttcacatttctattattgtatttatcccaaaatgttgtaacatatttatttcttatctgtcttctctttaatattttttcagccagggcttatgcctgctttcttgcctgccttccccccaacaaatacttatagaaggcttacttttgccagacagtgttgtcagcccagagggatacaacagtgaacaaagcagacaagaatacctgtcattatggagcttctgtgtcttattcaggtctgtatccctagaacctagcacagagactagcatttagtatgtaaacaagcaataattttggtttgaagccaagaaatcagaattatggttacattggaaactcccatatctttctctttcttactgcctacactatgcatttagtgttctacttgtacatacattaatatttagttataatagttaatcagtgtgtcttacttgcctaagtttctatataactttgtttccattggtgctgtctgtcaaacaccattgtctgtcaatcagcttctgggggtgctatgctctcttagttgttcagacccaacacactaaaaggggtgccctttcattcatttattcaatcaataaatatttattgaacatctactattatgtcaaataagacatatgtgctcctgcccttttagaacttacagtctattgagcaagacaagcaatgaacaagtaaataaataaatatgttattacaacatatgattgttgctatggaggtaatgaccatgaagctgtgatagagagtaatggggacagctaccaactttagagtaattgaggaaggcctctcagaagaagtgacatgtaggtcaccccaaaggatgaaaagtatccaaccatgtaaaaggttaagggacagcatcaggggacaaagggacagtaggtgcaaagctcctgaggtggcaaagagcttagtgaattggttttggggaaaagagcagtgtagctggagtttagatagtgagaagatgattaaattagagaagtagcaggtggcttcgtatggcatgttgaggcacttagagtgtatcctaatgggaatgacaaaccgtcgaatgaatgattttaagctggagagtaacaatcaaatttatgttttgaaaatcccattctgaagactgtgtagagaatggactgtgtgtgaggatgcagggacagcagtatggacctgctgcagtggtccaggagagagatggtagtcacctcaatgagtgtgaatccaggagagatgaagagaaatgtcagatttgggagacattaattagacttacaatcgtatttaatgttgaggtgggaaggggaaggagtcaaagattatgcctaggctctggcttgagctagtagctggctggaggtgctatgaactgagatagggtttatggcggggtgcaggagacaagttgggtggatagaaaatgcattttaatgatgacaaacatggtggtggcaatgatggtggtagtggtggtgatgttggatttactatagttggaggaaagatttaaaaatcttgcaattgtcaataactttctttagtgtgttggagaaagtccagtatatgtaatgtatttaaattttgcaagtcttctggatgcttgacctagaaaatatgcctttgtcctgtcctttatcccttcccaaagtgactaggattacattttctctaaatataccattaggaattaaaagatctcttacaattcaggaagctatgagaatatttaagacacaaggaatagagagagtaattcttaaaaggtaacaacttttcatttgttttcatcttgtgcaaatggtttattttctcaaagttaggtaacatttttaggccagtctctatcaaagtaatatccaaggatctcttacataaaaatcacctagggatgctggttcaaagtgaagatccttgtctacacaactaatcagaatctctagggttggggcccaggaaccttttttatttttttttttcaggctgacatttaaaaagcattgcttgagacaaggtattcttaacctttttggtgccccagtctctttggtagtctggtgaactctgtggatcccttctcagaaaactgcttaaacatgcattcaataaaatacaaggaaaacaagtatattgaaatataatgatcaaatattttaaaaacaaattttatataatattttacatacttttaattaacatattaataatgagatctaatactgggtctaatactaccataatttgaagtaataggtgaacataaatagtattttaactcatttgccacaattctaatgtgatatgaaattatctgtaatttctattagtgacaaagttacaggttcagctaaaaccactgtgatttgttgcctagattcataatggaaggaaatgctaaatttcagtcagaagtgaatgaaaataatggtataatgtttttcccatccaagttcacagataccaggcttagaatccttggctttgagattgtgaccaactagtacagagactagtgagggtatagtgaagacaaactggaatccagatgctagtcaacagaacaaaactcagggatgaagtcagtgagcctcaatatttggtattattaatttaaataattaaaagaagattcagggaccaaaaaaattgtccctgcattgtttggcttttaattggttggtttggctgttttgcctgagtgtacctggagaggcttgtctgtatactcttgttattgtccccttctcttgaaccctggctctttcagagggtagctatggagaaaagtttagattttgaccattttggggtgtttaattaagaacgttttccagaatggagagagacattcaaggatgaggaagtaacatgcgcagtaatgacagagtcaggaacaggctagtattagaaaacagaaggaagttcaaagtagctgaggcatacagtgggtgagtgagagagaggcaggagatgaagctggagagatggattagcctaagtccaaagagggccttcagacttcatgtacatgtacgagtttgggtatcatgatagagtcagcaggaagccaaaggagaactatatgctgaaaagagacatgataggccaggcatggtgtctcacgcctgcaatcctgtaatcctagcacttttggaggctgaggcaggtggattgcctgagttcaggagttcaagaccagcctgggcaacacagtgaaaccccatctctaccaaaatacaaaaaattagctggatgtggcagtgtgcacctgtagtcccagctactcaggaagctgaggcaggagaattgcttgaacctgggaggtggaggttgcagtgagccgagatcaggccactgcacgccagcctggggcaacagagtgagactccatctcttaaaaaaaaaaaaaaaaaagagagagacatgataaagtgtattatttcttaggaaaataaatctgatggcaaaatgagggatgggttagaggaaggcagaccacttttgaggctttggtaagaatgcaattgagaaaagtatggttctctgaagtaaggctatggtcatgagacagaagagggaacagctatgagagatgttaatgactgatttggatatatgccatgaagaagaagagtttgggatgactttgaagcttctagcttgagacttcaggtaaatggaagcaccattaacagaggataccaatcatgagaggcacagcaggtttttgggggaaggtttttagttccttcccctaaagaagaagaataagagtttgggatgactttgaagtttctagcttgagacttcaggcaaatggaagcaccatgaacagaggtgccaatcatgagaggcacagcaggttttttggggaaggtttttagttcagttttggataagctgagttttaagtacctattgaacatcaaatgagaaatgcatggagtttccattttaaccatttttcatagtaatcttttaatgtaggtaaatgatgtgagatattctttttgtctataaattgactgactgaaaattgtggggcagttatgtttcagaaatatgtaggattgggtattatattgtctttttattctaattttgatgaaatgtcaaccaatggctgtcctccaaagagttatagttgtatagttaattcttctggattaaagaaattcttcgtatacttatggtaattaattctagcaacatggaatatcagtaggcttgccttcttatgtctggagtttagactttttttgtgtgtgttttgtattacacattttttgttgttcttcacttggctttctatcatgactgctggaaggcagagggttgtaggtaggatgggagcaagaagcagtggaagtgtttgtgcagtcattttttgtaacagctccatggcatgaaaactactctcagcaactggtgtgaacacaaagggaaccggctagtcgcagccatctccatattcattggccttttaggttttggggcctagaatgaggggagaatttcactgtgaatgcaggatgttgaaatgcaaaattggcttttaacaaaattatgagggaagagatatttatctttgtgttccttttacctctgcctcactattctgaatccctgtacctgatgcctctgtgttaggttctggttggatcatgggccacactttagcatcttgcttagacttgttctctctaacagccattgttcctttgacctttctctttttgtgataaaatttcttgttcctatttatatttgataaattattctatatgaatatctgtggttacttacggcttaaaatatgctataccttccaagtagcaactacattttaagaggggtcctgggacaatgctttaacctagagttactctaatggtagggacagtacttatcatagttggggtccacaggtcttccctaatattttaaaaataatattgatagcatacacatgtgaaagacatttaacaaatacagaagaaaatgtcttcatttataaaggctgaggtaatagtgagtaaaagtagatataccaggcagaagtcatttgtagaagcttgactgaagtagatgagttatttttgaggatagtgatagaaatggggtgaagtgggataaggagaaattgcagattttcactgaaatgactttgagggcagggaccatgcctttatatttatgtcctccataggacctggaagaatgatctgtatatagtgtgtagtaatggttagtttaaatgaatgagcaaatccatgtggggaactattgattttaaatttttttaaataattaatttatttttttgagacagggttacccaggctgaagtgcaatggcgtgatcatggctcactctagcctccacttcctgggctcaagtgatcctcccatctcagcctcctgagtatctgagactatacgtgcatgccacatgctcagctaatttttaaatttttttgtagagacaaggtctcactatatttctgaggctgatctcgaactcctgggctcaagtgatcctcccacctcagcctttcaaagtgctgggatcacaagcatgagtcaccatgcctggttgatttttttttaaagaaaccttctgcatgtttatttttcccttaagaatatcctaaacccagatcgaatttagaaaggaaaaggaaacttttgatggatttagcacacacacacacacacacacacacacacacacacacacacacacgtaatcatttaaaaaggttggtggagatatgaaacgacttaggcaaaaatgaaaacccatttattcatcaatgaactccaggttgaagaaagttctatgactcataacaagttgtgctgacgagggagtctttaagttgtccattcatccctttgtgagatgtgagttttttttgtgtgtgttttatttggctttttaaatgttgacaagtctcaggtgtatgttaatagaaattctgtgatcataggtccattagaacagcatctgggaaggaaaactgatgctaagaaatcagcagtaagagggaataaaaatgcaaccaaaaccctttcgttgatatgcagcacaagctggttggaagcaaagggagtgatgcgatgatggaaatcctcattaaaattaaaagccatagaaagcggggaatagtatcaaaagcaatgcaacataaatcattatctacagggataaataaaatacaaaagaattagtgtttccagtttatgctttatgttgaaaataaaaatttgtttcttagaggtatctttgacatgtaacctaacaatggcaaactgccattgagagtccaggccttgttttaatgagtacctcataactgtacagaactagaagctacagagctctccagagtattagtaaatccagttttatgctatgaaaatagaaagtgaaagcacgttcactgtacctattcaaaagtaggaacaatattaatattctatttcattacagaatttcagttaacctaggttttagatatgatatgcaaaccacagagcaattttctatattgctatttttaattttttttcaactttttttttttagattaaggggatacatgtgcagatttgttacatgagtaaattgtgtgatgttgagatttgggtaaagaatgatcctgtcaccaagatactgagcatagtacccaatagtttttcaacacttgccccattccctctgccttctagtagtccccagtgtctattgctgccatcttgatatccatgcgtactcattggttagcttccaattataagtgagaacaagtggcatttggttttctgttcctgcattaatttgtttaggataatggctccagctccacccatattgctgcaaaggacatgatttcattattttttatggctgcatgatatcccgtggtgtatatgtatcacattttctttgtccagtccaccattgatgggcacttaggttgattccatgtttttgctattgtgcatagtgctgcaatgaacatgtgaattcatgtgtctttttggtagaaaaatttgttttcttttgcatatatacccagtaatgggttattagtaaataacccattatttattagtaaatccagttttatgctatgaaaatatttagatatgatatgcaaaccatggagcaattttctttttttttattatactttaagttttagggtacatgtgcacaacgtgcaggtttgttacatatgtatacatgtgccacgttggtgtgctgcacccattaactcgtcatttacattaggtatatctcctaatgctatcctccccctccccctaccccacaacaggcccccgtgtgtgatgttccccttcctgtgtccatgtgtttccattgttcaattcccacctattagtgagaacatgtggtgtttggttttttgtccttgcgatagtttgctatattgctatttttaatttttcttcaacttttgttttagattcagggggtacatgtgcaggtttgttacatgtgtaaattgtgtgatgttgagatttgggtaaagaatgatcctgtcacacagatcaccatttgacctaggtcaaatggcagttctcttttaacttctttgagaaatctccaaactgttttccacagtggctgaactaatttgcattcctaccagtagtatgtaagggttcccttttctctgcagcatcaccagcatctgttgttttttgactttttaaaatcactattctatggctattattaagccacattatgaaaaagttaagaaacaacaggttgcagagaaaacagaatgcttatacactgttggtgagaatgcaaattagttcagccattgtggaaagcagtgtggcaattctgcaaagaacttaaaacagaattaccatctgacccagcaaatacattattgggtagatccctaaaagaatataaatcattctaccataaagatacatgtgtccatatgtttgttacagcactatttataatagcaaagacatgtaatcaacctaaatacccaccaacagtagattggataaagaaaatgtggtagggatttcctggcaagatggccaaataggaacagctccggtctgcagctcccagtgagattgacacagagacgggtgatttctgcatttccaactgaggtaccccattcatctcattgggactggttggacagtggttgcagcccatggagggtgagccgaagcagggtgaggcgttgcctcacctaggaagtgcaagaggttggggaattttctcccctacccaagggaagccgtgagggactgagcctgaggaactctggcccagatactgcactcataccatggtattcacaacccgcaaaccaggagattccctctggtgcccaccccaccagggccctgggtttcaagcacaaaactggttgaccatttgggcagacaccaaagtagctgcaggagttctttttctccataccccaatggcacctggaacaccagtgagacagaatcaattactcccctggaaaagggtgctgaagccagggagccaagtggtctgactcggcgggtcccaccctcacggagcccagcaaactaagatccactggcttgaaattctcactgccagcacagcagcagtctgagatcgacccaggacattcgagcttgttcgggggaggggagtccgccattgctgaggcttgagtaggcagtattacgctcacagtgtaaacaaagccactgggaagtttgaactgggcagagcccactgcagctcagcaatgctgctgtggccagactgccagatttctctactctgggcaggcatctctgaaaaaaaggcagcagccccagtcagggacttatagataaaattcccatctccctgggacagagcacctggggaaaggggcagttgtgggcgaagcttcagcagacttaaatgcccctgcctgacagctctaaagagagcagtggacctcccagcacagtgttcaagctctgataagggtcagactacctcctcaagtggatccctgaaccgcatgtatcatgactggaagacacctcccagatggggcagacagacacctcatacaggagagctctggctgacatctggcaggtgaccctctgggaggaagcttccagaggaaagatcaggcagcaatctttgctgttctgcagcctccactggtgatacccaggaaaacaggattgggagtggacctccagcaaactccagcagaccggcagcagaggggtctgtcagaaggaaaactaacagaaaggaatagcacgtccactcaaagaccccatcttaaggtcaccaacatcaaagaccaaaggtagataaatccacaaagatggggagaaaccagtgcaaaatggctgaaaattccaaaaaccagaacgcctcttctcctccaaaggatcacaactcctcaccagcaagagaacaaaactggacagagaatgagtttgatgaattgacagaagtaggcttcagaagatgggtaataacaaacttctccaagctaaaggagcatgttctaacccaatgcaaggaagttaagaaccttgaaaaaaggttagaggaatggctaactagaataaccagtgtagagaataacacaaatgacctgatggagctgaaaaacacagcaagagaacttcgtgaaacatacacaagcttcaatagctgattcgatcaagcggaagaaaggatatcagtgattgaagatcaacctaatgaaataaagagaaaagacaaggttagagaaaaaagaatgaaaaggaatgagcaaagcatccaaataaatatgggactatgtgaaaagaccaaatctacatatgattggtatacctggaagtgatgaggagaatggaatgaagttggaaaatactcttcaggatactatccaggagaacttccccaacctagcaagacagaccaacattcaaattcaggatatacagagaacaccacaaagatactccttgagaagagcaaccccaagacacataatcatcagattcaccaaggttgaaatgagggaaagaatgttaagggcagccagagagaaaggtctggttacccacaaagggaagcccatcagactaacagcagattgctctgcagaaaccctacaagccagaagagagtgggggccaatattcaacattcttaaagaaaataaatttcaacccagaatttcatatgcagccaaactgagcttcataaatgaaggagaaataaagtccgttacagacaagcaaatgctgagagatttcatcaccaccaggcctgccttacaagagctcctgaaggaagcactaaacatggaaaagaacaaccagtaccagccactgcaaaaacataccaaattgtaaagaccatcaacactatgaagaaactgcatcaactaatggtcaaaacaaccagctagtatcataattacaggatcaaattcacacataaccatatttaccataaatgtaaatgggctaagtgctccagttaaaagacacagactggcatattggataaagagtcaagacccatcagtgtgctgtattcagaagacccatctcatgtgcaaagacacacataggctcaaaataaagggatggaggaatatttactgaggaaatgcatagcaaaaaaaaaaaaaaaaaaaaaagcaggagctgcaatcctagtctctgataaaacagactttaaacctacaaagatcaaaagagacaaagaaggccattacataatggtaaagggatcaatgcagcaaaataactaactatcctatatatacatgcacctaatacaggagcacccagattcatgaagcaagttcttagagaattacaaagagacttagacccacacaataataatgggagtctttaacaccccactgtcaatattagacagatcaaagagacagaaaattaacaaggatatacaggacttgaactcagctctggaccaagcagacctaatagacatctacagaactctccaccccaaatcaacagaatatacattcttctcagcaccacatcacacttattcaaaaactgactgcataattggaagtaaaacactcctaagcaaatgtaaaagaacagaaatcataacaaagtgtctctcagaccacagtgcaatcaaattagaactcaagattaagaaactcactcaaaaccacacaactatatgaaaactgaacaacgtgctcctgaatgactactgggtaaataatgaaatgaagggagaaataaagatgttctgtgagacaaatgagaacaaagacacaatgtaccagaatctctgggacacatttaaagaagtgtgtagagagaaatttatggcactaaatgtccacaagagaaatcaggaaagatctaaaattgacaccctaaaatcacaattaaaagaactagagaagcaagaacaaacaaattcaaaagctagcagaagacaagaaataactaagatcagagtggaactgaaggagatatagacatgaaaaacccttcaaaacatccatgaatccaggagctggttctgtgaaaagatcaacaaaatagatagactgctagccagactaataaagaagaaaagagagaagaatcaaatagatgcaataaagagtgatataggggatatcaccaatgttcccacagaaatgcaaactaccattagagaatactataaacacctctatgcaaataaaatagaaaatctagaagaaatggataaattcctggacacatacacccttccaaatctaaaccaggaagaagtcaaatccctgaatagatgaataacaaattctgaaattgaggcagcaattaatagcctaccaaccaaaaaaagcccaggaccagatggattcacagccaaattctaccagaggtacaaaaggaagctgataccattccttctgaaactattccaatcaatagaaaaagagggagtcctccctaactcatttgatgaggccagcatcatcctgataccaaaacctggcagagacaacaataaaaaaagaaaatttcaggccaatatccctgatgaacatcgatgtgaaaatcctcaataaaatactggcaaaccaaatccagcagcacatcaaaaagcttatccaacatgttcaagtgggcttcattcctgggatgcaagtctggttcaacatatgcaaatcaataaacataatccatcacataaatagaaccaatgacaaaaccacatgattatatcaatagatgcagaaaaggccttcaacaaaattcaacaccccttcatgctaaaaactctcaataaatgaggtatcagtggaacatatcacaaaataataagagctatttatgacaaacccacagccaataccatactgaatgggcaaaaagtggaagcattccctttgaaaaccagcacaagacaaggatgccctctctcaccactcttattcaacatagtactggaagttctggccagggcaatcaggcaagagaaagaaataaaagtattcaaataggaagggaggaattcaaattgtctctgtttacagatgacatgattgtatatttagaaaaccccatcgtctcagcccaaaatctccttaagctgataagcaacttcagcaaagtctcaggatacaaaaatcacaagtattcctatacaccgataacagagagtcacatcatgagtgaactcccattcacaattcctacaaagagaataaaatacctaggaatccaacttacaagggatgtgaaggacctctttaaggagaactacaaaccactgctcaatgaaataaaagaggaaacaaacaaatggaaaaacattccatactcattgctacccccatcaagctaccactgactttcttaatagaattggaaaaaaactactttaaatttcatatggaaccaaaaaagagcccgcatagccaagacaatcctgggcaagaagaataaagttggaggcatcactctacctgacttcaaactatactacaaagctaccataatcaaaacagcatggtgctggtaccaaaacagacctatagaccaatggaacagaacagaggcctcgggaacaacaccacacatctacaaccatctgatctttgacaaacctgacacaaaccagcaatggggaaaatattccctatttaataaatggtgttgggaaaactggctagccagacacagaaaactgaaactggaccccttccttacaccttatgcaaaaatcaactcaagatgggttaaagacttaaatgtaagaaccaggaccataaaaatcctcgaagaaaacctgggcagtaccattcaggacataggcatgcacaaagacttcatgtctaaaacaccaaaagtaatggcaacaaaagccaaaattgacgtgggatctgattaaattaaagagcttctgcacagcaaaataaattgtcattagagtgaataggcaacctagagaatgggagcaaaattttgcaatctatacatctgaaaaacgctaatatccagaatctacaaagaatttaaacaaatttacaagaataaaacaaccccatcaaaaagtcggcaaagaatatgaacatacacttctctaaagaagacatttatgcagccaacaaacatacgaaaaaatgctcatcatcactggtcatcagagaaatgcaaatcaaaaccacagtgagataccatctcacgccagttaggcaatcatcaaaaagtcaggaaaaaaaagatgctggagaggatgtggagaaatagggatgcttttacactgttggtgggagtgtaaattagttcaaccattgtggaagacagtgtggaaattcctcaaggatctagaactagaaataccatttgacccagcaatcccattactgggtatacacccaaacgattataaatcatgctagtatacagacacatgcacacgtatgtttattgtggcacagttcacaatagcaaagacttgtaaccaacccaaatgtccatcaatgatagactggataaagaaaatgtggcacatatacaccatggaatactatgcagccataaaaaaggatgagttcatgtcctttgcagggacattgatgaagcagaaaaccatcattctcagcaaactatcgcaaggacagaaaaccaaacaccacatgttttcactcgtaagtgggagttgaacaatgagaacacatggacacgtggaggggaacatcacacactgggccagtcagggggtggggggctgtgggagggatagcattagcagaaatacctaatgtaagtcatgggttgatggttgcagcaaaccaccatggcatgtctatacctatgtaacaaaactgcacgttgtgtctgcttggtccagagctgagttcaagtcctggaatcccttgttaactttctgtctcgttgatctgtctaatgttgacaatggggtgttaaagtttcccattattattgtgtgggagtctaagtctctttgtagttctctaagaacttactttatgaatctgggtgctcctgtattgggtgcatatatatttaggatagttagctcttgttgttgaattgatccctttaccattatgtaatgaacttctttgtctcttttgatctttgttgttttaaagtctgtttttttagagactaggattgcaacccctgcttttttttttttttttttttttgctttccatttacttggtagatcttccctccatccctttattttgagcctgtgtgtatctttgcacatgagatgggtctcctgaatacagcacactgatgggtcttgactctttatccaatttgccagtctgtgtctttcaattggggcatttagcccatttacatttaaggttgatattgttatgtgtgtgaatttggtcctgtcattatgatgctagctggttgttttgcctgttagttgatgcagtttcttcattgcatctatggtctttacaatttggcatgtttttgcagtggctggtaccggttgttcctttccatgtttagtgcttccttcaggagctcttgtaaggcaggcctggtggtgatgaaatctctcagcatttgcttgtctgtaacggattttatttctccttcacttatgaagcttagtttggctggatatgaaattctaggttgaaaattctttcctttaagaatgttgaatattggcccccactctcttctggcttgcagggtttctgcagagtgatctgctgttagtctgatgggcttccctttgtgggtaactcgacctttctctctggctgcccttaacatttttttccttcatttcaaccttggtgaatctgatgattatgtgtcttggggttgctcttcttgaggagaacgtttgtggtgttctctgtatatcctgaatttgaatgttggtctgtcttgctaggttgggaaagttctagataatatcttgaagagtgttttctaactggttccattctcctcatcacttccaggtacaccaatcaaatgtagatttggtctcttcacatagtcccatattttttggatgctttgctcattgcttttcattcttttttctccaaccttgtcttctctctttatttcattaagttgatcttcaattactgatatccttttttccgcttgatcgaatcagcttttgaagcttgtacatgcttcacgaagttctcatgctgtgtttttcagccccatcaggtcatttgtgttattctctacactggttattctagttagccattcctctaaccttttttcaaggttttagcttccttgccatgggttagaacatgctcctttagcttggagaagtttgttattacccaccttctgaagcctacttctgtcaactcatcaaactcattctccgtccagttttgttcccttgctggagaggagttgtgatcctttggaggagaagaggcattctgttttttggaattttcagccattttgtgctggtttctccccatctttgtggatttatctacctttggtgtttgatgttggtgacctacggatggagttttgttgtggatgtcctttgtgttgatgttgattttattcatttttgtttgttagttttctttcttttttcttttttttaggtattgatgggacgtatctcaaaataataagagctatctatgacaaacccacagccaatatcatactgaatgggcaaaaactggaagcattccctttgaaaatgggcacaagaccgggatgccctctctcaccactcctattcaacatagtgttggaagttctggccagggtaatcaggcaggagaaggaaataaagggtattcaattaggagaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacactaataataggcagacagccaaatcatgagtgaactcctattcacaattgcttcaaagagaataaaatacttaggaatccaacttacaaaggatgtgaaggacctcttgaaggagaactacaaaccactgctcaatgaaataaaagaggacacaaacaaatggaagaacattccatgctcatgggcaggaagaatcaatatcttgaaaatggccatactgcccaaggtaatttatagattcaatgcgatccccatcaagctaccaatgactttcttcacagaattggagaaaactactttaaatttcatatggaaccaaaaaagagcccgcatcgccaagtcaatcctaagccaaaagaacaaagatggaggcatcacgctacctaacttcaaactatactacaagactacagttttctttctaacaggcccctcagcagcaggtctgttggagtttgctggaggtccactccagaccctgtttgcctcagtatcaccaatggaggctgtagaacagcaaatattgctgcctgatccttcctctggaagctttgtcctagaggggcaccttccagatgccagccagagctctcctgtatggggtgtctgtcagtccctactgggaggtatctctaagtcagggtatacggggttcaggcacccacttgaggaggcagtctgtccattatcagagcttgaacactatgctgggagaaacattgctctcttcagagctgtcaggctgggatgtttaagtcttcagaagctgtgcccacagagcaccttcccccaggtgctctgtcccagggagatgagggttttgtctacaagtccctgattggggctgctgccttttgttcagatatgcccttcccacagaggtggactctagaggcagttggccttgctgagctgtggtgggctcttccctgcttgaacttcctggcagctttctttacactgcaagcataaaaccgcctactcaagcctcagcagtggtggacgcccctcccgtctccaagctccagcatcccaggttgatttcagactgctgcactagcagcaagaatttcaagccgggcacggtggctcacacctgtaatctcagcactttgggaggctgaggcggacagatcacaaggtcaggagatccagaccatcctggctaacacggtgaaaccccgtctctactaaaaatacaaaaaattagccaggcatgatggcaggcgcctgtagtcccagctaatcgggaggctgaggcaggagaatggcgtgaacccaggaggtggagcttgcagtgagccaagatcgcgccactgcactccagcctgggcgacagagcgagactccatctcaaaaaaaaaaaaaaaaaaaaaaaaagaatttcaagccaatggatcttagcttgctggggttcatgggcatgggacccattgagccaggcaccagagggaatctcctgggatgcagaccattttaaaatgtttcttggccacttgtatgtcttatgagaaggatcttttcatgtctttgcccagtttttaatgaggttgtttgttttttgattgttcatttgtttaagttgcttatagattctggatattgaaccttcattgggtgtatagtttacaaatattttctcccaataggtaggtcgtctgtttattctgttgataggttcttgctgtgcagaagctgtttagtttaattcagtcccacttgtcaatttttgtttttgtcgaaattgcttttgaggacttagtcataaattctttcccaaagccaatgtccagagtggtgttgcctaggttttctttcaggattcctataatctcaggtcttatatttcaatctttaatctaaagttaatttttgtatatgatgaaagataggggtccagtttcattcttctgcatatggatagccacttatcccagcacaatttattgaatagggagtcctttccccattgtttatttttgttcactttgtcaaagatcagatttggtgcgcagccttatttctacgttctgtattctgttccattggtttatgggtctgtttttgtaccagtaccatgctgttttggttgctatagccttatagtacagtttgaagccaggtcatgtgatgcctccagctttctttttgtttaggattgctttgggtagtcaatctcttttttgtttccatttgaatttttgaatagtttttttttctagttctgtgaaaaatgacattggtagtttgataggaatagcattgaatctgtagattgctttaggcagtatggctattttaatgatattgattcttccaatcaatgagcatggaatggttttccatttgtttgtatctataatttatttcatcggtgttttatagctgtcctagagatctttctcctccatggttagctgtattcactggtattttaattttttttgtggctactgtaaatgagattaccttcttgatttgtctctcagcttgaatgatatttgtgtatagaaatgctacttatttttgtatattaatttagtcttctgaaattttactgaagtcatctatcagttccacgaatattttgacagagtctttagggttttctaggtatagaattatatcatccatgaagggaaatagtttgacaccttcttttccaagctggatgtcttttatatctttctcttgtctgattgatatggctaggactataatgaatgggagaggtaagagtgggcatctgtgtcttattccagttgtcaaggggaatgcttccagtttttgtcctttcagtataatgttggctgtgggtttgtcataggtggctcttattattttgaggtatgttcctttggtgcctagttattgagggtttttaacatcatgagtagatgttgaattttattgaaaactttttctgtgtttattgagatgatcatatggtttttgtttttaattctgtttatctggtgaattatgtttattgatttgcatatgttgaaccaaccttccatcccaggaatgaagcctacttgatcatggtgaattaacttattgatgtgctgttggatttggtttgctagtatgttgttgaggatatttgagtcaaagttcatcagggatacttgtctgtagttttttgttgttgttgttgtgcctttgccagattttgggatcagaatgatgctggctttgtagaatgagttatgggggattcctccctcctctatgttttggaaccatttcagtagaatttgtatccaccgtgatttgtatgcctggcagaatttggatgtaaatccatcaggtccagggcatgtttttttttttttttttttttggttggtaggtttttattttgattactaactcaatttcagaactcgctattggtctgttcagagtttcaatttcttcctgattcaatcttgggagagtgtgtgtttccaggaatttatcagttttctctagattttctagtttgtgtgcatagaggtttttcataatagcctctaattatcttttatatttttatgggttggttgtaattttacctttgttgtttctgattttgcttatttggaccttctctcttttttcctttgctaatctagctagcaggctattgatcttgtttatcctttcaaagaaacagacttttggttttgttgattcttcatatggatttttacatctcaatttccttcagttcgtctctggttttacttattttctgctagctttggcggtaatttgttattgtttttctagttcctctgggtatgatgttagatcattaatttgagttctttctaactttttgaggtaggtgtcttctatgtaattatgtggttttatgagatcttcttgatattaatttccatttgtatttcattgtattccaagagtatgattttattttttgaagttattgagacttgctttatggccaagcatgtggtcaatcttggagtatgttctgagtgcatatgagaagaatgtatattctgaggttgatgggtggaatattctgtagatgcctatgaggtccaactgatcaaatgttgagttcaagtccaggatttctttgttagttttctgccttgatgatctgtctagtggtgtcagtggggtgttgaagttccacactattattgtgtggctaagtcttttgtaggtttagaagtacttgttttatgaatttgggtgctctaatgttgggtgtgtacatatttaggatattttagtcttcttgttgaattgaaccctttatcaatactgttgttggtttaaattctgttttatctgacataagaatcatgacccctgctcttttttggtttccatttgtctgatagatctttctctaatcctttatgggtgtcattacatttatatgtgagatgggtctcttaagacagcaatggatttctctcattttttaatccacttaccactctgggccttttagatggggcatttaggccatttgcattcaagattaatattgatataggaggttttgatcatatcatgaagtttttagctggttgttttgtagtttgtattgtgtggttgctttatagggtctgtgggctatgtactcaagtgtgtctttgtcgtagtaggtatcattcttttgtttccatgtttagaaatcccttaaggatctcttttaagactggtctagtggtaaaaaaatttcccttagcacttacttgtctggaaaatattttaattttaattttaagttctgaggtacatgtacaggatgtgtaggtttgttacataggtaaacatgtgccatggtgttttgctgcacctatcaacccatcacctaggtattaagcctagcatgcattagctatttttcctaatactctccctcccccaaccccaccccccaacaggccccagtgtgtgttgttcccctctctgtgtccacgtgttctcattgttcagctcccacttataagtgagaacatgaagtgtttagttttctgttcctgaattagtttgctgacagtaatggcttccagctccatccatgtccctgcagaggacatgatctcattccttttgatggctgcatattattccatggtgtacattaccacattttctttatccagtctatcattgatgtgcatttaggttgattccatgtatttgctattgtgaatagtgctgcaatgaacaattgtgtgcatatatctttgtaatagaatgatttatattcctttgggtatatacccagtaataagactgctgggtcaaatggtatttctggttctagatctttgagaaatcaccacaccatcttccacaatggttgaattaatttacattcccacaaatggcataaaagtgttcttatttctctgcaacctcaccagcatctgttgtttcttgactttttaatgatcaccattctgagtggcatgggatggtatctcattgtggttttgatttgcatttctctaatgatcagtgatgttgagctttttttcatatgtttgttggccacatgaatgtcttcttttgagaaatgtctgttcaggtcctttgcctacttttaatggggttgcttttttaaaaaaatttgtttaagttccttgtagattctggatactagacctttgtcaaatggatagattgcaaaaattttctccgctctgtatgttccctgttcactctgatgatagttgtttttctgttgttgttttgttttgttttgtttttgctgtgcagaatctctttagtttaattatgaaactgcctttgcaacattatgatggagacagtgaaatagatctaacttaatcaactccatgttgcttctaacctccaagctgtccttgttcattcatgggtataggctgaattaactttgggagaagcttacttcatagtttatagtttaatatgaagacaataacagccctttcccaaagcagacctccttcatgcctgggaattagattgcctttgtaggactaacattagccacaagattagaaattatggtttgaaagtcatgcggctggaggctacaagtttctgacccttcctaaactgctcctaagatcagtgcttgaaatattttgcagaccctgcacttgatggatcagctggcactacccaggttgataagttgtctcatctaatcatctaatcttgtggcccccacccaggtactgactcagtacaggaagatagcttcgactccctgtgatttcatttctgaccaatcaatgcttctggctcactggcttccctcaaaccaccaagttgtccttaaaaactctcctccctgaatgctcggagacactgatttgagtaataaaactctggtgtcccgcacagccggctctgcgtgaattaccctttccctattgcagttcccctgtcttgagaaatcagctatgtctagtcggtgggaaaggtgaacccattgggtggatataattagatacaatttgtcaaattttgtttttgttgcaattacttttggtgatttcatcatgaaatctttgcctatgccaatgtcctgaatggtattgcctagattcccttctagggtttttatagtttggggttttacatttaagtctttaatccatcttgagttaacttgaagcttaggttggtgggatatgaaattcttggttggaatttcttttctttaagaatgttgaaaataggcccagaatctctcttggcttttaaggcttctgctgagaagtctgttgttagcctgatggggttccctttgcaagtgacctgtctcttctctagccatctttaagattttttctttagcattgactttggatagtctggtgactgcatgccttggtgatgtttcttttgtatagaatcttccaggtgttctttggatttcttctatctggatgtctatctctagcacgattagggaaattttcttgaattattccctcaaatatgttttccaggctgtttactttttcttccctctcaggaatgccaataatttgtaagttacatcactttagataatcccatattccttgaagactttgttcttgtatttattttatttttgtctgggttagtttgaaagaccatcttcaagctctgaaattttttattctgcttggttcaatctgttgataaagatttcagttatattctgaagttccttaactgagtttttcaatttcagaagctctgattgatttctttttaaaatgtttatctcttccttcatttcctggattgatttagaagtgtcttcgtgttgattttcaaccttgtcttgggtctcagtgagcttccttacaatccattctttgacttctttatctgtcatttctgagtttccactttggttagggaccatttctggagagctagtgtgatcctttgatcatgtcactacattcagattttttatggtgccagaattcttgcactgtttctgtctcatctggagacactggcacttctaattttttaattattttcatgcaggtaggatttcttcttattttttccctgtaatattattgtttttcttttcctttcccttccctgcagggggtacaactgtagagaatgctgggtaggatattttggcttcactttcatagccctatgcacttttggggggcaggttttatattgggctgtgtagtttgacctataaggtagttgatggtacttacaggtaagagctggctgtggccaatgcagtggggtatgtacttgatccttgttcactggcacaggctctctgttgcctcaggcaatgggttgactcatggaatgcacagtggtctgagctccctgctcaggccggggacagggaagcccaatgggtggggccagaccaggcaggtccacttacaggttctctgatggcaggcataagcactgagggtgaatctagtgggtggccaccagacacccagaggtgtgcctacgtatggagctgagaaacctccttagccccaggttctttgcacagggatggtgggtagctcatgctcctattccagaggaatgggtgctccagatacctggagatctacctgagtgtggagcagagggacccctgcaccaatatttctgcaaaggaggggtgggggtgactcaggctgctaaaccaggaatgcaggtgctctaaatgcctggagctctgcctgggtgtgtagcagagagggcccttctgtaccaggttctctgcacaggaagtgtgtggtgactcaggctgctgatccaagcaagctggttctctgaatgcctggagttctgcctggacatggagtgcagggggccttgctataccaggatctatgcccatgaagggtcaggaagctcaggctgttggtccaggcaagtgggtggtccaaatgtctggatttctgcttaggggtataccagagagtgcccttgagtgatacaccatctcaagggggaaagctggagcacccagcaatggcacacacagactggtttccagtcatcaagctggccttggctgcaagtgtcactgtccaggagaaactgcagctgtagcagctctcctcctgcctgaggcttgcaatggaggagagcagaattccagtgcctacttctgaaaccctttccacagttctggctgtggatgtccttatcccagtccagggcaggcactctagaggtctggtctgagacggcaatgcctgtgtggtcatgctgccaggttgccacagaatggctgactttgtatgtgcccagattaaaaatgatatcctgctctcagtcccacatctgggaaaatgcctgcaacttttcctggtgtctttcccttgcagagtctctaagcctctcctcaacttacctccaggtcttgggagaaacaaagtgttctcccttggtcttggttgctcagattcccagtggaaaggtaagtcacagagggaggctctctgcttctctcacatgctggagcttcactcacttaatagctaaatgctgtcacgggggctgtttgccagtgttctccacaggaccagggatatctttcatgattctagtggattcccattttcctccttgaattaaactgcacagagtttatatttatgcactgtcttgctacttccgagtggctgaggcatgctaaaagcccctaatccaccatcttggaaaatgaaactgtattgctactgaagacgtgggatgtccaatatggcattgcaaataagcatatatctatagaccaacatttatgtatataatactgtgttaaatactacagggaaaatattaaaaaataagcaaagatagacattgaagaaatatttacaagcatgctgagtgttatcatggagaagtacaggtgcaatggaaatgttaaagtgagggatcttgtcaactctgcaaatcagaggaaacgctctggaggaattgtctacttaaatgagacttaatagatgagaatgttaaccaggtgaggaagtactagcattctagggagagaggaagcatgtatggggccctggagatgagagagaaaatggcatattctaggaaccttaaaaagcgcagtatggctgaagagtaggaaaccattaggagtttggctggaagtaagattggagagtaagttagaagtcacattgtgagggacaatgggaaactataaaaggttttaagaacagaaaatgaccggtgagaagtgcattaaaagatgtggtgtaattgggcacagtgtacactgctcaggtaacaggtgcaccaaaatctcagacacccccactatagaacttctccatgtaaccaaaaaccacctgttcccccaaaactattgaaatacaatttttttttttttaaagagatggtggctgggcgtggtggctcacgcctgtaatcccagcactttgggaggccgaggcgggcggatcacagggtcaggagatcgagaccatcctggctgacatggtgaaaacccgtctctactaaaaaatacaaaagattagcggggcatggtggcgggtgcctgtagtcccagctactcgggaggctgaggcaggagaatggtgtgagcctgggaggcagagcttgcagtgagccgagttcgcaccactgcattccagcctgggtgacagagcgagagtctgtctcaaaaaaaaaaaaaaaaaaaaaaaaaaaaaaagagatggtatactcttgggtgaggccatcttggaagacagtaataggtagttggttattttttgttagtcagtttagtacccatacttggctcttggactgtgcttattagaccttgatatggagtagtccatttgtgttccatgaaacttttgaaaccagctgattgtcaaatgtcaagcatctcaagagattctgcctgggttggctttatggttccatttatatgtatgttctatataatatataaattctataatttatataataatataatatataaattctataatttatataataatataatataataacatatacattctataattctagtacctactgctgacatgtaatattatatagatataactgctgatctgtaatatatataattcctgacatgtattatatattacaatgtaatatatattagatgtaacatatattacatctcataatgtatacctctcatacattatatatatattacaaggtctaattagagaagtctaactagagaaatcacatcaaggtctaattagagaagtatgtacatctcagcagttatatatatatataatattacatctagaattatattacaatagaatatacatatatatgtgtgcatatatataatattacatctcagcagtaggcattaaaattctgctctcccccattgcaagcctggggtaggaggagagctggcatccaggaccagcttggtgacctgcatccagtctgtgtgccattgctgggtgctgcagcctgctcccctgagaaagtggtgcagcagggtgctctctctgccgtacccccagggtgctctctctgccatacccccaagcagaaatccaggcatttggagcacccacttgcctagaccagcagcctgagctgccccacccattatggacataggtcctggtacaacagggccctctccactccacacccagactgaggccgatctccagtttatatatgtattaggagatgttggtaatgatttggagtggttattagccaatcaggagacaaattgataatttttttctcccaaaatagaagaaagacaggagagaaatgaagagagaggaaaggtagagctatataacccagtagcaagatggactatgaacagtactcagtagctttctcatatgctgtcaatggatggagtgtggttcaggaggtttggattcagttatattattttcatatgacttaccattttaacttccttagggaatcacttaaattagtcatgccttagttcttttcatgtaaagacattctggctcagaaccaaccattgtgcagtttcacttgatgaaatcatgtcatttagagcatcttgaactccagagagaggtatctcatgcgagaagtttttattacaattgttatcttctgcttgtttgcacctcagttccttagaaaagaaacacattttgaagaaattcctttaataaggacttggcaatgtaggcagactgccttgtgatattcacacttttctaactgcaatattgagtgtgtgtctttgatgggtctcttatggcaggtgtactgactttttttcccctcctggtgtcggtgtaatatttttacagaacggcagagggtatatgaatagatcctgatgtaaggtgtgaacaaggaagaaagatgtttgctctggctttggcttatcttctagcaaagttgcctagaatgtggttgtaaatgactgtcatgtagtaaactctgcctaccttccctgtctcttctctaagctaaaataactagcactgttttgttcatttatgcaaacttgtgctttttttttttaatatgtagagagatgatgctaagtcatcagcagcattgtggctctgacttgtttttactagtagatgggttgcatctgagcttttcacttgccttacttcactgaggaccaatatagtgtctctgggggacaatggtcaaggtgaggcttttcgtctgtggctgtgatatagagtgagtctcattggcttacacaggatataactgcaattttgacctcagtgctatgctcaatttagttgagtgaggttgcttatggggtaccaatgaatcccagagggcagaactcactctcaaaaatgtaacttgtctattagtcagtggacaaacatataactgaagagtatgcagatgtttcccattgaaatgagaaaataaattttaataacttttttttgtatcttttaaggaagagcctggaattctccattcagttgccacccatagtgtgtctcattgttttctgttattgtaggtttctaggtcagatgctgatcacgaaattatttgtcataaccttctgtttgaaactgaagcatttttttttaaaaaaagttttgtctcataatgtctagaaactgcctttacattataaagttgcttgtatttatccacagcctggaataatctattgatggtattttacttctaaacagtaagaaagatatgctgtaatctgttgggaagactgtattctttgtacttatctaggttaaaggaaacagtagtagcttgacctctagatatttggcttcatatgccttggctgcttggtagaagtcatcccatattgaatatacattgtttccaaaggacatttctgcttctggagtagctccaaacacacactgctatgcttataaaacagggctgagggaagtagtttgctggaaccagtttgctcttgctagttaagagtcgattgtgtacatttcttttcaacactgtgttgaatgacataacattggtagattgaaacaggtcatgatgggagtattcacaccacaggaataggcaaaggctacccatcaggggtccctctccccttggagagtcagttgttgaatacttaacaacacaccactggttggaggttgttatcccagccattgaggcctaccccagagtagacttgacatattccattttattcctggaattgggactgactcaggcctccccaggttttgggggaactattctaaaggaataagccaattcaaatccacacttttgaaactgggtgagaaagagccaagtcatctgaaggatgaaggtccagaatggggctgaattaccattcagtttatcgcattcagagcaatgttgtctaacagactgattccaggtgctagccatttactgtaaataagaaatatgaactattttgtcactggaacaatttaccaaacaagtaccttcctgtcaattcatggtaaagtaatgagagaaacaagagaagtcctcaacttgagtatactttgtaagtggtttagcttcctggcaggcactgatgtatttcatgtgtatccatctcatccctgcagattctcttagcttaatgattgtcaaaacactgtaaatagtcggtgatattgaagatggcaatttccataaactatttattctttctttttgacaaaaaatgacttcctatttttttaagaatgcctcaaacacctgggttttggtgctttcatttttagaatgaacattcctcctacttggcagttaatattttcgactttcagaacacttttggaatacggcttgactttaaaacttttaccattaaaatatttacaacgcatgtaataggtatagggatactttcattacaaatcattaaaaaaaatctgaacacctgaatgaaaacttggacaaaagatatgagcaaagctatctacagaaaaaaggaaatacaagtagtcaataaatatatgaaaagatgatctatctaattcatattgaaaatgtaaatgcaaatgaaaacaccatatcaatgttggttgagaatatgaagtaaataagccatctcatatactattggtgggagtatacattggtattaggtttattggagaaaataaggcaatattttcaaaaggtaagatgcatttagttttgggcccactgtccttacttccagaatttatcttacaaaaatatttgtgtatgaacattacatatacatatacatacacatggctattcattataaaattgttttaatagcataaaaactgagaagtatccatcattagggatgatctaactaattagttaaattaatatggaaacaccaggcagtggtgtactttgtattcactagaaagtatgaggtagatctacttacactagcatagaaagatgttcactaaatatagatggcacttggtgaaaaaaatattgtccaataatatgtcttgtattacctcactttcatttaaaaattatatatcactcttcactatatatacttctgtagaattgaatatttgaaaataagcaggcattactcttgtgtttaaaatctattggaaaatacttttgtttttatactgttctgtaagcttgttctcctctattaacaacatactttgaacttatccctccctcactcttcccaactgacgtgcaacatcataccccatggataagccatcctccatccatccatgcatccatccacatattcatctatccacatacctgtgcaccaaattatttcttacttacttatttaaacaatttctttttccagttatagaagcaatgcttacccttggccaaaacaaaacaaaaaatgaacaagcaaaaacaataacaaaatggtacagttagagaagggtacataaaaaaatacagcttggactcattctccagaggcaaccactttaagagtttttgttctagtggttacttttttgccattaaataatgtacttattataataatgtaagtatttatatcaacattatattataatattagtaatatgcttatatctccatttgttgtcttctttttcttcttctcttctctgctctcttctcctttccttgtctatctgtgtcaggctcagaagaaagccataatcaggatatctctaaccctggcatagttcatgccttgggatatttgaccaagatgggaagaaccagagaggaaaatggatataatcatagaggggtggaccagtaaagaaatgtggcccctcgtctgtgccagttccttacctgaaaccagagaaggctagattgcagttggtgttttagctgtggataaaactttaacccagagttcctgggactcttaatggtatgacgaaatggagaaaaacatggcttttgagtccaaaagactggattttgaatccccactctaccactttctagctgtataatcttcaggcaacttgtttaactcctttgggctctagcatccttatctgtaaactgacagtattttactcaatattatactgtggaagttagatgatgataataactagcatttgcttattactatgcatcagatatgattctaagtgctagattgggtctctgattacaatgtatatctccttctcatgcttactataattatgattaaataatttattgtttaatgtgtgtctctcccaatgaatgttagtttcatgagggcaaggatcatgtctgtcttcctcacagtactgtatttttagtacctgctaagtatatatattgattctcagtatttattgactaaattaagagatatctgggttgtgactgtctcatgcgtgtgtgtgtgtgcgtgtgtgtgtgtgtgtgtttgtgcgtgtcagacttttatgaccctgaggcataattcggtatttgacttcaaagtgagatgaccagatggtttgttttttattttaccaatgtcctaacagtcctttggtagccccaaataaatatgaaatatagagttgaaaatatttgggattaataattccttataaaaataattctgcattgatggtcaccaagtagtaatacatgcccagaacttggctgttttattaaagtttatttaaggaatagggaaatttggtaggaaatacagatcagtgtgctcaataaaaaatcctgccaacttttctatctgtaaagtgtatctttaggctataactcataaaaaaaaaagtaatgttttaattgcagatgacatatcagtttctaccagtttgttgttatataggtaatgcaattgattaagctcaattggaccagatcattcttttactgaatctttgttccaattgtagtgttttgtagataacttttttttttttttgagacagagtctcactctgtctcccaggctggagtgcagtggtacaatctcagttctgtagcctctgcctcccaggttcaagcagttctcctgcctcagcctcctgagtagctgagactacaggcacgcaccaacacacccggttaatttttgtatttttagtagagacgtggtttcaccattttggccaggatggtctccatctcctgacctcatgatccgcccgcctcggccttctaaagtgctgggattacaggcatgagccaccaggatatctttgctcaactgggttggacagtcgagaactgattttaattttattgagggaagcattggcttgaatttgtctctttaaaacatcaatctcattgttcaattcccacctatgagtaagaacatgcagtgtttggttttttgtccttgcgatagtttgctgagaatgatgatttccacatggacacaggaagggtaatatcacactccggggcctgttgtggggtggggggaggggggagggaaagcattaggagatatacctaatgtaaatgacgagttaatgggtgcagcacaccaacatggcacatgtatacatatgtaacaaacctgcacattgtgcacatgtaccctaaaacttaaagtataataataataaaataaatcaatctatgtttctattttaacaccaaataattatgttaacaaagaccacagacagcagttgcttttgcttatccttaatcacttccctaagtataaagattttggtaattcaactttaaggctatctattcctattgtgaaaaaggaccccctccccacatattcccatgtgtcaatgagggaacataaggctgatgtggtaaagactatgatgacctggtacatttcaagatgttttatggtacttaaaaccaaagggatctgaaaagggagcctggtgatagaggaggtttaaaccaaaaagactctgggttgaacgtgaccagtaattgctcaacctgcctggtatgtctaaaaggaataacacacttggtatataatctagaactgtgattttgatgtgtgaacatatcattgaaaagaaaaaaaaatctatcaactgatctattatgatgttaaattacttatttgaccaattttaaataacgttaagatgaaatttacatatacttcaatgatttaaaggatagaactaaataattttatatttatttacttttcatgatacataatatttttacatatgtatggggtacatgtgatattttgttacatgcatagaatatgtaatgatcaagtcaggatatttagggtatccatccctcaaacattcatcatttctctgtgttgggaacatttcaagttctcctttctggctattttgaaatatataatatattgttgttaattatagtcaccctactctgctatagaatattataactcattttttcatctagctatatatctgttcccattaaccaacctctctctgttccccctcccctaacacccacccttcctagcctctggtatctatcattctactccctacctcagtaagatgaacttttttaacttccacatatgagtgaggacatgcaatgtttgtatttctgtgcctggcttatttaacttaatgacctcacattccatccatgttgctgcaaataacattattttattctttttttatggctgaatagtattccattgagtatatataacactttttctttgggaataaagctgcaataaatatggaggtccaggtatctatttagtgtactgattccttttcctgtggataaacacccagtagtggatggctggattgtatggtagttttatttttagatatttgagaaatctccatactgttttccacagtggctgtagtaatttatgttcccaccaagggtataagagttctgttttctctgcgtcctcaccaggaattctttttgtatgaatctatactacagcaatccaaatggttatgcataaaaatatgtgcacatacaaggatagccaatgcagtatgcgttgtgatggtgaaaatctggtaacagactaaatacattttcatgggtggtggtggtacattcatactatggaatactatacaaccattaaagagatggagatagacgggtatggatagaaatgggtagatctacaagatatatgaaaaacagatatgattccacatataatggaaaaatctatctatgcatgcataagaatgtgtgtatatctgtatggaaatctatagaaaaaggtttggaatttttaacattactataactcttaggaggggagtggttaaagtctatggttgaagggtaaatttcacttttgtcattttaataataaccattctgactggagtaagatgatatctcattgtggttttgatttgcatttccatgatgattaatggtgttgagcagtttttttcatatacctgttggctatttgtatgtcttcttttgagaaatgtctatttagagcttttgcctatttttaatgagattgtttctttctttgtgaggttgaattgtttgagctccttgtgtattctgtatattagtctcttgttagggaatagtttgtaaatattttctcccatttgacgggttgtcctttcactctgtttcttgtttcctttgctgtccagaagctttttagtttataatggtttcatttgtctatttttgtttttgttgcttatacttttgaggtcttagccataaattattttcctaggccaatgtcttgaagtgtttcctctgttttattccagtagttttattgtttgggattttacatttaagtctttaatccattttgagttgatctttatatatggtgagagatagggatccagtttcattcttctgcatatggttatccaattttcccagcaccatatattgaagagtgtcctttccccaatgtgtgttcttagagcctttattgacaataagttgactgtaaatatatgaatttacttctgggttctgtattctatttcattggtctatgtgtctgtttttataccaataacgtgctattttggttactatagtgttgtaatatattttgaaatcaggtagtgtgatgcctcaagccttgttcttttttttgtttgtttgtttttgagatggaatctcgctctgtcacccaggctggagtgcagtggtgtgatctcggctcactgcaacctccacctccctggttcaagcaattcccctgcctcagcctccatagtagctgggattacaggtgcatgccaccacacctggataatttttttttttttttgagacgtagtctcactctgtcaccagggctggagtacagtggcgcgatctcggctcactgcaatctccgcctcctgggttcaagcgattctcctgcctcagccccctgagtagctgagattacaggcgcccaccactatgcccagctaattttttgtatttttagtagagacggactttcaccatgttggtcaagctgctctcgaactcctgacctaatgattaacctgcctcggcctcccaaagtgctgggattataggtgtgggccactgcgcccggcaggctgatttttttgtattttttttttttttcagtagagatggggtttcaccatgttggccagactggtctcgaacttctgacctcaggcaatccacctgccttggcctcccaaagtactgggattacaggcctgagccactgtgcctggccactttgttctttttatttaagattgctgtggctattcaggccattttttggtttcatgcaaattgtaggattgtgttttctatttcagtaaaaatgacattggtattttgataggcactgcatcaaatctgtagattgctttgggtactgtggtcattttaacaatgttaattattcctatgcatgagcatagaatattgtttcatttgtttgtctcattcattagtgttttttttttcaagcttcttttttttattatactttaagttttagggtacatgggcacaacgtgcaggttagttacatatgtatacatgtgccatgttggtgtgctggacccagtaactcgtcatttaacattaggtatatctcctaatgctatcctacccccctcccacaccccacaacaggccccagtgtgtgatgttcccctacctgtgtccatgtgttctcattcttcaattcccacctatgagtgagaatatgcggtgtttggttttttgtccttgtgatagtttgctgagaatgatggtttccagtttcatccatgtccctagaaagaacatgaactcatccttttttatggctgcatagtattccatggtgtatatgtgccacattttcttgatccagtctatcattgttggacatttggctttgttcccagtctttcctattgtgaatagtaccaaaataaacatatgtgtgcatgtgtctttatagaagcatgatttataatcctttgggtatatacccagtaatgggatggctgggtcaaatgatatttctagttctagatacctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttacatttctctgatggccagtgatgatgagcattttttcatgtgtcttttggctgtataaatgtcttcttctgcgaagtgtctgctcatatcctttgcccatttgttgatggggttgtttgtttttttcttgtaaatttgtttgagttcattgtagattctggatattctgaccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcatgaattaatttttgtataaggtgtaaggaagggatccagtttcagctttctacatatggctagccagttttcccagcaccatttattaaataggggattgtttccccatttcttgtttttgtcaggtttgtcaaagatcagatggttgtagatatgtggcattatttctgagggctctgttctgttccattggtctatatctctgttttggtaccagtaccatgctgttttgcttaccatagccttgtagtatagtttgaagtcaggtagctcgatgcctccagctttgttcttttggcttaggattgacttggcgatgcgggctcttttttggttccatatgaactttaaagtagttttttccaattctgcgaagaaagtcattggtagcttgatggggatggcattgaatctataaattaccttggacagtgtggccattttcacgatattgattcttcctacccatgagcatggaatgttcttccatttatttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggaatttgacttcctcttttcctatttgaataccctttatttccttctcctgcctgattgccctggccagaacttccaacactatgttgaataggagtgttgagagagggcatccctgtcttgtgcccgttttcaaagggaatgcttccagtttttgcccattcggtatgatattggctgtgggtttgtcatagatagttcttattattttgagatacgtcccatcaatacctaatttattgagagtttttagcatgaagggttgttgaattttgtcaaaggccttttctgcatctagtgagataatcgtatggtttttgtctttggttctgtttatatgctggattatgtttattgttttgcatatgttgaaccagccttgcatcccagggatgaagtccacttgatcatggtggataagctttttgatatgctgctggattcggtttgccagtattttattgaggatttttgcatcgatgttcatcagggatattggtctaaaattctctttttttgttgtctctctgccaggctttggtatcaggatgatactggcctcataaaatgagttagggaggattccctctttttctattgattggaatagtttcagaaggaatggtaccagctcctccttgtccctctggtagaattcagctgtgaatccatcaggtcctggactttttttggttggtaagctgttaattattgcctcaatttcagagcctgttatttgtctgttcagagattcagcttcttcctggtttagtcttgggagggtatatgtgtcaaggaatttatctatttcttctagattttctagtttatttgcatagaggtgtttatagtattctctgatggtagcttgtatttctgtgggatcggtggtgatatcccctttatcattttttattgcgtctatttgattcttctctcttttcttctttattagtcttgctagcggtctatcaattgtgttgatagtttcaaaaaaccagcccctggattcattgatttttttgaagggtttttttgtgtctctatttccttcagttctgctctggtcttagttatttcttgccttctgctagcttttgaatgtgtttgctcttgcttttctagttcttttaattgtgatgttagggtgtcaattttgggtctttcctgctttctcttttgggcatttagtgctataaatttccctctacacactgctttgaatgtgtcccagagattctggtatgttgtgtctttgttctcgttggtttcaaagaacatctttattactgccttcatttcgttatgtagccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtggtttacttccaactgtgtggtccattttggaataagtgcggtgtggtgctgaaaagaatgtatattctgttgatttggggtggagagttctgtagatgtctattaggtccacttggtgcagagctgagttcaattcctggatatccttgttaactttctgtctctttgatctgtctaatgttgacagtggggtattaaagtctcccattattattgtgtgggaatctatgtctctttgtaggtctctaaggacttgttttatgaatctgggtgctcctgtgctgggtgcatatatatttaggatagttagctcttcttgttgaattgatccctttaccattatggaatggccttctttgtctcttttgatctttgttggtttaaagtttgttttatcagagcctgggattgcaacccctgcctttttttgttttccatttgcttggtagatattcctccatccctttattttgagcctatgtgtgtctctgcacatgagatggatttcctaaatacagcccactgatgggtcttgactctatccaatttgccagtctgtgtcttttaattggagcattcagcccatttacatttaaggttaatattattatttgtgaatttgatcctgtcattatgatgttagctggttattttgcttgttagttgatgcagttccttcctagccttgatggtctttacaatttggcatgtttttgcagtggctggtactgactgttcctttccatgtttagtgctttcttcaggagctcttttagggcaggcctggtggtgacaaaatctctcagcatttgcttgtctgtaaaggattttatttctccttcacttatgaagcttaatttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaaccttttttccttcatttcaactttggtgaatctgacaattttgtgtcttggagttgctcttctcgaggagtatctttgtggcgttctctgtatttcctgaatctgaacgttggcctgccttgctagattggggaagttctcctggataatatcctgcagagtgttttccaacttggttccattctccctgtcactttcaggtacgccaatcagacgtagatttaatcttttcacatagtcccatgtttcttggaggctttgtttgtttctttttattcttttttctctaaacttctcttgtcacttcatttcattcatttgatcttccatcactgataccctttcttccagttgatcgcatcggctactgaggcttgtgcatttgtcatgtagttctcgttccgtggttttcagctccatcagctcctttaaggacttctctgcattggttattctagttagctgttcatctaagtttttttcaaggtttttaacttctttgccatgggttcgaacttcctcctttagctcggagtagtttgatcgtctgaagccttcttctctcaactcgtcaaagtcattctccgtccagctttgttccattgctggtgaggagctgcattcctttggaggaggagaggcactctgatttttagagtttccagtttttctgctctgttttttccccatctttgtgtttttatctacctttggtctttgatgatggtgatgtacagatggggttttggtgtggatatcctttctgtttgttagttttccttctaacagtcaggaccctcagctgcaagtctgttggaattttctggaggtccactccagaccctgtttgcctgggtatcagcagcggaggctgcagaacagtggatattggtgaacagcaaatgttgctgcctggtcgttcctctggaagttttgtctcagaggagtacccgggcatgtgaggtgtcagtctgcccctactggagggtgcctcccagttaggctactcaggggtcagggacccacttgaggaggcagtctgtccattcttagatctccagctgcgtgctgggagaaccactactctcttcaaagctgccagacagggacatttaagtctgcagaggtttctgctgcattttgttttgcagtgccctgcccccagaggtggagtctacagatgcaggcaggtctccttgagctgcggtggactccacccagttcaagcttcctggccactttgtttgcctactcaagccttggcaatggcgggcacccctcccccagccttgctgccaccttgcagtttgatttcagactggtgttctagcagtgagtgaggcttcgtgggcgtaggaccctccaagccatgcatgggatataatctcctggtgtgccgtttgctaagaccattggaaaagcacagtattagggtggtagtgacccgattttccaggtaccgtctgtcacccctttctttgactaggaaagggaattcactgaccccttgtgcttcccaggtgaggcgatgcctcgccctgctttggctcatgctcagtgtgctgcacccactgtcctgcacccactttctgacactccctagtgagatgaacccggtacctcagttggaaatgcagaaatctcccctcttctgcgtcgctcactctgggagctgtagactggagctcttcctattcggccatcttggctccacccatctcattagtgttttatagttttccttgtagcaatcctccacctcataggttaaatttgttcctaggtagtttgggattttttttttttttgtagctattgtaagtggaactaacatttttgtttctttcttggctggatcatgattggtgtatagaaacattgctgatttttgtacactgattttgtattctgcaactttactgaatttatttatcagatctgatagttttttggtagagtctttagttttttctagatcatggcatcagaaaagagggactatttgacttcctctgttccaatttggatgcatttttatttctttctcttacctgactgttctggctagtacttccagtaccatcttgaataggagtggtgaaagtgggcatccttgttccagttcccagaggaagactttcagtttttccccattcaatataatgttagctgtgaacttttgatatatagcctttattatgttgaggtatgtttcttctgtacctggtttgttgagagttttttttttttatcatgaagggatgttgaattttatcaaatgctttgtctgcatctattgagatgattgtatgtttttttcgttcatgtgctatatcacccttattgatttgtgtatgctgaaccatccttgcaaccctggaataaatctcacttgacgatgatgtattatcttcttgatgtgttattggattccatttactagcatttcgttgaggacttctgcatctatgttcctcagggatattggcctgtagtttttgtgtatgtgtgtgtgtgtgtgtgtgtgtctgtgtgtgtgtgtgtgtgtgtctgtgtgtctgtgtgtgtgattatatggttttggtatcagagtaatgctggccttgtggaatgagttagggagtattccttcctctttaattttgttggaatcatttcaggataattggtggttttctttagaagtttggtagaacttggcagtaaagccatctggtcttggatgtttcttttttgggagactttttattactgattcaatctcattacccattattggtctattctcattttctgtttcttcctgattcaatcttggtaagttgcatgtgtccaggaacttatccattttctccaggttttccagtttgttaacatataggtattcttaatagtctctgatcatcttttgtatttctgtagtatcagttgaaatgtttttttttcatttctgattttattcattgggtgttctatcttttttgttggttagtccagctagtggcttattaattttatcttttcaaaaaagccaacttttcattctattggtcctgtatccttggtattattcttttagtctctatttcatttagttctgctctgatctttatttttttctgctgattttgagtttggtttgtactttcttttctagttacttgaggtgcactattaaattatttatttgaaagctttctactttttcagtgtaggcatttattactataaacttcttagcattacatttgctgtatcccacaagttttaggatgatgtgtttccattttcatttatttcaagacattttttgatttacatcttaatttcttcatctacccaataatcattcaggagcatgtggtttaatatccatgtatttgtatagtttccaaagttcttgtttgtattgatttctggttttattccattgtgttctgagaaagatacttgatataatttcacttttaaaaacaatatgttgagatttgttttgtggcctaacatatggtctattctggagaatgtttcatgtactatggaaaagaatatgtattctgaagttgctggacagaatgttctgtaaatgtatattaggtcaatttggtccaaagtccagtttaaatataatgtttctctggtttttctgtttagctgttaggtctaatgctgagaatgggatgttgaagtcccccactcttcattgcagtctatctttctttttagatttagtaatatttgctttatgaatctgggtaccccaatgttaggtctatacatgttcataatagttatattttcttgctagattgatacctttgtcattatataatgaacttttttgtcttttttttaactacttttgatttcaagtctgtttgatataagtatggctactcctgccagcagtggactgggtgggtgggttcttaggcccctgaatagcaggcatgacataagttatgtcagtagtacatggctttttatttccatttttgtggaatgtctttttccattcctttactttcagtctatgtgcatctttactggtaaggtgagtttcttgtaggaagcatatagttggattatttaaaaagcccatttaactattctatatcatttaactggaaagcttcattcttttatattcaagattattattgatctgtgaggcttttctcctgtcacattgttaattgttttcaggttgttttatatattctttgttcttttatttttctgttattttttggcattgtggtttggtagatttctgtagttgtaccatttgcatcctttcttttcattctttgtgtgattgctttaccagtgagttttatactttcatgtgtcttcatgatggtaaaagtccttttgttcccgggtttaggactcccttaagtatttcttgtgggtttcatctaatggtaatgaatttacccagaatttacttgtctgggagagactttatttctccttcatttatgaaggatacttttgctggacatgttattctttgctggcagtttttttctttcagcactttgaatatgtcatcccattcgctaaatctgctcttagtctaatgggggaattttcttataaatgactagatgcttttattttgttgtttttagaattctccccttttctttgagttttggcagtttcactataatgtgctatggagaagacctttttgaattgtatctgacgggatggctgagcttcctgtatctgaatgtctaaatcccttcctagacttgggaagttttcagctattattttgttacataggttttctatctttcttttttttcaccttttgggaacactgaaaattcaaacatttggttgctttgttgtatcccatatgtcatgtaggctgtgttcattcttttaaattactttttctttatttttatctgactgggctatttcaaaacacctgtattcaacttctgaaattctttctgctgcttgacctagtctattattgaagctttcaaatgtatttttttatttcatgtgttgaattcttcagttccagaatttctgactggttcctttttatgatatgtatctctttggtaaagttctcattcatatcctgaattggtttttggatttctttgtattgtgtatctgagttgtattgtacctcactaagcttctttaatatcattatttaaaattatttttccatgatttcataaatttctttttcattggaatctgttgctggagaataattatgtttctttgtaggtgtcatatttccttgcttttttgtgttccttttgtccttatgttgatgtatgtacatctggtataatagtcacttcttccaattctttttgaatttgctttcataggggagtactttttcctgaagatgtatctatgatgctggttggggaggactctttggctttgatctgagttcatgcagtagtgtagtaatctccatatgatttcttctgctatatagcatcgttaatgcctgtgatttccttagtagcttagggtatgattgttaatggagactgtggtgaagttgtgctggggactgagatgacaaatgggccagtcttcaggccctggtggtggcagtggcaggccaagtatgcctgtccttgggccccatggctgtgtatgctggcatctgtgttgacaatttctggcaggtcagttcttgggccttcaggtggcttgctcagatgccagctgtgtcagcagtgactgggtaggtgggttcttaggcccctgagccacagacaaggcatgggtaatgtcagtagcagtgatgtgatgattctttgtctcccaagaggtgtacattgatgttggtagtggctgtggtgggctgggttggttacgcttcaggcctgcaggtggcacttgcaggtagatgccagctgaggtggtagtggctaggagtttaggcccaatattatgcctttgggaggagtgctcaggtgcccacggtggtagactgggttgggtaatccccaggatcccaggctacgtactctgccttggggttgggaatggcaaaactagtctgggtaagctgctgcttaggccccctaatggtgagagatggtaccacctgtggtgagtagaggtgtagtgatcctcagtccccaggtggagtgctcaggtgagggatgatagcggctgtgccgagtccctgccactggagagggtgggactgtctttagtggctataacctgggctggtgggtgaagaatgtgtattccttttatattctggtcccactggggcttggctcccagacttgccagtagtagcctatgtctagatcatgcccccaccccagatgcaggagtccccactcagctggcaaccaagtcccagtggaaactgatgccttacccacatcccattctttatcccagcagtgctcacttcccaagaccggcagctgcagcccacacctgcatgccttattagtcctggttgtggaatgctcccagcttgctcctcagtcacagcactgacagcctgatagcccaagtttccataatgccccagttccagtgctgttgggctccaggactgtgttcattctgccaaaaactatgcttgaaaatgatgcctttttgtagctgcttaggtctcagaaatggtgtggcacccagcacagactcactccctggaacacttccctcccgtggtctcctggcagctccatatgttagtttcagggtttggcagggggtcaaggggttctcccatagccaagattgcatgattccacagtgtggatatgggtcactggaagtctctcatttaccctttccctcaattggaaagtcgctcccagctgccactcaatcctggccaggcagcctacttctctccctctcctttctccacttttgatgtttcttgtcacttctctgttgaattccagtattctctcttggataatgtattttaagtgtgactgtccatacactattttcgttcttctaagtggaggaagaggacatgaaatacttctaatcagccatcttgaagctcctcccttaattgttaatgatggtgtaatattccaccatatgggtatgccataatttatttaacaatctattattggacatttacattattttcaactttggtagtgtaagtattgttgagatggacataatagtgcataaatctttagttacatttgggattcttttctttttttttttgacggagttttactcttgttgcccaggctggagtccaatggcacgatctcggctcactgcaacctccacctcccaggtccaagcaacttttctgcctcagcctcctgagtagctggagttacaggcacccgccaccacacccagctaattttttgtattttttagtagagacagggtttcactatgttggccaggctggcctcaaactcctgatcttgtggtctgccaacctcggcctcccaaagtgctgggattacaggcatgagccaccacacctggctggattattttcttaagatatactgggtaaaaaggtttgaattttgtttttgcctgaaattttgcattaagatagaatcatgcttcatcatagagacacactgtacctgacataacccttgctgtattttcgggtatcttttagttttgttattaggaatgttagaataacatccgtgtacatgagtctgactgtattttctgagataggtaatttttaaaggttattatataaacttaacagctaatttgttctccagaaaaatgaatgacaatttatattctcattgccagtatatgagagtgttttgctgcaggctttctaacattgagttaggttgttacttttaaaccattgctagtttgatagatgctaccaatgttgatcagcaaaagggggatcaaaaaataggatatcagttgggagaaagaggtaaattttttgaaggctttaagaaacaattagtatgatcccagggtgtagttacatatttgcacggacttttatgcctgtattgaaaagatatgtgaacaccagtgatctggaaataagatatccaggctagtaatcgttacgattatggctattattataaaaagacctactgttcatttattgagttaatccctagaagactaaattaaaatacatatcactgaggattagttttttaactttctcccattggttcattttcaaaaacaattatgtgtggtgaaccagttgctacctggggccttaaagaggttaaaacagaagttttaaaggggaaaatatcatttttttcacaaagaagtgaagtaggagtgcccaattgaaggaggcagcagattcctggtttcctgatttgtgctgaatatgagttgtagggcagcaggataaattttactcaattctgaaaatggagggaggggagagagatacttgcacttttcttttgcctaagtgtaacttcagagtattatggttattgatcagtgaggagaaaatattaaatcattaatattaatgatccctaataggaaagaaactttataaaatgtgaattaattgatttgcctccaattgattccttgctgtagtaaaattacttagctcactaagcctccgtttctctgtattttacacaagggtaatgaggttggtccacttcttaaaatactataaaacctcaattagctggagtgtggaaaagggaaagtgtaaggattaaaggggttagaaaagttttttggcatggtggtaaacagagaagatgccctttcagctattgccacgcaattcttgttgaaaacattttttttaaagtttattttattattgttatactttaagttttagggtacatgtgcacaatatgcaggttagttacatatgtatacatattaaagtcatagaaaaaatgcaaataaagaatattagatgtatttaatgactcaattggaaacaaagcaaaaacaaaaacttggcctccagaaatttgaatcagtgaacttaacattcaatgctaaaaaaatcctagaatgaactacttaactattgagaagatatatgcctcctcaaacctccaactcttccttttctacagataaacttgccagctgtttcacagaaaatgtagaagccacaagatggcaactccccaccataaaacacttacctgcaccatcatctgtaatttctgccttcctcccattttcaattgaagatcagaaaatcctcccgtgtatgtcaaattcttccacttgagctccagaaacctttttttaatctgttttttttaagtgtccttactccatacaataaccttgtgttttctttcttttcgaccattcccccttttctggcttctttccctaatcatttagagcttgttcaagtccctcctattcactaaagaaaaaaaagtctgatggtattcccccaaaccagtaaattcagtctaatcatgaggcaaacatcaattaaaaaattattctctaaccttctgccatatgcttaccctatctctctctttcctatcacagctaatctttgtgaatattgtctccactcagtgttctacttccttaccttcagtttactcttcaatctatacagtctgattctaaccccgctacaccactgatctgtttctgacaatcttcttttggttaacagcctttttacttggctaaatataaaggacacttttgagcctctgactcacttgatcacccagcgtttaacatagttgtcattcttgaaatatgctattcccttggtgttcctcctggttttctttgtacctttcttgttacctttttctcagtctcttttgtaggctactctgaaccttcccaactcaaatgttggtgtttctcagtactttatccttcgctaccttcttattttgcctctatcttttggtagttcatctactcctgtgacatgaagtaccatctctgagcttaagactacaaaatatttataccaattctgtttccttaacttctattagtatcctcaatttttcactaacatctattcttagatgtactataggcaactcaatctgtacatgatcttaacccctgatcacctcaccagtgtcaactgtctctattcctcctatctattaataacactctgtgattctgccatattgaactcattctacttcaatgaacattccatgccctctcagctccaggcctatgtccaggctattacctctttttagaacgatctttcctatcgcactctaggtttcaacttagaagtcactttctccagacacctttgtctttctcataaacatgagtttgatttcttctctctttcctttcaaaacactccatatttctcctcttattacatttaaaatacttcattgttgttgtctgtggttttttcttttctactagactgtgatcacacaaaaagtagatacaatacctatcatgttcccattgtattcctatcataggcatacattaagtttattgaataaataaattaatggatcttaggagcaaatcagactaaacaaagttattattttcctttggtaaaactgttagaatgatatatcactatgaaagcctagtctatcacatgcatgatctctcatgacaagatgtgccaatatggtctagttaaatggattttagtatagttaaatgattcataccaaattggtcaaccagattaatggattaatgctgacatgtagagagatctatggtggtaggccacagatctctgttatatgtcatatcttattcagaattttaaaaattattgacttgattgaaggcagagaaagcaagcttatgaaatattcagatgacacaaaagtaggtgggagagttaataaaatgaataaaagccttatgctttgaaatggtcttcatgatttggaataatagaataaaactaacataatgacatttcatagggattaatataaatctataggtttaggataaacattttaaaatccatttaatattcaagaagaatggattgcatacctactgtgttctagtcaatggtgctggggatgcaaaaaaaaaaaaaaagcatagcctctgcccttgaaatagttaaattttgacgatgatattgaatctagatcatggtacataataggctcattgcactttgtattttctacatagagaatgttgtatgctgttgtaggtatcatattaattttacaatatatgcagaaagtatactatttagtttaaaatttaaacatttcaatggtatcagtcggaataatttagattatgctattgtaataatccccaactcttggtggtttgtaaaaacaaagttttatttttcacttatgtaatgtgttggctagaagctctgctctgtgactcttcattctgtggcccagggtgatggagcaaccaccatcataaatattaccagtcactgtggcagaaggaaagatagctgtggaaggcgtcacattgacaaataaatgctctggcctggaagtgacatgcaactgtgagcaatgacttctggtcacaaataattggccagaaccagatgcatcactccatcaatcacaatggggccaggaagtgcggtcatatcatgtgaccgaaggcaaagaggtgttaagtattttgagaacagagttaatgatcaccattactatattgagtaaaaagtgaaaattacccttcaaccttagactttatccactcccctcctaaggattatagtagtgtcaaaaattccaaactttttttttttaagagatctgaagtgattttacctttatttccttcactttaagccagtgatgaaatttcacagtgatttctgggataggggcagaaggaaggtggtgttaagaatcatcagggctgtggcctagtcagcctgcagaggtgcaggcagggtgggcccccactgggacagctggaggaggcaggtaggtgatgttctcagagctgagagctggtatgtgatgtcctctgcagcttccagcacgctcagctcgatcaggccgtcccctgcggtggccagtgagttggggatcagcttggcttccatggagtcaccctcagcagagatgatggctgctattttctgctgctcagccttttccaccacaaatctggccctctctgcttcctgctgatccacctctttggcttccactgcttctgtgaactccttcccgaaggtgggatgtgtcaaggacacatcgtccaggatgagcccaaaggtggctgctcactccgtaagattgtcactcacctgcctggagagcagctctctctgggtgattagttctccagcatcaaagtgagacaccaccgacttgaggatcttggtagtgatggatggcagcacacgctcatcatagtcctctctgatgctggtgaagatgcaaggaagctggctagcgacaggccaggagaggatgtgcagtgtgatgttgacattctgtaagtctttgctaccagtgatgactggtacattaagtggtcgagaatggcagtcaaagataattggtttctgtacccatgggataggaaagtgagtcccttcccctaccacaatgtcctgtactccacagaatcggtcaaagatgacagctctgtgaccagcatccacattatataaggcagagttcagcatgcttcctacaacagctaaggccaggccaaacttgccaatggacacaaacactttggcagccatgttttcttctgctggaccctctcacacctgcttccactctgacctccacatgaattccccagccacacatccaaacctcttcctacagatttccatacacatacacacacattctcaggcatgcatacatacatagatttttccattatatgtggaatcatatctatttttcatatatcttgtagatctacccatgtctatccatacctctttatctcagtctctttaatggttgtatagtattccatttatgaatgtatcacccctacccatgacaaggtatttagtctgttatcagattttcaccatcacaatgcatactgcattgaccatccttgtatgtgcatatatttttatgcataatcatttggattgctgtagtatagattcatacaaaagcaattcttgagcactttaatttttgccaaatactaacaaattgccttgtaaaatgctgtcctaatttataatgtcataaacagaatatgaatgtgtacattaaattttgagaagactattgacaaacacttttattgatggaagaaaatgttagatgatgagggatttagacaccacatcaaaaattgagtaagactcattgatcaatgagtgtgattgaagactttttgtctaaactgcttgtaacaccttatacctactacttctaggtttcctggctggagaaaccctgaaaaagactagtccctgtaacacataacacttttgattttatcttaatggtcagaactcaagattatatcttaatgatcagaactcaatacctttccatatccagctgctagggaggctgtgaaatgaaattttcatttttgtggactatgtatggagcccaaagctggggactatgatcactacagaaatcaaaaagaaaccctatagttacttatgccagtttttttctttatacttgcttctccttgcattctctcctgagatagtcccttctgctgtctctcaatgtttcatcactcactattcctcttatctattccccttttttgctatgtcaactttttgagtctccacttctaattttttctctctctgcttcttcatgttttttctctttctcctctacgatttttttccctccctttctgtgtcctatccacctgactctatcttttgctatctctgttttcttacttgtgtgcctttggctatgttggtttcagtctctgtgtctctttatttctacctctgattctaatggttagggctaacaacagacttggctgccactttatgcagttattttcaaatgacagaagtgcttgagaataggctagatataggaatgctgtaaaaaggatttcttgattggttgaaagttggactaggtaactattgaggtcctttccaaatttgagtttgagagccatatttccctccatagtagatagaatctagttaacattattgcatctctgttttctgattgaatagctaataggacctcagggccatctctatgtgaataccagacttcattgcaaattactatagaattataaaatgtaagagatagagataaatgtgtgttgactaaagaactgtctttctctgtatatatgtatgtacgtgtctgattttatacatatatatacatatatgaaaaccttgtgaagatatcaaaattttctttgattgcaaaaatgtaacaagaaatgattataattgtgtgctatttgaaactagctgatattttagattgggtctattaactgtgtccaaatgtatccataagttaaatgtgttttggtttctagagtcaagagtttgccatataggtactgttaaaaattagcatgaaccagaaacctgacatatctggtactttaagggaggaagggaataaagtgaaaaaggtaatttgcaaactatacttgaaagtcattgaagcataacatcattacaattatctgtcaaaagatttagttcaattacagttttaaagctctctcttcaatatggcattactcatatcaggatttgatactccaatgagaggaatactaatgccttcattagccattgtcttagcagcttcattctttagaattcattacgtggccttttgggatttttatatactaaccctagggaatcagtaaacacaaatctctcaggggaatatgaacttcagaaataagaaccattgcatatttatagccatggcaggggggaagactctttttaggaaaaaaagtaattttgaaataattgaataacagtataattgccatgatagtaggtattatacatgctcctgtacactttcttcacacagcagtaagttggttgtaaaatcaccaacaggaaaaagttataatgtaataaacctaaatttcagtgtaaggtttccaggagtaactcgagctgcttctgaaacttttactattgaaacagatgtgtgggaaccatatgttgggagcccagtggtcactgttgtaagacattccttgatcaatgatgatatttcaggccgactgatgctgtagatgaacactgctactagattgattacactggcctttctctttgactatttgaattgaggcagtttgacagattttccctttcaatgggaaatctgaatcacctactgaacatgctaaaaaaaaccacttattttactaggtattcccttagcacttaacaaatataggttgctcttcattgtcctgcacttgactaagtactctactatgcatgtatcgccacagtgaggttatagttccttgaagaaaagaagctacattttataatcttagacttggtttatgactcccatagcatctaacttctagggcaaaaatcgttcagtagtggttaagagattggggtttgttgtcacacagacctacattcaaatcctttttccataatttattaatgtcatgaacttgggtaagtcacaaatgtcagtttcctgaaaagtaaaatggagattatagtaactcataagattgttgagaggataaaatgacatataacagtttagcacaatgtctggcccacacaaagtgctcaataaattattatcatcataaagtataatcattgttcagcaaaatttgttgaattaattgactcttctgtggaaatgggattggtaaatatatggacttaaaaactttatatgctcactttttctaattctgactgattttaactgacaggaaaagtagcatatgaaataattctgtagttaaattgtacagttccaatgattatttccctattcacagtcaaacattaactattttatttcacaaagaatagggaggggtgaattaaatagggaagtagaaatatttctgcatcagttattttccacataaaatatctctgaatatcagttataaaatctagttcatgtttttggtgaatatgatcacataatgtccacttggcaaacagagtttttaaagggctttctcaaatcaactttttttgccaccatttataaaatatcagaattataaaaatgatatttgattttagcaagttatggtccctacacactgtcagctttcagacagaaatcgtgaaggtacaatcatagatagaataggtttgcggtaaggagagcttggcagactcctaaaatctaaccagtatggttgagttggtaactaagtgaatatatatagcaggaagagctatagcagagatgagccaatgttcttaacaaagtcactggcgttatataagttctaaattggggggtaagacagaggagctagaatgggcacgttgttcaagaaaattttgaatcataagccttcctttgaaagttcagagcctacataatcatctggagatctggcagataaggtctatggaaaacaaagaatcctgtggagtacttaatggtcttttcagtcttggtttggggtctccaaaaagcagaactctaaggatttgaatgtaggtagtttatttgggaggtgatcccaggaagtactgcaaggaagtggcaaagtcagactggaagggaggtaaagcaaataagcaggttgccactcaatattactggaacataccaaagggtgagggagctagggtatttattcatgaactttcacaattgattgagaatcatttagtgaatattaacaacctggcacttctagtcatctcctatactggccaagctgcttttgcagttaaagaagcccctctggcagagaaacataggaagacttctgcagatgacttttagaatgggtcaaagaagacatgggcagggcaccaacagtgtttatgacagcaggaaatatggtacctctcagatctggataatcccatgttagacaagagatgttctatttcaaacaaatgagtaacttgaaaaaacactaaaagtttccactcatttgcattatttaaacatttgataagatgttatctacatagattttgttcttttattcattaaaaatatttattaattagttatgtgtcaggctctatgctaggtgatgagaataaaacagttagtgaccaagtggctgccctcatgaagtttacattctagtgggcaaggagtaggcaaagacaaccaagctaataaatttaaccgattcattaagtgtttcaactcattggagtataaacttgaaatggtattatttttccactaattgctatttactgtgttctgttgtatttaccctcttccactgagagattaggacaatgataaacatttcaatctgattgtataactttttagctgctttcagatattaggagagtctcatgctgattttaaagctttggcttgcttactccaagcccctatctgatgaaaatgcttctcttcctttttcttcaaacagatgggacatatggctctagcggctaggagtttggggacatgtatggtagcctttcatacatctcttcttatttcttccctttcccctgtgcctgttttgttattgctttgggaggagagttgctggggaaaagggagaggaaaaagacagatgcttgtgactgtgtgtgtcttctccttggttggtcacaattgctcttctagctgtctatgggcactatataaacaggtagttataacagcctgctgatgggaggcttctccaagcatctcctctggacattggaaatcccttgcaagattattacatcttctgttagaccttcagctggtgccatcagatcactttattttcacatgcattcatcttgccccatgttgcaaagcctctggcaagaattatgcagttacctagtccagcttggacctttgggcatatgccaaattcattttccatgtctcttgggacccatatatggctgtgtgttgggagtaggtgagaattagtctcggtcctcttgtcatctggaaatctccaatatcccacctctcccgagggttctttatcctagctccagtggtgcagggaaagttcagcatgtctaatggtaagtatatggttaactgggaaagaaaaagcctgttttccttgtcaaaacgtagccttctcctcctttccaggttcctttgtttattgatggagttggggtgaggtgatatggaactagctgcattggttcattgtgctggtggcttcagacatcaaactggaagttttctgaatttaggatatcaggtagatctttgaggtcaattctgggaaaagaggatcctaccaagcacttgatatcaccctgttactcttatattctgggtaaggctctatacctttaggtacgaactaattatttttaaaaatctttacatagaatactggacctttacatgtcatccagaggctattgcctttccaggttttcttccattcattatttcagtgattgctgtagtttcaccctcatacctcccattgccatttttgtatcttgaatttatcatgagcccaaagtacttcagtggtacttatattccgattattttaaaggaccctagctgaaccaccatataggtaaccaatttactgatttttttaactcaatagggacaaaaacttaaagataatttcccccccacccccaatgtctactggtggcactttacaaactcctttccctgttattggatgtggagatttaataacagcttggttcaattccttacccttttcagttatttttgattttggaagagtttcattctaagtgcttgagactcaatactgttcatttaaaaatgaactcaaagtagtgtaaaaactcttcctatcacataaacaactgtaaatgctgatcagtcttatgaataaaacaaacaaagaggtgagctagagattgacagagttcagattgggtagttgagaaaggcctttttgtgggactcagacatgtaggatgttaagaaactgagtgaacagtggagagtatctcaggaggaagacaaagtgcaaacaccgtggggaaaaaaaaatgccttggcacattccaggaacagaaaaaatgaccatcatggctggagcataggcagcaaggaggagagctttgtgaaataagatcaaagaggcacctgggggctccacctataggcctttgaaagtctaatgatttgaaattaggtacagtggtacctccagctttgttctttttgcttaggattgtcttggcaatgtgggctcttttttagttccatatgaattttaaagtagttttttccaattccgtgaagaaagtcattggtaggttgatgaggatggcattgaatctataaattaccttgggcagtatggccattttcacgatattgattcttcctatccatgaggacaggatgttcttcttccatttgtttgtgccctcttttaattcgttgagcagtggtttgtagttcttgaagagatccctcacatcccttgtaagttggattcctaggtattttattctctttgtagcaattttgaatgggagtccactcatgatttggctctctgtttgtctgttattggtgtataggaatgtttgtgatttttgtacattgattttgtgtcctgagactttgctgaagttgcttatcagcttaaggagattttgggctgagatgatggggttttctaaatgtacaatcatgtcatctgcaaacagggacaatttgacttcctcttttcctaattgaataccctttatttctttctcctgcctgattgccctggccagaatttccaacgctatgtcgaataggagtggtgagagagggcatccctgttgtgccagttttcaaagggaatgcttccagtttttgcccattcagtatgatattggctgtgggtttgtcataaatggctcttattattttgagatatattccatcaatacctagtttattgagagtttttagcatgaaggggtgttcaattttgttgaaggcctcttctgcatctattgagataaacatgtggtttttgtcattggttctgtttatgtgatggattacatttattgatttgcatattttgaaccagccttgcatcccagggatgaagcccacttgatcatggtggataagtttttgatgtgctgttggattcagtttgccagtattttattgaggatttccacattaatgttcatcagggatattggtctaaaattctcttttttttgttgtgtctctgccaggctttggtatcaggatgatgctggcctcataaaatgagttagggaggattccctctttttctattgctaggaacagtttccaaaggaatggtaccagctcctctttgtacctctggtagaatttggctgtgaatccatcaggtcctggactttttttggttggtaggctattaattattgcctcaatttcagagcctgttgttggtctattcagagattcagcttcttcctggtttagtctttggagggtgtatgtgtcgaggaatttatccatttcttctagattttctagttaatttgcgtagaggtgtttatagtattctctgatggtagtttgtatttctgtgggatcggtggtgacattccctttatcatatttttattgcatctatttgattcttctctattttcttctttattaatcttgctagtggtctatcaatttttttgatcttttcaaaaaaccaacccctggattcattgattttattgaagggtttttcctgtctctatctcctttagttcttctctgttcttagttatttcttgtcttttgctagcttttgaatttgtttgttcttgcttctccagttcttttaattgtgatgttagggtgtcaattttagatctttcctgctttctcttgtgggcatttagtgctataaatttccctctacacactgctttaaatgtgtcccagagattctggtacattgtatctttgttctcactggtttcaaagaacatctttatttctgccttcatttcgttatttacccagtaatcattcaggagcatgttgttcagtttccatgtagttctgcagttttgagttagtttcttaatcctgagttctaatttgattgcactgtggtctgagagactttttgttgtgatttctgttcttttatatttgctgaggagtgctttacttccaactatgtggtcggttttggaataagtgcaatgtggtgcagataagaatgtatattctgttgatttggggtgtagagttctttagatttctattaggtccacttggtgcagagctgagttcaaatcctgaatattcttgttaattttttgtctcattgatctgtctaatattgacagtggggtgttaaagtctcccattattattgcatggcagtctacgtctctttgtaggtctctaaggacttgttttatgaatctgggtgctcctgtattgggtgcatatatatttaggatggttagctcttcttgttgaattgatccctttaccattacgtaatggccttctttgtctcttttgatctttgtaggtttaaagtctgttttatcagagactaggattgcaacccctgctttttttttgttttccatttgcttggtagatcttcctccatccctttattttgagcctatgtgcatctttgaatgtgagatgggtctcctgaatacagcacactgattggtcttgactctttatccaatttgccagttggtgtcttttaattggagcatttagtccatttacatttaaggttaatattgttatttgtgaatttgatcctgtcattatgatgttacaaggctatagtaacaaaagcagcatggtactggtacgaaaacagagatatagatcaatggaacagaacagaggcctcagaaataacaccacacatctacaaccatctgatctttgacaaacctgacaaaaacaagaaatggggaaaggattacctatttaataaatagtgctgggaaaactggctagccatatgtagaaagttgaaactggatcccttctttacaacttatacacaaattaatttaagatggattaaagacttaaatgttagacctaaaaccataaaaaccctagaagaaaccctaggcaataccattcagaacacaggcatgggcaaggacttcatgactaaaatgccaaaagcaatggcaacaaagccaaaattgacaaaggggatctaattaaactaaagagcttctgcacagcaaaagaaactaccatcagagtgaacaggcaacctacagaataggagaaaatttttgtaatctacctgtttaacaaagggctaatgtccagaatctacaaagagctcaaacaaatttacaagaaaaaaaaacccatcaaaaagtggacaaaggatatgaacagagacttctcaaaataagacatttatgcagccaacagacatatgaaaaaatgctcatcatcactggtcatcagagaaatgcaaatcaaaaccacaatgagataccatctcacaccagttagaatggcattcattaaaaagttaggaaacaacagatgctggagaggatgtggagaaataggaaagcttttacaccattggtgggagtgtaaactagttcaaccattgtggaagacagtgtggcgattcctcaaggatctagaactagaaatagaatttgacccagcaatcccattactgggtatataaccaaaggattataaatcatgctactataaagacacatgcacacgtatgtttatcatggcactgttcacaatagcagacttggaaccaacccaaatgtctgtcaatgataggctggattaagaatatttggcacatatacaccatggaatactgtgcagccatataaaaggatgagtttatgtcctttgtagggacatggatgaagctggaaaccatcattctgagcaaactatcacaaggacagaaaaccaaataatgcatgttctcactcatagttgggaattgaacaatgagaacacttggacacagggcagggatcatcacaaaccagggcttctggtggggtgggaggcagggggaggaatagaattaggagaaaaaacttctataaatgacaagttaatggatgcagcaaaccaacatggcacatgtatacctatgtgacaaacctgcacgttgtgcacatgtacactagaacttaaagtataataaaaaaatacaaaaaaattgaaaaagaaagtctaatggaaggagttcagatttcactctaaatccagtgggaagccactgaaaagttttaagcagggaacctgacatggtttaactgtgaactttcatgttttcttctatttgcaaaaaataaagccagaagaccccagattgtcattgtttctctaatggagttttgaaaaatgtaaaattataggtgtggttttgttgaggccaagatctgtggttcaaactttatatccttttttttgacttttcagctgtcaagaaaagtgaaggatgaagccaccatttcttttggcccttgtggtctgttctgtagtcagcacaaatctgaagatggtgtcaaagagaaattctggtaagttgctggcaacttgccactatttggtcaaaaatgtacagttttgtgagcacccagagggcacctgtgcctttaactatgaatgtctttaaatagaagcactcgtattccagttatgttggaaagtagccaaaataaaaatgatgtttaatcctaccactgagaaattgttgggaaatcagtggaattttgttaaacttcaatgaccagtatactctcagtggacaatgaaatgttaagggcctacttagagttggttacatttgctagtgaataaatacctgggagcaaacatttacaaatgagaaggtaagaaacctttaaaaatatacatcctttgcctcctaattgagtgtgtagcattgcaatttaaagactttgataaatatctgagttttagttccttatagttgtacccagttgctaacaggcaggggtctacagcctccaagttcagaattattagctaattgcccgaagaggaatttctcgagaagaaaaatctattcctagaacatgttggtctggcaggcagccatgactgtactaagagattagctgtagccagtacatagtccagtcaaagcttaatcattgtttaataatacttggatatatatgtctttcagttttgattatacattctagctgtaattacaaactttgcatgagattttaagaattgattttctgtctgtaatcattccagtaagacattgaggaatgtgttattatatggaaacaaaagattgtgttgagactttctactggcttctaattcatttatttctgagaattaaatgtatttgctttactttctcattaagtatcaaatctagtcaatgaaatgcatgcttacttttcaaagcaaaaaatgcggattggggggaggtgcttggagtttggctaatgtttgtttcctgagataagaatacttactaattgaaatacctaacaaatagttttgtcttcaattgatagcatattaataaatgtttccaaaagtgagagatttatcacagactataaaatagagtaacactgctgaagtccaaaggatcctggagtgataaagatagggcaatatattgtctttttctcttcttatagattcaggtctatatttaaattacttttgtatgttgtgactctctttcagctgaatttgtgtttaatattttacctattatctctccagctcagcatatcattcatggctgcctttccttgctttacctttgaagtcccattttactttcaatcttggttcaaattgatagttgctgaaataaaatatttagagagattgcttaacagcaaacataacctgttgaaccagattgcattttccttactcggtcatgtcataatgtctggagcagatccgaaaggaaaaaaagaaacgagggtttaaaaagtcatctgtattatggtagcttaattgaagtaaaatccaaactgaaaaaaaataagttgctgtcaatgtattctgtcttataccttggtttgcttattatataagagaagagaggctgttaaaatatatatatattttatatatatttatatatataaaatatataaatatatatatacacacaaatatatatgtgtatgtatagacacacacacacacacacacatacacatatagctgggctattacaggtggctcacacctgtaatcccagcatttgggaggccaaggtgggtggattgcttgtgctaaggagtttgagaccagcctgggtaacatggtgaaaccctatttctacaaaaatgtaaaaattagctgacattgtggtgcacacctgtagtcctagctaatcaggaggctgaggtgagagtatggcttcagcctgtgaagcagaggttggtgagccgagatcatgccactgcactccagcctgggtgacagaaccagaccctgtctatatatatatatatatacacacacacacacacacatacacacacacatatagaaggttatcattaatgcacagatgtcattaaaagatcaacttttcaatgctttgcctctttatttttgcttgttaagcgtgaggctatttgtggcttactagggtttcttagctttgttttcttagtgtggacaaatggtatcatatctgcagtcagcttcattgaagaaacattacccaaaaagatatttcacttacagtcaaagtgttagaatggtttcagtctctgcttctccttccctttatgctgcactccccctccatccctgccaggacaatagcaattgtaatattggaacaaaacttcttacaggtctgtgcagttgaaatcatttgaatgcacagctggttcttttattttatgccttactgcttctgtttatggtgtatacggagtaggcagaaaagactaataggttagtgttggtttgtgcttgtctctgtgtgttttttgtttgtatgtttgtttattgtttcataatgcaaaaaagatagggcatgggatgaataaaagacatcttaagttgctgatgaaaacgaggatactttggagcagttcttttcaactctacctttctgtttagccacccccatcataaccccctctccagccctatacctctgttaatattattattttatgtagaaaatataattatttgcactttcattatcatagtgctatttgagttaccttatcttttgaagaacattaaaaatgctttggcaaatctgcagtacaaatttttgcttcatgtagcttgtgaagtcctttgctcattgccaatcaaagagatccaggtttaagctcgcatggatgttcatcatggaatcactaacggaactcgtaacttttatttttttcccctcttcccttccctcaagtcaagaaatgaaaaacgattgcaccctttattcattaacatttatgactgtttagtgtctgatgtgaagatagttataatgatttctatgcagttcattgtagacacaaatccctttcactgagatccctacaactgctgttgctaatggccacccttatgcacaagacagagagaggaccaagggtggaagttttttcttctgtacttgtcaaacatggaaaagaacttagtaacagatgtgagttaggtttttggttttggaggttggtttgtttgttttaatctactctgggcacatattggagcaaacctgcttttgggtggtgtacaatttttagaggtgatagcacaggctatgtttccatgtaatgcccattcacactgggcaagtccaacaatcaaccctggcttgggaaacagcaaagatggctctgagactgcatctagggcctgattgctttagaacatattaaaatgcacagcatttaattttaaggactatagctgattattcaagtgtaagtttttggtcttcttcacataacactccttcagtattcactttttataaatttaggactggatagataaaagtcatttggaaagcctactctatcaaaaacaagtttacttaaaggtgtcattctttatgtcaggaaattggctaatatcttgatgatcaatagcagaaatggccatttctttttcctgtagaggacacaggtacctaaaactaatttttaatagggtgggtgggagaaattactcttcctcaagaagtcactcaagaccttctatttagctattttttaacctgaaaaacgtcctcagaatatacatgaactttattatttgggacattaaatcatccccttaactttcttttggcttttgctgctgctgctcctgcatgaaaatgtgagccatgttatgcagttgttggcattcagttcttccagcatggacctctgtatcagagaaagcatcagtctgatgagtgggtatgttaatattcaacccaaattgggtcatcttacagtcagttcatctggaggatgatctagcacaaaaacttctcagtgttgggaggaaaattgcagagctacctgcatatctcaatcagctagaaaatgtagtccccagtggtaagaagaatgtgaagacttgctggcacacagtgggtatttaaagatatattttggatggacttgaaagaaccactcagttccacgtaatgagagaatggctttatttggggctttggtttataaaattatgatattttctgattgttgatgaggaaataacagcttgttttcactaaaatacatttgttttagaatttccagttagataactgaggacgaccataaaggcaaaagtagaggttatatgagcttacatttctggccaaagctagaaagggactcttataccacttccaagtaaaaagaaaataacttcttttgtgaaatttattgttatataattaaaaataaaaggaaccatgctttgaaccctcaaaggaaacaataaaatgttttatttaaaaatgctggttagaagtaatgttgctctgtggatattcacactgtgcttttagctgtagagtgtaagaacactagaagttagaaaatcaacaatgtgatattgagatctcatctcctaaatgtattctaatgagctaagatcaaggaggaaaatacttccctatgatttgttctttaattgaaagggacaatctgagacatggtacttttatctctttaattagggtgacttctctggaggaaaatggatctttgaaggaagggaaagtggtactagaagaattggttaggtcattggaagtgatataggacaatgtttggagtataagacaaagtttacagcaactagataataggcagggatgagagatatcggtcagaaagaatgtgtggccagaattgagctgagtgaaacacagttattgaataagttgaaggggaaataattttacagttcttatcattgaatttgatatggccaaaggcatacttgttgaactgttactgtatgtgcaatattccactagtcctgaggtggggctgacggggagggaaaataaatcaaaactcccttgtttaaaatacttaatatcattgagatcaatgaatggctaagcaaataatggttttagggttagggagggtggagtgtaggtcctgttctctggaatgttccattctctaaaggtagaacatttctggagttttagctggatgcccagatgttaacaagatattccctagcactgctaatcctttaatatcttcttccattatcaactctgtagtggtcgttccgcaatgataagcctttggcagtcttttccagggcatgttcagtccagttctcaatcagggatccatagaggacctccacatagatctcatgggctcccctctgggaagctctctccttttactgggagttccagccattttaaatgccttgaactctgatctctgtagctccagctcaataatactactgggctctgttaggactctaactcaccaagccatagttggggaattgtccccagtcggagagctgggttgattgtggggctcacaccattagtcctccttttctccgagatcacagcttaacacttcctgaatattattgctttacacatttcttccacttttgttgttgcttactgtgggagagttagtctagtttcagttacttcctgttaccttcgataccccatcattctttgggtgctttctgtcataaagaagttgtgctagggttaccttgatactgattctttttagtggaaaatgaatttagaaaccttctttttcttttaaattgttatttcattgagatacttccaattcaaatccagcatcacagggctcttccttacctttctccattccatatttgtatttcctttttccacagtgagaaccctcattctcatcaacatcaatatatttacttgttttgtcctataagttatacaaaatagttttagaatgtctacaccaaaaccactacaagcaacaaacttactaaagtacaagatattttataattctttttgtctttagaattcatcccactaaagttgtacagtcagagtgatatgttcaaaagttgcttgaattaatttctttttctctgtggtcatgttattaattcaatatataaataagttaatttgtgtttctatgcaatttgcttttttatccttttggattaaattttatttttgaatacataaaatttttacatcattggaaattcaaaattatagaaaaaataataaatccaagaagtctcactcccatgcctatcccttctacctggtctcacacatgtcctagttgtaactaattcctttagtttctgatatttcctttctttttcttttttgcacaaatcaatgtgtatatttttagttccacttgtttcatagtagcaaaaaataattatccatttaattttttggttcttgattttttcactaatgtatcttggaagtcaagcattttggattctgttaatatttttttcttattacaattgtgtatcatgcttaatgaaatttaaaataatattaaaatagaaaactctcttgtttatatccctagagttaactcatgattgaattttttatagattcttccagatagtttctttggatatatatgtatatagatgatttatgtatcctaaatcatatgcatttttcaaacttggaatcatactgtacgtactattctccaacctgatgttacttcacatgatatttatatctgtaacttctaattcttgacactatataactaaatcatatttttaaatactgtgaaatattccattgtgtggacttataataaaattaaaaccagtgctctgtttatggaaattagagttttatccctaggttttgctattgcaaaacaatgctgcgaggagtgccctattacatagatcttagtacactagaagagtaaacatttttgtaggctagattcctagaagtggaaatgttggataaagtttttatttaaattttgaaatgatactgacaaattgcccaccaatgtcactgtgccaattttgccaatctaaatccaaatgaaaaacatttcattgtttactaaaatccccaggttggctactatgagtatgttctttggattcaaataaccttaaaagtgtgtgtgtgtgtgtgtgtgtgtctgagacatagagagagagagagatcagcagcaaaacaatccatacagtgaaaatctctgcctattccattaagtttggcaacaaagaatggcagagaagagaatgtgagttaacaactaagttcattattattttggttgttctacaacatcaacatctgatatgattgaaatattaaagttccttatgacactggttctctttaaatgaaaaggtgtggataattaagctaattatttaatgaaagctggaaagtccgaaaacaattccatgggggatttcatccagctctgtagcatcttccaaatacagaagtcaccgagcttggtatcatgttggatttgttactgtccataaggttaaaggatgagagagaaggaagaataattgagccttctattaattttgatattgggatttatcccatccataagtacagccaagaactgcagtgaatgagctcctttctactctgttgttttggaatgaaaagatattttatctgccagagtggagacatgctttgaatgtctgttatttctgccaggtgagtttctatcataacccaactcatgtaggcacatcagtctaaagtgcatcccttgtggctttgctgacttctacaggtgtaatttgccctaaacgaagtatgtgctctgcaaaagcacacccttaatgcctactgtagtttggtccctggagaaagctagcacccagagatttcttagaatatgcatgactttcctagtctatgagaaggacactgaatatgcagttttaaacttccattcatattcctattcttgcctcatatttgcttccatatatttatttgagactgtcatagagaagcatgatattttgtgaggcttgcaccaggactattttctaaaagaaatgctttgacattcaatgaccttcccccaggctaagaagagtcaggccctgcctctctctgtgggtgtgagttatgagagctgtattgtaagtgtgctctccctaaatggttacagacaagaaacacatggttttaagaggcacccattaaacccttaagatgaatggcatgtatttggcatctctactttgtggagaaacaagacagtggtttcctgaaatcaaattctgccaaggattgtcttagaaatagggcatttattaattcaccaaacatgcaagcaaactaaatgcaagcaagcaaaataaaatgtcttatgatgggtccctctcagtgattcagaaattgaccagacatgcttttagccccccaagaaacaagtaaatcatagggggaagggagaaactaacatgcatcgagtgctcctatatgccaggcactttacatacattgtctcctaatacaaagacactgaggtaggtaggtccaactcttgttctccatatagggaaactgaggcttagagtagctaaataatttgaccactctcttacatagctagtaattggcaaagccaggatttaaacccagatttgtctgaccccagagtcctgctcttaatcactcgtccatgttgtgcctttgtgtggacatcattagcctcattttaaagatgagaaaactgaagctcagggagggtgagtttatctgaggtccccaaccattaagtggaaaatttaggtttcagatgatcgactgattccaaagtttatgctctttccacaacaccatggatatgtcttatttacaactcttataaaaggcataatataataagagtcatataagaggcatggatatagttcatatcaaggagatattattttcagctgggtgtgagggtgattagggaaggcttcatgggacaggcatcatttgacattgactgtgaagactggattgggcagactggattgggaatagtgacgggggatggtattctgagcagaggttaaaataagagcaaatatgtggatgcataaagtgcaggatatttttgaatatcaagtggcctaaattgactggaggatagtataagattcaggtagttaggaaacatatttgttgagaaacaagtagctagacagatggtgttttgaatacctccacaattttaaaattataggatatatattgaatccagaaaggaaatgttggttaaggcgctttagattggaaggcagggggcaaggttgctgagacattctagctctgtgctagtgtttcttttttatttttatttttatttttttattattattatactttaatttttagggtacatgtgcacaatgtgcaggttagttacatatgtatacatgtgccatgctggtgtgctgcacccattaactcgtcatttagcattaggtatatctcctaatgctatccctcccccctccccccaccgcacaacagtccccagagtgtgatgctcgtgtttctgttcacatgctttacatttgctataataggaaggttcaatcaaagctttgttttcaattatgaaaatgttttgaatttaaaaaaaactgagtaaggcattaaccttaattaaaaatcagaataaagcttatttgtatcttcagcttcagggaattaatgatttttttttttttacagtaaaggaacttgtttctggtcttaacattaccagcgggtggcactgtaatacattccttctgcatctctgaagtagcgttttaccatctcatggctgtcttcagagtctgaaattagaaggaataacagctttatagtcaccatagtgtgattggtctaatctttgaacacatttactaagcaccacccccacaaccacgattcttcagtttttgagagctattctgcttaggttctcaccaaactacctctgaatcttttcatttttttcccaagaaggtgactgtgaggcatagctctcgttacttttcaagtagttcttcaaagttaggtattcaaaagccaaaggcaggagaagttatgagactggcaaattttacctttggcactccccctggctactttgcttttaatatctttgcttgtttcttgtgcatttcgccctccccaaggctaaagagaattcaaatgattcacaattttcttgacctttactcagaactttcctattctttgataggtgacagctagtttaatctttaaaccaatccagactgatacactgaaacactactgagcattcggtgttattggacacacctcttcctttttgacactctcttcttctgctctagtgacatcattttatcttggtcctatctgtatctttctggccattttttcccggtctccatcattatctcattttcctctctgtctcttaaaagtcgcttttctccagcattttctccttgttactcttttaacaaaccactccatacgtttccaaagtttctactcccttggtattaactatctaccctcttggtgcttctcagcagtgtctgcatattggaaccacccagggagcttttaaaccatattcctgtgcaagtaccactcccagagttactgatttatttgggctggggcctcggaatctgttggttttttgttcatctatttgttttaactacaaggtgattctaatgtacagccagggatgagaacccctgacctattgaggtttctagcaatccagtctttatgtctcctctgagttacatgcattattttccttctagacatcttcccttggctgtcccacaggcactttgaacttcaaaactcaatttttaatctatttaaattccacccttcttgtgtaccccatcttagttaaaattacattatcattctatttgggccagaatatatggtgtgactctcaaatctactgcaagtttccatattcagtaatcaccaagttctgcagtttgaattctcaaatatcttctaaactacctgtattagtcagagttttccagagggaaagaactaataggatagatgtatatatgaaagggagtctattaaggagaattgactcacacgatcacaaagtgaagtcccacgataggccatctgcaagctgaggaggaagtcagtagtggctcagtccaagtccaaaagcctcaaaagcaagaaagccaacagtgcggccttcagtctgtggctgaaggcctgagagcctccagcaaatcactggtgtaagtccaagagtgcaaagtccaaagaacctggagtctgacgtccaagagtgggaagcatccagcaagggaaaaagatgaaagccagaagactcagcaagccagcttattccaccttcttccacctgctttgttctagttctgctggcagttgattggatggtgcccacccatactgagggtggatctgcctgtcaagtccactgactcaaatgttatctcctctggcaacaccctcaaagacacacccagaaacaagtactttaccagccatctggcgtccttcaatccaacaagttgatacctaatattaaccatcacaccactccagtcatgttttttttaaacaaattttgacttttattttagattcgggggtatacacgtgcaggtttgttacctaggtgtattgtgtgatgctaaggtttgtggtatatatggtcctgtcacccaggtagtgagcgtagtacctaataggtagtcaccccacacttcttcatcctatctgttgctgacctagttcagcctttcataatttcttccagcccttctacattactgcccattttccataatacttgcaaatggtgtttttacttgtttgcttgtttttagttatagatgtacagcaatttcaagcatttattccattgtctaatgaacatttgtagatcaactgctagatgcaagacctctacttatgaaataaaactcctttgactccctattgcatacaggataaaggtaaaatgccttgtagcatataatatatggcatacaagacccttaatttattccttagttcacttattcattcaatacttaaatattcaatggcctgtaataggtactatgctaatttttatataaatataaaaacacgtgtgctattatatatgtatgtataggtatatacatatgcatgtgtatacacacacacacacacgcacacacacaaacacacaattcatttaggctccaggcttctcagtcctatttttgtgcccctcagtcctatttttgtaccccttgccacacacctcttcacacaagagccatcctgagttatttatcattctgaaaaaagaactgttcatattcccagctctgagcattttatcttatgcttttcttcacatgtgaatcacttcccaccttctctgacttttgatactattcatctttgaagaaccatttcaaatgtcattttctctgtgtacctttcgttggattgcccccatcgacccacctcttccaggcagaattaattgtccttcctctgtgctcctgtagcattttgtttagacttctatactggaactggtcatattgtgatttagttatttgtacgtctgtcttttccaccatacctgggagctttttgaaggcaaaaattgtttcctcgattctctatacctggtagactgccttgtacataatagttgatctacgaatgtttattagataattgaatagatgcttgtggattactggcaccctagcagtctttaggagcagaacacatgtgattgaaagtcattaaacaaccttgaaaaactgagtatgccacctatcacagtttggaattgtggccagagcacagcctgcctactctcaggttttgctgttttgacaaggaggatttatcagtgcaatcagggcctttgaaactctatcctcatctgcagagcccacattcacatagactttatagtttataatgagattttaatgtctgaacaccacccacctcagtggtcagtgacttggcttatttaggattcatgtggtatgaactagctaagaacagagagcatggtgggctgggaaagggcaggccaattgctttctttcttttttttttatactttaagttttagggtacatgtgcacattgtgcaggttagttacatgttacatatgtatacatgtgacatgctggtgcactgcacccactaactcgtcatctagcgttaggtataactcccaatgctatccctcccccacccataacagtccccagagtgtgatattccccttcctgtgtccatgtgatctcattgttcagttcccacctatgagtgagaatatgcggtgtttggttttttgttcttgtgatagtttactgagaatgatgttttccaatttcatccatgtccataaaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatgcctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatgaccagtgatgacgagcattttttcatgtgtcttttggctgcataaatgtcttcttttgagaagtgtctgttcatgtccttcgcccactttttgataggattgtttgtttttttcttgtaaatttgtttgagttcattgtagattctggatattagccctttgtcagatgagtaggttgcaaaaattttctcccattttgtaggttgcctgttcactctgatggtcatttcttttgctgtgcagaagctctttagcttaattagatcccatttgtcaattttggcttttgttgacattgcttttggtgttttagacatgaagtccttgcccatgcctatgtcctgaatggtaatgcctaggttttcttctagggtttttatggttttaggtctaacgtttaagtctttaatccatgttgaactgatttttgtataaggtgtaatgaagggatccagtttcagctttgtacatatggctagccagttttcccagcaccatttattaaatagggaatcctttccccattgcttgtttttctcagttttgtcaaagatcagatagttgtagatatgcggcgttatttctgagggctctgttctgttctattgatctatatctctgttttggtacaagtaccatgctgttttggttactgtagccttgtagtatagtttgaagtcaggtagtgtgatgcctccagctttgttcttttggcttaggattgatttggcgatgtgggctcttttttggttccatatgaactttaaagtagttttttccaattctgtgaagaaaggctttggtagcttgatggggatggtattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaggcaattgtgaatgggagttcactcatgatttggctctctgtttgtctgttattggtgtataagaatgcttgtgatttttgtacattgattttgtatcctgagagtttgctgaagttgcttatcagcttaaggagattttgggctgagacagtggggttttctagatatacaatcatgtcatctgcaaacagggacaatttgacttcctcttttcctaattaaataccctttatttctttctcctgcctaattgccctggccagaacttccaacactatgttgaagaggagtgttgagagagggcatccctgtcttgtgccagttttcaaagggaatgcttccagtttttgcccattcagtatgatatcggctgtgggtttgtcatagatagctcttattattttgaaatacgtcccatcattacctaatttcttgagagtttttagcatgaagggttgttgaattttgtcaaaggctttttctgcatctattgagataatcatgtggtttttgtctttggctctgtttatatgctagattatttattgatttgcgtatattgaaccagccttgcatcccagggatgaagcccacttgatcatggtggataagctttttgatgtgcttctggattcgttttgccagtattttattgaggatttttgcttcaatattcatcaaggatattggtctaaaattctctttttttattgtgtctctgcctggctttggtatcagaattatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagttttgggagagtgtatgtgtcaaggaatttatccatttcttcatagattttctagtttatttgcgtagaggtgtttgtagtattctctgatggtagtttgtatttctgtgggatcggtggtgatatcccctttataattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgttcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcatttcgttatgtacccagtggtcattcaggagcaggttgttcagtttccatgtagttgagcggttttgattgagattcttaatcctgagttctagtttgattgcactgtggtctgagagatagtttgttataatttctgttcttttacatttgctgaggagagctttacttccaagtatgtggtcaattttggtataggtgtggtgtggtgctgaaaaaaatgtatattctgtttatttggggtggagagttctgtagatgtctattaggtccacttggtgcagagctgagttcaattcctgggtatccttgttgactttctgtctctttgatctgtctaatgttgacagtggggtgttaaagtctcccattattattgtgtgggagtctaagtctctttgtaggtcactcaggacttgctttatgaatcttggtgctcctgtattgggtgcatatatatgtaggatagttagctcttcttgttgaattgatccctttaccattatgtaatggccttctttgtctctttcgatctctgttggtttaaagtctgttttatcagagactaggattgcaacccctgcctttttttgttttccatttgcttggtagatcttcctccatccttttattttgagtctatgtgtgtctctgcacgtgagatgggtttcctgaattcagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctggatgatctttacattttggcatgattttgcagtggctggtaccagttgttcctttccatgtttagtgcttccttcaggagctcttttagggcagggctggtggtgacaaaatctctcagcctttgcttgtctgtaaaggattttatttctccttcacttatgaagcttagtttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaacattttttccttcatttcaactttggtgaatctgacaattatgtgtcttggagtttatcttctcgaggagtatctttgtagcgttttctgtatttcctgaatctgaacattggcctgccttgctagattggggaagttctcctggataatatcctgcagagtgttttccaacttggttccattctccccgtcactttcagatacaccaatcagacgtagatttggtcttttcacatagtcccatatttcttggaggctttgctcatttctttttattcttttttctctaaacttctcttctctcttcatttcattcattttatcttccatcgctgataccctttcttccagttgatcacatcggctcttgaggcttctgcattcttcacgtagttctcgagccttggttttcagctccatcagctcctttaagcacttctctgtattggttattctagttatatattcaaaatttttttcaaagttttcaacttctttgcctttggtttgaatgtcctcccatagctcggagaaatttgatcatctgaagccttcttctctcagctcgtcaaagtcattctctgtccagctttgttccgttgctggtgaggaattgcgttcctttggaggaggagaggtgctctgctttttagagttcccagttttcctgttctgttttttccccatctttgtggttttatatacttttgatctttgatgatggtgatgtacagatgggtttttggtgtggatgtcctttctgtttgttagttttccttctaacagaccggaccctcagctgcaggtctgttggaataccctgccgtgtgaggtgtcactgtgcccctgctggggggtgcctcccagttagggtgctcagggttcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgtgctgtggtgggctctgcccagttcgagcttcatggctgctttgtttacctaatcaagcctaggcaatggcgggcgcccctcccccagcctcgctgccgccttgcagtttgatctcagactgctgtgccagcagtcagcgagactccgtggggtaggaccctccatgccagttgtgggatttaatctcgtggtgcgccgttttttaagctcgtcggaaaagcgcggtattcgggtgggagtgacccgattttccaggtgccctccgtcacccctttctttgactcggaaagggaactccctgaccccttgcgcttccccagtgaggcaatgcctcaccctgcttcggctcgcgcatggtgcgcgcacccactgacctgcgcccactgtctggcactccctagtgagatgaacccggtacctcagatggaaatgcagaaatcaccatcttctgcgttgctcacgctgacagctgtagaccagagctgttcctattcggccatcttggctcctccccccaaaattgctttctttttattaagagaaaatatcatctatacagcatggaattacaaaaagccttaagaaaatgctgtgtaaatgaacagccaaagtaccttcctgcaatctagaccgtgggatcccatatttaaacttatgcctgtgcaacaaaatattagacaaaacaataccagagggagaatggtggtgaacagtttttaaacctatgtagagtaaatatttgtggtagtgttttcctttacacagcatatgcagtagaatgacaatataaaggaagtagaaccccatttgtcaggggagtaggaaggcctgatttttatcagcatgcttctattggctacgtctaagttagcctttttatagagccactgcatctcatccttcctttttacttttgttcaaagtcgagtctcccagctctttgagctcttcctcagtcactctaatttctgctttgatagtagatcctagacttcttttacctctttccattttattcagtccctaagtgtcattcgcacatcctctgtgcttcacctaactacaacttggccaaagctgttgctactaatttcagtttacttagaattagttcaattgttcaattcccacttatgagtgagaacacatggacacaaggagaacaaggagaaaacatggacacagggaggggaacatcacccatggggcctgttgggggatgaggggcgagaggagggataacattaggtgaaacacctaatgtagatgacaggtcgatgggtgcagcaaaccaccatggcacgtgtatacctatgtaacaaacctgcatgttctgcacatgtatgtcagaacttaaagtttaataataaaaaaagaattcaattttcttaaagagctgatcaatttgtgcggagatgtataaaatctgattttgaactaaagaaacttaccttacatcctgattagatctttaatgtcataaaaatgtaaactgtacagtgaaggggcccttagcacacaattgtttaaaatccactacccgttgtgtacttttgtcccttccttttctagttgttccttcaagatatggactggagcccatgaatgacactaaaatgtggctcacctactcatcctgctgattaaaaaaataaacaggaaacacatcacttctggtgaatgtcatgaccaggatgttagataaaaacacccttaggggccttaacaatttgtggccagaatgacctttgtttttgcagttgtttttcagtctgcaaggggcctttccatttcctcttagaaggtatgaacactgaccacagcattttgaggcccaggctgtgcggcttaactctcttgcatacaagaacaaggaagagaataaacagttccgtttcctgggtaatcttaccttcctctttcctaatgttgttttaggatttttatctttgcacttttattccttgaattttatgatggggattgtcatattctctgacttttcatggattttattagaaatcacttgtatcatcaggcttcttggatctaccactttggatttggtgccctttttgctgctcttggtaagagctttgtctgccattttcacattcttgattatttatgctgctttgaatgtccgtttgagaaagtaatcagatttttttccctctgagaaagcaggggaatgatcttttgcatcactttgcataaaattaacatgttgattttctataaacccataggttcaggttaatttacataaacctggcattcaggaagctcaacctttacattgtcaaggaaaatgaaataaatcaggacagctgaaattaagtatattcaagccatcagaaaatggggtgggcaaagaggcgctatggggtagaaaatttcatagttccttatagttacactcacaaaatcttaatgtgttaagggaccagacaggtttttcaatccagccttttcccagtgtaggaatcccattgagagcacaccatgcaagtgatggtccagctgacagttacacttgcaaaacaaagtgcctagtaaagcagactctttactttggaatgcctttaattgttaggaaactaaaatctgttcttttgtgaactcctattaatgggtcttagctctgcctcctggaatcaatctaatccagtggttcttaatttggaatccctggacaaggcttaaatgagtccacaacccccctgaaactgtatgcaaaattgtatgtgtgggcatgtgtgagtgtatgcatgtatcgatagctttcataaaattttcaaagggacatatgatcctcaatcagggataactttataagcatacaatttgtgcagctgcactaagccccacacttaaaaggaatttgtacttggattaatgcttttctgttgccatcctgaaattcttaataatttttaaacatagagcccgaattttcattttgctctgggccctgcagattataggggaactacccccaaagacatgaagttattaaaaaaaaacactaaaatttctataaaatgaatcattggatagttctactttcaggaggcctgtaccatccttctgtttaccttctgaccttcttgtgtttccaaacattatcttcttgatttagaatgaaatgagggcagtctacttcctctttaaattctttccaatttcttccctgccctatatgaaagattcttaacttggaatattaacttggattcataacttggaatccatgcccattattttattttacaacttatctaatttatctatatagtatttcaaactttgaaaccaatttaacacaacaactgtattgtgtctgaagaaaattaaccatttttattaacactgggacagttcttatctttttatccttgggtatctgaaattagagcacagcgagttctgtcagagcaaaaaatatacttttaaagcaaatcattcagatgtatccaattcaattttactaacttctgtcttgcttcatatgaaagcttttaaattgatctctttctttgattgatcagggtctttccccctcacatataatactctcaataaatttaatacactgaaatgtatattctcataccaaataattcacttaatttataacatcaaatacagaaaaacttaatttaaaattttaattgcatattttatgtcagcatgttattaaaacgaagttcataacacattagtaattttattggagaagtacaagttcccctgagggtcaataggtaaatgtgttattactctttggtgaccttggactctgctgtgggaagaatgcaaatcatagccactctgaacaacgtgagaaagagaaagaaaataagctctaggacgaaagtttaaaagtactgcaattatttttccttggaataaagaagtctaaggataacctgaaacaaatgaggtatttttgatgaagaagagttgtcttctatattcaagagaaatagatgatttgagatttaggttgacatttgaagaaattttcttttaaactaatagaatcatgtcctgtgtaggttagagacttacttacctaaggcaaaggcttcagccagatgatatcttgaggttccttcaaattctaagtttccacccttgggcttaaaattccacttctgtgatacaccaaggctggcatggactcttttgctgatttgcctttcatcttggactcttcattttcattcttaattatgtgttgaacacatgtccctcctggggaagaatgagtttggaagtaatgaagttaatttgttgaatggctagaatgaccacccataaatatctaagtgaggattgtctctttcaccttcatcatctgggaggccaaaactgaaatatagttatttcaattttgttgtcattactcaaatgtttttgcatctattatttgagaactcccttcagaacccatggcataatctgggtaactccagtttggacctaacctttgagtgtgatttgcttctttaagatagccaacaacaacaaaataaccaacatacatttgcacccatatcttactaagtaggtcagtgtggtaatatattttctgtgaaaatcatgttataactgtaaggtaatagagggtttctttggcttgcaaacaaattggatatgaaggcacaattaggacagaaatttcaaaaaattacaatagatcctaaaactgtgctagttggtagactatatggctggtgactaacataggtgactgctttgttaactaaaggaaaatattcatcccaaatttaaaaatcaaaatagtctcattatatcatacatatacagccaatcaacagaatagaatcagagaataatggaatattagcttttgaaatctcttggagatcattttgtctaatgtcttcacctccacctctgtgattctcacattcgtgtttcagctgaagtttcattctgggaagactgtcagtggactcccaagaatagcttagattccttagtgcctgagtcagggcctaataaataatagctactcaataaatattcattgaatgaatgagtatatgaacatatttagaggtttggaagaagctagaagaagctggaagttacagtgtcttgaagttattatcataaatgttaataattattcaaaacagctaggggagaagaagtaatccggttgtatgagcattctgattgttgcaattctagttaaatgagatttttctataaacatatatgtaaagattgtcctatctcctcagatattaaaaagggttttatttttttaaggctatgtttggaatttgaaccaaattcgaatgtgactgcttcttgctcttataactgctaattgccaagcactgtatagaatcgtttggcctgacattgcttctgaaaggagctaaccatgctctggtaagaagggaccggatctatggaaaagaaatgctctgctgtatacctagctttcacctgatatacacttcacttcttgggatgtacacttgctgtatactgccctactgcacaatcttcctcacttttctccctgcctggcatagttgtacccatagaacagagacctgatctacttcagccacatgtaaagaatccatatggatcaagtgctggatgaagattctgtacaccttgattctagtcctgggaatatcactctatctatagcactgtggttaagtactttctgagccttagcattctcatgaaaaaaataatgaggggtttgggcttcatccaaattgttctcaaattgtcttctgtgcattcctaggggttcattggaggcacttctggggctaatacagaggtcagagaaagaagcagaatgacggggactttgggctcacccactccacttcaaccacagcagcttcacttttgtttgatatgcttctgtgaaatattttgtttgaaaaccatatgcactgacatggtgagagtgcataatagatataatttagtcattcaggtaggtgaaatgattccaccgactgtttcatgatccaatattatggctttttgtgttgctgattgaactgaatgatcatgcaacaatctgatcaattgctgtaagcagctatcttcttggccacctggctgcatctattcatgtcaactcagcagtagctttagattaaagatgtgaaaattatgagcccaggaatagaagagtctggctttccttctcatggagattgaggtgggggtatgtgaatagttctgggcaggactatatggagttctattaatagaccctccacctcacctacttttccttccctagacctggagctggactttctataaatgattgcctgcttatatactaaaagctaaattgatccaagtaagagtcacacccagggtacattttatcattttattatctctcatcctttcaaactcaatcgattgtttactataagaagcacgattagtgctcctaataggctgacaggaagacataaagtaccctagagatggaccagaaaagggggaaatacatttggtctgaaatatgagttttattttcaggtatccactgatctgtggttcaaagtgtgatgatttctcaatgggaatgacctgatttttttcttggattttgttactatttagcattgattgtgtgtagcattttccatttacctaatggctagaggtcatgcaaccagtcaccactctcattccagcgtcacagatgaggagccagaaacccaaggagaaactagtaagttggctctagctcatatgctaaattgatgcagaggtgcagggaaccaacatcaattttctaaaacccctaatgtacatctccttactggttccaatctcctcctgcagggacaccatacagtacaaataaacccttccactaagctagttggaggccttgattataaaatgtcagagtggggcttgtgccttgccctgatctttagggtcatctgaagagcttgcgctgtggcttgaccttatgggaataaagcagcaaatgctttaggcttcttgttgaaaacctgcaggagaagatgattggcagtacaattgttgtgacattgttcatttatgaagcatcagaagtgggtgtgtaggcatggcagagacactcaccaaaaattatttggttttgctggaataaagtgcatcttggattgcttataggaggattgtattcagggttcgtttgacaatctaacttccacactctgatttgcccaaaaagctgtggcagcactgtgtttggagttatggattatcagttttgtcagccaagatagcttctgttttcctcttcaactcaagggtcagcattctttgctcaaaaatatttaaatccattttaaagtgagcagaatgagggagcagaaggaaggcaaattgagacagagacaggaagggagtgggtagattatacgtagagttaatagttgctatgtgaaattcaagcttctaggtttatttgttcaataaatataaattaaacactcacttgtttgccagatgcatgcaagaggtaaaagattattaccttttgattctcttaactgacagaaacagtaaccttgaaagtccactcaggcattacccctatcctcttctttcaagacttccatgactaattgagcagtaggaaattgttcctgttccatttcaacttaattgtgaaaatttgttctcttcttgctgtaagatatgcttttatctatttgcacctgctcaatatacatgcattatttctgtgtaatgtgggtacctgttcggccaagttagataactaagaaagaggtaattgagggggccttgctctggagctgtacctacttagatttaaatctgatatatgcaataggtgactacctatgaaaccctgagcacattgctgaatcatcagtacttcttctctacagtgaagttatctactgggcaagagtcactgtaagaactagagaaaacatgtagaaagaataacctggggtgggggaagggggaagggaaagcattaggagatatacctaatgtaaatgacgagctagtgggtgcagcacaccaacatggcacatgtatacatatgtaacaaacctgcacgttgtgcacatgtaccctagaacttcaagtgtaataaaaaaaaattagccaggcgtggtggtgggcgcttgtagtaccagctactcgggaggctgaggcaggagaatggcgggaactcgagaggtggagcttgcagtgagctaagattgcgccactgcactccagcctgggcaacagagtgagactctgtctcaaaataaataaataataaataaataaataaataaataataaaaacttaaaaaaaaagaacatccacataggccttgctatatgacataatgctcaatagatggcagttgttttgttgttgtcatattctttagatcaacatttccttagttaccgtaaacaaaatcagaatgtgagagtagtcccaaagaggggtctttagttctgcttttctggtcagagagaacattttgtgtatttaagtttaaagggtaccaccagacagtaggttttattatttctcttatttcacttttccacttttccataactagcagtcatctgtagttttctttagtgcttaaggtgttatgaaatattcatatcattttatgaaaggctatttacacagaggaaccagatgtaaccgagtgtacatacaaatactggccttatttttcacgcttggtaagtagcgcataacttgaaagctaagagaagatactttttgttttggcaccaataattccagaagaagggcatcctattaaaaaaatctattgatctaagagggactagaaatttggctgaatattttagaaattgtttgtttgccctgagcttcaaaaactcatggcttagagtttcctgggaagggtagaatcactgaatagatagggtccagctagctaagtttcctggtcagcccctgaagaaagtttcattgcataaaaagcgtagatttgtcttcaaagttttccccaacactttatctctgaggttttctctattcatcttgagaataaagccctgttggtgaacataaatacactcccagagttgcttatcaggcaagacagaattgagcagttgggcctgaactctcccaccgtttaaaccaacgttctcaaggagttgttagagcaatttatgcttcccacatctgttcctagatgttatgacttgtttatggaagcaatgtaaataccaattctaacaacagctacaactaatactcaatgtttactccatgccagatcctgtgctgagcacttgacatgtaagacttccttcagtgcttgcaacaaccgtacaataggtgctacacgaaacagaagattctatggtcaaaaaaagctctagagcagtgggtagaaaaagttgaaggtgtttctctactataggatttaccaaggacttggagtgtgcagcttttccaagtgtattggagcatggaggcattttttctcctgtcttagtccatttgtatggctataaaggaataactgaggctgggtaatttataaagaaaaagaagtttatttggctcagggttctggagggcgttcaggaagcatggtgccaacatctgcttctggtgaggacatcaggcagcttccagtcatggcagaaggtgaatgggagttggcacgtgcacatcacacagccagagaggagaaaggagtggggggaggtgccaggctcttttttaacaatcagttcttgtgggaactaatagagtgagaactcactgattacctcaaggatggcaccaagccatttacgaggaatctgccctcatgatctaaacacctcccaccaggccccacctttgacactggagatcaaatttcaacatgagatttggtggggacaaatatccaaactatatcattccccaagggccatctggagagatggaacaccatttgggacatgctatcctatgagtttcttatggaacccatgcttattaactttggaaattggatcaaatttcaaaaatttctgtctttgccctggccttatcttgtccttaaataacccatactacctaatcttaaaacaacttataagtttatatatgtgtcctggagaactggatctatgttgcttatctaccaagtccaagccaccatcatccctcagctagactattacagtcacctcatactcattttcctgcttccattcttatcttcttgtaaactcctatctatgctgcagccaggttcgttctaaataacaaagaaacaacaaaaaaccaaaactgtgccacactactattttgcggcaaacctttgaagacttaccatcacattcaggatttgaacactgtaccatcacctacacaactatgcatgacctgaaccatgcccatctctccccgccaggctcctgctgctgtagccaaactgtcagttcttctagtgtttcagactaattcctgctcgaggcatattctaattccctctgtctgaaatattctgtcacccgtctttctattcctactcgtcctttgtttctttgcttaaatgctgttttctcagagaggttgtcactaaccacccccaaaattaggtgtacccagtttttgtgttcaataaagttaaagggattttttttacagtaggacttatcagggcctttgatatgttaacatgtattatgaatttcaagagggacatggagtatcctgcttttttttccttcagatcacttatcacaatgtttatttgtttaatggctatctccccactagactctgggttctatgagggcagaaatcatgcctctctactgatcctacacccccaacgcttaatgcagtacctggcacatggtaggggataagtgtatgtttgttgaatgaatgaggaaatgaatgtgattcttcctgctgctggactgcctttttacagtggggctgccatggaatgatttaatatttttcatataacctcttcctactaagattttcacctctcttgtttaacccaagtcacttttggaggaaaaactagaattatattcagcactgattggtaacagttgaggattaatgagagcaatacctggctcttatatttttaaatattaatcttttaaaattattgaatattttattaactattttaacttttttaatatttaaaatgatttccaattaatggaattctttaaaacagctttttaaattttaaaagttctagttcagagcaaaataacaaagtaagataatgcattacaactgttgtttcccaattagccatatctatgggaagcaatccttaggccatgaagtctaagcccaatgtgcgcctagtaccatctgaccttcaaagttggtccagagaccctgagagaaggaaatgcctttatgagtgctgagtctgcaaatccaaaaaccaacgtataagtacacgctaaatatgtgttggtagatttttatgtaagaccttggtggtgttatatatattctttcatctgatctttcttgttacttatgtaacacattttcattgctaccaagcaggattacaagttcaattgtgacctatggaacaaaatgactgactagaccttgtgatattttaaaccatgacgtggggtgcattaactgggtcctgcaaccaaatgaggcacatgcttacctaattttcagggtcctctgggccactttgagagggctagtgcaggtagagccagcaggataacagaacagtgtacagcccagaaggtcactttctggtagttggaaagggcaagctgtccagtgttagttctttgacaagagctgcccctaggtcagtgtacacacacataaaatgtgtgtgaaaagatgtagacaaaaggaattctctgggaggttattagtgtcagttacttgtcagttacatccaagggccacagcactgctggtatagcttccgttgagtttctgtgccatattttggttttacgggcaagcagccttcaccaggatatgctaaagagtcatcaatggattagtatcactaacaaaaggaagattcaacttaatgagagaaagtgtgcctcattaatggttgggaaattaagcagtcagtttctaatcaatgctaagtgatagaacttcagtggaggctaaagctcattagtagaatacacatagatggtaatgacctcaaaggtatttaaaatataggtgaaaagaactacattaataaggcaaatctattccacctgtccatgacttggctcactgttcccctgtgttatctgtatgtcatttggtacatttatttatgagaataaatttgcatttgtgtggcgcaattggttggtatgcttggctccaactctggagaataaatttgcctgataaaatatatggttttcaaatttctacatagataatggattatgagcaacacaataatttgctttcatgaaaaaagtctataggaagaattgacttataataagggctttgtttattcagtaactcatttattcaagaataattgccttgagggaaaaatggatagcaaacctaatgcaataaatgtttatttggaattgtatttaactatttcttccttttcttccttgtgaaatgctttctcaaatgtgatctgttaataaattatgccaatatcgccaagggccttgctgaagatgttcatattgaaatgttccaaaaatatgccttagtttccctggcagaaagccaatggtgacatcagagatggcatgactatacttcaaacaggacaatgcatatgacagccaacttactagctctattcttatcccacgcttgccaagctactgcaaaagcctcaagtggtaatgcataggtaatttgtaagtcttgtatctcctttctttcacctggccaatctgtcctccttaagaggcaacttgaagactacaacgaggagttttaataaaatcgtactctcctatcttctcttcctcttgcctatcctttaaaatttccttttcttgttcattcttctcagaaatcctcagttggttctggcatctttagtgaaaacagccagatgaggtgtttatcaattcctagggctccttttgttttcatttagataagaaactccccaagggtaagacctttatttcttgtttggcgaagtgcaacatttgttcacagctctctatccccgataaatggaattaggaaatatgtcttgaagtagagccaagcactgatacaaaggcatccagcctgctttccataccctttgcttaggagagtggtgctgtgacaataaatggcccctggtcatttgtaattggttaatgtccaggggtagagcaatttaaaagtctagagagcaaagtgtaagaatgattttggctcttttgaatatttccccaaccaagatcatcggtagattgtaagatctgcaatcagtagaggttccagatatttgcaggcttttaattaataaggctaaagaatggaatcaaccattttaggagctctgcaatggttaccatgtgtatcacattgcttaaagcagatgctgcctcttgtcacgtcagggcctagcttctccctgaagccttcttcccctcatcctgtctctgttagtttttcttctctgtcatcctctaccactttcatacttaccaggctctgggatttctttaaaggtctaccatgttggatgctcactgtcacctcagttgtgaaaacagactcatttatacctcaggacatatggctgttttggttaaactccaagggccttggtctatttatttgttggaatctttctagtttgttattaaatgacagacaagacaaatgaataccacctctgggtaaatttacaaattttaatgacatttctctccattaagttttgaccttaataagacagcagggaccttcatataataaagtagttcatgcattttgtttagctttatagacagaggaacaccagaagcattttctcttgaaaccaaaatgagctgtaagcaactgtactgagtctctagaaaggaattagttttgccagcgagagttgaaacaaggacgctactgctatgttctgagaccctgaattctgttccaaaatagataagactggatcttggcatctgactttttgttttttcagtggtagtctgttttgagtcacctatatctgtatggtaacgatagagtgaggagccataagtattcatccagacagaacaaggacctgaacagtcaggtcttctcaagcaccagatggctctattttacagaaaaggaaaacaatgcctagttaggtaaaacagccagaccagagtcactctgcaagttagaagtggaatcttgctctcttgcttgtgtgttactggttagcacatcactatcctgaagaacaattaataatatctcatttcttgccttaggagaagtcttttaaattactggtgcctcagtttcccttttatatagatgggacaaatgacatcatagtttattcactaatccattcagcaaaaatagtctaggtactacaaagacagccatatatcaaatgtagtccatatctggatatatgcactttttctatcaaaaagctacacacaaaaattacaatacaccttattttgcactgctatagagtttaggacaatgtactgtaagaggattatatatatatatatttattattattaaagttttagggtacatgtgcacaacatgcaggtttgtcacatatgtatacatgtgccatgttggtgtgctgcacccattaactcgtcatttagcattaggtatatctcctaatgctatccctcccccttccccccaccccacgacaggccctggtgtgtgatgttccccttcctgtgtccatgtgttctcagtgttcaattcccacctatgagtgagaatatgcgggtttctgtccttgcaatagtttgctgagaatgatggtttccagcttcctccatgtccctacaaaggacatgaactcatcattttttatggctgcacagtattccatggtgtatatgtgccacattttcttaatccaatctatcatcgttggacacttggcttggttccaagtctttgctattgtgaatagtgccgctataaacatacgtgtgcatgtgtctttatagcagcatgatttataatcctttgggtatatacccagtaatgggatggctgggtcaaatggtatttctagttctagatctctgaggaattgccacaccaacttccacaatggttgaactagtttacagtcccaccaacagtgtaaaagtgttcctatttctccacatcctctccagcacctgttgttttctgactttttaatgatcgccattctaactggtgtgattatatttttaacagtagaagcagactttgctggactctttcgagcccatgaaagaaaaatgtagggtgtacatgcacaggtataccctaaaactttttgaaaattgtgtataaacatacagtgttttcatctctttttcgtcatcatcccctgtcaagcatgcatcatgttcataccattgtacatgtgttaggaaaaaactggaccattcaaagattggcaagattggctggacccttcatcccattcttctatctttacctttcttcattctgtcactcctccttagaaccctctaccctgtctatccatatcagctttgtttttcaaggatccacttgagggaccaataggtttgtatttaggttatctgtagaggatcttaaatgcacataggacattacattttaaagttagctaactcttattttaaaggcacttgtcaagcactggccagtactcaggggtttgctgcatgatgggtcaccttcattgaggagcatttgcagaaacggactgccacacggtgataacttggctggactaaagcacacagatgtttgagctgttctttaatcatagatttaaatttcctattttcagagaattcactttggttataagaagaaccttgtagcaggaatggaccccagtcatccttttattggggaaaattttatgttttgaaaatgttaactaagccataaaacattcagccatccagtttttaggactgaaatatgggaatcatttctggatttagctctgcctttgtaattcagctcccccaatattagagcagcctccatatgtcccaattaagtggccaaagcttggcttctgtggattgattccataatgcagaccgtaatagctcataatgactctgaaagaactgtctagccaatcttgccaaaactaaaattgcctttcatttttaatatccccaactgttctcaccctgttggggatagcaaatatatttgcatttggggggaacctcatatgcagctctgtggaaaacatggcacttctcgctgtgattttatgagctatatgtagccaagccatgcatatcgtgaacatatctgcacacagacttgccaggacctgtgattcttgcaagccttttcattgttcctcagaatttgtcagtaggaagttggtgaaatacatctgcccaccctcctccttatttgggagcagaattcataccaggcatttggtttcttcagactgtaattaacaactatggacttagaactatatcccccaccctagctggtagtataaacaggacacgtggacaatagcctgaccattcactagtcctgttatctagtgctgctaagactggttaaatgttctgacctgaaatataagtattttgccattctctattgttctgtaccatttattctagttgatgtcacttctgttcgtaacctatagaactctttgtagatgggagagagattttgactatctagaaatgagaggggtaattaatgcagtaaagacctttagaaggtgaaggggaatggggtccagagcccaggagggcgggctaaaaaaatagagacagttctttgattctaaaagtagggaaggaaaaaaagttgaggatacacgcaagataggtttgggtgacagtcaaggtgacttccattttgtaaactaagttagaggtaaggttgatcaactgagggggaaagggggagtgtaagagtaaaacttgagaaagtggctagaatttggatagatcctgcttttccccaaactaattgtctctatcagcaaggactgggccagctaccctgaaatgattctgccacgcagtgaccatattaaaaatcttgaaagcttcatcagtaaactgctttaatgagtagggctctgcagcactgatcccacaatatgagttggtcccattacaaactgataatgtccagcctcagctgggctctcactgtcactcaacaatccattgatgtgtcttggtctgctacttctgccattacacactaccttcactcccaataaatacattaggtggtaatacttgggctagaaaattttcagtgagatgattcctttgccatggcagggacctagcttgtgtgactatcacctaatctttagtgctaattgtgaaaaggcatgagtctttctggacttctgagggaagaaagtcttctattcttttcagttaaatcaactaggatgcaaagcagaatataatttctctctaaagtccagattcctttgccttttgtggggcagcaggagagagagagaaagagagagagagagagagagagcgagcacgagagcacatgacattcctatgagtgacattagtagaagagctagaatcttctaccataacaggaatatgtttatgtatggctaatggtttatatgaaatgaatgtgcatatgactaagggaagactttgagatgaaaaagtgagaaactttgggatgagtgaacttgtgatgaatctaatgggtggcctagcatcagaaccataacatgagtagtagccaggtgggccaggtagatatagcaggtcagatgaaatccacttttcagaatacgggactaatattgagctgaggtatttgaagaacaggcatccagatataatataatattagggattactgtgtttcaggcactgttctcagtaccttatctgtacagtattaactcatttaatcctcacaacagccctgtgaagtaggtactgcggttttcgttttgtttcgttttgagatggcgtctcactctgtcacccaagctggagtacaatggcctgatctcagattactgcaaccactgtctcccgggttcaaatgattctcctgcttcagcctcctgagtagctgggattacaggcgcccgccaccacacccggctaatttttgtatttttagtagagacggggtttcaccatgttggccagcatggtctcgaactcctgacctcaagtgatccgcccttctcagcctcccaaagtgctgggattacaggcatgagccactgcgcccagcaaagtaggtactgcttttatccactgaggagtggggagtgtaagtaaattgcccagagttacagggctaattaacagtagaactacatttcaagcccatgcatttaattgggaagactgtgaagaagctatcacctgtttttaaaagagaggggtaaagcaaattacacaaggttaaacagctaatggaactaacttgttcaggaacccaggtgttctgtgtgtaaggtattgttttgttactgcacccttagtactcaaagtatcagcagcattggcatcacttaggagcttattagaaatgcaggctctcagtacacttctcacacctgctgaatgcaagtgtgcatacagttatttgtgtgcatattaaagtttgaaaaacactgagctattacttcattggcactagtttgcgggacagatatttacaaatactgttagccaaaggcagaaactacatcccaattatccatctaagacagggaaagtatgaaatttggcagggtttgggggtggagttcacatagtaggaaacacagggatttgaatagttgaccagccagtattggagaggttagagttcagaggtaaataaaatgggattctacaggaaatgaagttctatgcagtaacttcatcacataagagttcctgactaagtgaggtatgtaggcaagcagtaccagaagctagccctcctagagctcctgttatttatttgtcaaagggcagagctggttttgaagtgaatctgacttttgcagtggttgcagcagggagggtcaaaggatagatttggcacaccgtctagttgatttttcagcttccctgtcctgggggaatcacagatttctctgctttaagtaaacttgatatgtgaatatctggatttataaaacagtaaaaattataggtgtggcaatctcagtttatagactttgtaactaaattattcattttattagagagcacatgatatgttgctttttaataatgagctcccctaacacatttaagacagaattcaattttcagccctgttaaaaattcaacctagtaaaaacatatacaatataagtaagctgcccttgcatgagccgggataatttgcctaagcaactgtgtaaaatggtctgaatgtttcctgaattcaggacaaataggattttggtatatgtcaccctttgaaagacaaaagaggtgctttctggagaacacactgctcttgactttaagcctccttcagttctgtttcacagtttttattcttcatggtctgttgaactgaacttgtgacttcaagtggttcactgaactgagatttattgcagtttgaggaaggaaacagtaaaataagaaggcagttttgctatttttgtacaagacctcctaagcaacatttcacaaaacacatggtttcaattacctctgtggcatccacccacccacccactcatccattcagccaatattgtccagtgtcactatgttagggctgggaatgcagcagtggacaagatacatacagtttctgctctttggagcttatagtctagggtgagatgcagccaggttaaccaggcagtttccagtagagtgtgattaacagctaggatgattgaactctgggctgtcatgagaacataaaaaagatgtctatgacccaaaccagctgcaatgaatagacagaaattatattagctatctgtggctgcataagaaattacccccaaaattagtgttttaaacaatatgtatttgttattccacagatttccatgagtcagacacctggtcatggtttaacttagtcgtctgcttcagtgtttctcattggttgcaatctagggattgaccagggctatagtcatctcaaagtttaactggggaatgatcaattctaagctcacttgcatgatggttggcaggattcagtttcttgtgggttgttggactgtgggcaccagttccttgacggctgttggctagaggctagcctcaattatttgccatggggccctttccatagggcagctgacaacatggcagctgggttcatcgaagtgggaaagtgagggagaaagaaaattccagcaagacagaaatcagtattttgtaaatgaatctaagaagtgacatctcatcagtttcgtcatatactgctccttagaaacaagtcactaggtccaactgtactcaaaggcaacagcccaacacccaaagaaaagagaaaaggtttatataaggatgtgactgtcaggaggcaggaaacattgagagccattttagaagctggctaccacagaaatgtcctcctgtacagagatgtaagttgtagctccttaatggctctgttgaactattcttagtctcattcttactcaaactcaaagtttgtcaccaggctaccctgcctccggttcatagtatattgtcatagtgttacctcgattggcatgaaaaatagttatcaactcccttatttcttcgatcatttcaatcataatggttgggagggtcaggaaaatgccttcggaaagcaaggatattggaacaagtacaaatttaatgccggctttcatgatatctgtctaagatttctggtaggccttttctctgagacacctgtttttaattagattattttgatttctatggcttattcaaggtgcctttagtaatggataatgtagaacaagtatatttgtccattgggatctggaaaaagcttgaaaaccagctctcaggaagagaggtatattagttagggtgagggctatacttctataagagactacaaaatagaatgacttaagtgagatgacaatctctctcttattctcactctgtagtccctctccctcctcatccccttccctgccttgctctcttctctctctcattacattatagctggtataggctggtagggaagttgtgctccatgcagtagttcaaagctccagataccttccattgttgttctgccatcatctagaccagcggtccccaaccttttttaccagggactggttttgtggaagacaatttttctgtggacttggtggggggatggtgtaggcatgattcaagtgcattacatttatcatgtactttatttctattattatttcattataatatgtaatgaaataattgaacaactcaccataatgtagaatcagtgggagccctgagcttgttttcctgcaactacatggtcccatctgggggtgatggagatagtaacacatcatcaggtattagattctcctaaggagcccacaacctagatccctcacatgcatgcacagttcacaatagggctcgcactcctatgagaatctaatcccgcccctgatctgacaggaggcggagttcaggcagtaataccagcaatgggaagcagctgtaaatgcagatgaagcttcgctcgcttgcccgccactcacctcctactgtgtggcttaggtcctaacaggccactgactggtactggttcacggcctggggcttgaggacccctgatttagaccacagattgatagattatggctggcagatcaaatctggcctgctgcctgcttttgtaaataaagtcgaattggaacacaaccagccccattcatttatatattatctatgtctactttagcactacaacaccagaactgagtagcttttgacagagaccttaccatctggccctttatagaacaagtttgccagcccctactctaggacatggtccttgtgtgcatgttttcattccagattgtgggaagagggatgggcaagagttcagagtaaataactatattttaagaaattgttgaggaagttgtatatatgacttttgctcagaagccattgatgagaactagtcatgtggccacatctggctgtaagggtgaaaggaaaacgcagtccctgattgggtggctttatattcagacagtactcatgacaagaggataatgtatactgatataccaatattattgacatttttcaattaaacaatctaatgtacagataagcaaatttactttcttaacgacacaggggtagtaagaagtactttctgacatcagcagaaaatataatagagttgagctgctagaaaaacaaaaacagttaaagaattgggctacatagagattgaagctagaatactattcagaatccagggcagcttcagagacctgaatatcgggataggtgattttcagaggacctactttctttctctcctcctgaaaactggctttctaattttgtacttggtatagcttttctctgtatccccttttcttcttactcttgtattttctccttatttttctcttgaccataatttcctcatgactctagttttacggcatggcatttcttgattgatcttttcagtctcacttctcaaggtcctctttgttcattgccttgttttcacattattaccctgttcacatttctaaaaggcagagtgaattctgtccagattgttgtcttcagagtttctggccacttttgcaatggcttcctgagggttaagaattacgcttgtttgtggcattggtgactacagagggtggggtcatttggtataaaagattataaaagatggctttcaagggctttcccttgaacaagggaatggatatgggcagttgacaggtttactataataccatagtcataagagctacagcctctcttaaacacttaatactgcccagggccgttatgtgtatctttttatttgtcataactaaagcttgtcagtctgctcttatttgtgaataagccaaatatcaccaattcttggcattatgtatttgtaaaaaacaattctttgaagtttgaggattcccctagtgtagatagctgctggcagttacaatttgttaatgaacatgaacctcttggtaggtttagctgtaatagagggactgagtaaaaactcaaacttcttagatgtttgagaaagttggatttataacttcacattttattgtgttcatcttatcacttcccacagcagcaattttcacctcaaaattctcttgcattgtaggaatgaaggcttagtgtgtggaaggcactgtgttgaatgctctacaatacatttatttaattttcacacaaatgttgcaaagtaggtaccaatattatccccattttacagttgaggaaactgaggtacagaaaggtcgagtgactttcctcaaagtcacagagctagtaagtggcaaagccagaattcaagctcgggtggtttgaattcagaggcaagtacttcacccccatagttcataaagcacttgagtatcccgtaccccaaattttctagtgacacagattgtaatctgttttggatcccttttctcctcataaactactttcaggaatgctctaagagctctgtgtttaccagctactgatgtctctagaaaaaccatcagagtccatcaagtaaactatgcatgttaaaaaatatttagtgatatgtattcatgatggatgctaaatcttccaacggagccatgaaggtccattggctaaatgaatgtgcttctagatttgtctaagtacttactgtctagcataaatagttcacattatcttggtaaatgcagagggttgattttcttagtacaggttatttatacagccacaaatagtcccagttggtaatgacttttgggtgagtaatatgggttttaagtcttttacaaatatatgaaattttatggtaagtatgcagtgttacattaatatacaactaatgtcagaatggcctttgctgggatagtaatgctgataaaaattttttttgaaaacattcaggctgcaaatataacagttggtctgcaaaatttgaatgtactccttatccctatttactctcatcttattctgtctataaattatgctctacccttcctttaacacctggtacaaaatgcacgtccaggaatccagtcccaattaacttcacctaatgcatcactccctccctatgtgctcttagcacctctagatacagttcatagagacatttgcttttgttttcatgttttttgtaagtggtcttaagtcacttcatgtatgtttgttttgtcacattatataaattgaattgtcttcatgatgtcaggaagagccgttgcaaacagaaggtgaacagtaaataatgttgactgactgcccttaaagaatagaaacatctgtttgcttcaggtcaagactcttagaatactcattgaatatggatttccttaatcacaaggacatgccaggaagaaggaaaggaaagcacttatagtttttacaacaaaaaacataaaaaaagaataaaacaaaatccctctctgtttgattttcttcatgcccactctgattgcttcagactgactgattaaggctgtccaacagtattttgtaaataagggataaagtcctcctacacattaatttcttgaaaagaatatatggagatttgggtgtttcattcctccttaaagttgccataatgctttgtagaatgtgctagtgcaccatcttgcttctgtggtcaggtgaagaagtgaacagggaggtggtggtggtgtatgtgtgtgtgtgtatagagtcttctgtcataatattgacccccttctgctgagatttgtgtgatccctgatttatcatcagaaattgatcacaagagtttatctgtataggagaaaaagcaaagccttggaattgaagcaaggaaattaagagctcagttttgcttgaactcataaattataaattatgaagggaagttgacaggcctgaatttggtatgatggagaagtattttagaaaagatcaatgaaattcataggtatttaatagagaagcatatggacaagcatggctccaaatccagaagctttggagggaaatgtcctggtgatcatagttctcctataccatccctggtcccgagctgtgtccaaagaattggctcaattattttctagctctaaggatgctggtctagcctaggaatgacctaaggagtcaactctgctggcttatttttgctctcttaagactagtttaagttaggatatccagtgccgtccttcaaacatgaaggcagaccaattaatctgccatccataggacacgggtttgtgtagttgatcaactataaaggactgggcattcttgatcttctactctttctcactaggtctcctttatgaccagtacaaccttatgcttggtcctgtgctcacagctctttgtgtgtttccactatcacagaatgtgttccattttacttggtaaaataattttttatgcaactagtaaatatagttagctatttatatgactgtttccttcatcagactgtcagctaaggacagggtcatgtcttattctcctctgtatcaccagcacctagtaaaaagcctgttcataaatgttctataaatggatgagcccaagctgtggcctaggtgaagttagttgcagtaatgaaaatagtaacagataactgatatttagcacttactaataccaggccttgcactgagcactgaaatgaactatatcacttaatcctcacaaactactctgtgtggagttatcatctacattcataagtgaaaacacagaggccgagagatgttaagtcatttgcccaaagacacacagctattaagtattagagtgaaaattcaaaccaagggatgtcagattccaaaccttcaacattacactgcctgctaggatgtcaatctcatgagaagaaaataagcttggcccatttggtggagagctcagagtgacttcaggtttctgaacccaatctagtttcatattagaacagactttaatccaaattatcccagaaatctggggacttactagtgaaatcagatttttttccagaagaggtagactactcctaatttggggataaggatgctagtgctagaagagacttatgtggcatggtggcatttggtttaaatagtttctttataattctccctcatcagactgcgtgttttctctgttatattttcctaatgtcagggattggacctctaagaataggtgaaaagtgtccctggcagaaggaatataacttatgatggtcttgaagtgaaaaggagcttggcataatcaagcagcacaaaagtggccagtgtggctggaacacagggactgagtggcagaaacgctagatgagcctgggggcaggagggttgtggtagtggtgaactaattcagagcctccacagtacttggggtgagtttagtgggacagtgttacgaatgaataaataataataggtggagattctcccttactctcagtgaagtaaatcccttgaatatattggacatggcctctttgttgaattatctgctataatggactgtgttctaaggaaatccagagtgcagtcaggccctgaattatactcagaatatcttcttaaagaacgtagtctctatgaaaaattcaggagtagagactttgggccaagattatacagttatatctacagagagatataaatatacagataatttaatgaaatgaaattatttaaactcaatatactctaatagatttattaggtatgttgaaacctttagtcgctaattacaacttaatgaaataacaacttaattcccgttcctactcccttctttttcaatctacagttcacatagcaaattattcatctaatggttaatcatctgactcctctattagactctgatgagatagcctgaggtttgaagaaaatgattcttgaaagacacaaggatttatgaaacccagggggctccaggcatctgagcttccttacttttctattgggaagatgggaaggtggggaggtcccacattttgtacttttctccacagaagcattggagggggaggagaaggtatgctgggaggtgacctggcaataaagggaatagaactaacaattactgaatgcataccatgagtcagccatcttacattcattatgccatttaactggcacaacaaccatttgatacaggtaccatttgttatcattttacacatgaggagatggagactcagaaaggctaagtgacttgcccaagctcatacagctagttaggttgtggagcatggaatctaataacgtgcaactgtgggtgcctgcaaagtttgctcttccaacttactctgtgcctgcttctcatttttcctaatacctgaattctccttgcctctcagattttcatcaggaggtggcttctcaatctggaaatcagggcccatgagggaggaaagctgtagtaaatatgctttggtgagcaactagcttttctatttccaggatatgaacatctcatcagctgaataaacttaaggttatttctgcccacccacccacctacactgtcactattgctacctgacacttcatgataacatcacccttcaggattctccaactgcacgaaatggaaccccagagataatttgaggctgagctcagaatttatgtaccatgtatcaaaaatgaaacgttttagtcaggtttcctgagacccgatagccccagctaaactggaggcgagagggaaatctttttgagtatggttggttagggaaagttcaagcctctgtagaacatgatggtgaaggacctttgacagcctaaggccagaataaaggcaatgggtgcttggagtcactaggattaatagttctttaaaggcggggaccaagttttgtttttcgtttctagcacctagtacagtgacttgcattaagtaggtgctcaacagatgtttattaaacattcaagtgtaaaattctataaaatattaatacttgaagataagtacctatttgttaataggcatcttttaaagtaattcaagctataagaacaaagtcaagaaagtatagtggtcctttgggggaatagctatgattaagagatagggaccctgacaatgatgttgcagagccctagatttttgccccaactctgccattaactggctgtgtgcccatggacaagtcacttgactactctatgccccatttgtcttatctgtaaaaatagagggtaaaatgttcctacaagtgttttattcatatgttcattattttatgcacataataaaaatacccaatattcatttagctcctcgcagattacagactcatgtatatcacctcgttgaagccttccacaatgtggtgaggtaaatattatctcagttttacagataaagaaactaaggttccggttatagaagtaattgtagaagactactgctaagtaagtcttttgcctcaaatccagtcctctttccaggtaccacagctcttttcacatagtaattagctgtatgtaaataatgcttcccaagtgcttgaaaaatcatttgttcccttaagtcttcaaacatctctcctccaattgtgtttgattgttaatttactcagcaaattcatttccaaatttcaagccagctgaagttgacttactaggaatttcacattctctaggtcataattaacaaggcttgcctttatttttctgcaataagccttggttttttggtgaaggaaatgcacatgccctgctggaagcttaggcagattatgaggggccgtactttttagcttagctagaaatggaatctatgtgggaattgaactacctctatttcagctaacagcagaaagtacacctgcctttgcttgtatgcagattcatatatattggtgcagatatgacattattaacaaacctgtacatgtacccttttagaatattttgtcttccattaatggaaaattaatatatccaatgacaaaatatcaaatctactactggatattttaacatatattatgacaaatcagattcccttaccactttgtactgttgggaatgagtcctcaaatgtaccctctttccctagggcatgacacactggctacattttcataatttaacaaagtataaagggactttggcagatatcaccgaatctgtcagatttaactgcttgtaaattcaattagtcgggggaaaaacagctctggagaatatatcaaaattcaattagtcagcaaatcgaggtttttagcctactcttttgggtaatctatcaaaagggaaagggtacttcacacttatgatcaactaattaaatgcattaggccctgatgggatagtttttaatattcaccaccctttcaagtctatttggccagaaaacctagtatgaaagagttccaacagtaggcgttatctaaacaagtgtatagaatgtctaattaaggtacaggctgaaggtgtttccttgccttcttcttttaattgattgaaagagcctggctctaaattttcaataccttttaataaccaatttaagtgttactgggatgataattttattgtacaccaaatactgctttcttttgaaaatcttatcactaatgaaggtgtttatagctattaactgattatagtagtgctccttcaaaaaatgggtttctagtgagctaatgatatatcttaagtgttttgaatgatgtttagaggaattacaatgtggagtgactaaaccagaggctgcaaacattgtatgggggtgttctttcaaagtaaatatgtcatttctgtgactcataacttaactttgagtagatttatcataggcttgctgtaattgaattgtttcaaggctgtattttcttttgtttgaaattcatcccacagtagtgcaaatgttaacaatattgttttgcttctttataatcacttgtcaccctccccactatttgggcaaacatttactgggaagctttactccctcatccctgaaaggagaggagtgtggcaggtcttgtcattctaagacagcagttaagaataacaacccatgaggaatggtctggattaatgtttttgccacttgcagctctgcaaatatccctgcttgctctctgactttggtgaagttacagcttctttcaattttggcttcctcatccatgaactcccaatctcatccagtttaacatttccattcctttttatctgttggcattcatatcatcacacagttgttcttacctttctttagtcttttgctttctatctgactgtctttgggtaaccttggtcttgtagtccttttcaccttgaaactggctcaccttatttttatctcctcatgccttctatttattaatgcaggacagcagagccacctgctttctaatatttgcgctaggcccttttttgatgacattgctttccagcctttctctctgtaatggggagacctttttatctgtcaagtgtcactaccctacaggggaataaatgaattgaaggcaacacagaaatataaattaaactaatttatacttatctgatttttaattagagcaggacacatcaaagtttgatctgtgggtggcaaatacatttatttactagatattgcatcaatttgttccctgcataacacatccagttgaactgtggtgtgactgagaggtggaatgatataggaagcaaggaaaatattatagaacacaggaattaagggattgttatcatctgagcagggaattggggaacattgaccttaaagttgttataatcagcctcaattatcaactctatctagggcagatctttcaaatccaagttagtttctctctggcttctagaacactcctgggctgcttttctgattggtaggtgcttggggaatacaaactaattttaatactagcctgccaaatttaattgagaaggaatatctgctactgaaaattaaaaatttgtaagatagatgattggttttggataatctgccctttcagattaaatgtatgcaatgaatttaacatgttataaggaagatctatatagcgcagtgcttaagaatgtatctctggattcaaataagttgaatttaaaccacaggtacactttggctctttgaccataggtaagctacctgtcactctaaacactgctgtagcagctcagacagtggtttttttttttccatagtgggctgttgagcctgtcccattcagagaagacactctgaaattttaagaataaaaagcctggataatggcaaacccactaactgatgtttcacagatgactgtaccaagaggtgctgaggcttcaaaagtaatttctataagtaaaaagcagagaatggggaaaagtagcctaacacctttgaaccagctcaacttctctcttttttcacacctcgcttgaatggtcatactgacgagtactttctatatgttacctctctcctgtccctttttctgtcacttgcactttgtcttctccgccattctcttcttacccatccctcttctgtgtgtattgcctttcccctactccccatattcctatctctgtgtctcctctatcattcatgactcttctctttttggcatgtgtaatattgaattcgagtttagttaaaatatttgttaacatcatcaaaacaaaacacttttatgtataaccgtgatcaagaaagtgaaaagataatgtacagaatgggaaaaatatttataaattatattgctaatcagatattagtatccagaatatataaagaactcttacaactcaacaatgaaaagataagggacacagctttaaaaaacagcaatggtcattgtttcaaagaagatacgtaaattgcaaacaatcctgtaaaaagatgctcaacatcattaatcatggaaatggaaattaaaaaaagcagtgaggtaccatttcacatctatttgtatagctataataataaaaaaaagaaacaaacagcaaagttgtggggaaattagaacactcctgcattgctggtggggatgttaattggttcagttactgtggaaagcagtttggcagtttctcaaaaggttaaacagagaattgccatatgacccagcaaatctgctcttagatatatatgtgaaagaactgaaaacagagactccaacaaatacatgtacagccatgtttgtagcagcactacttaaaattgccaaaaggtgcaaatgggccaaaagtttatcagtggataaatgggtaaacaaattatggtacatacatacaatggaatattatttagccgtaaaaggtaacgtacaatgtggacaaaccctgaaaacatgttatattaaagaagtcagatgcagatgtagaaggctacatattgtgtaatccacttatatgaaaatccagaataagcaaatccatagagacagaaagcagattagtagtttcaagggctaaggtgaggcagagatgataaagaaaatgcttaatggctatggggttttgcttagggattagtgaaaatgttgtgggactagactgagatgttctgggactagccttgtgaacgtactgaatgccactgaattgttcactttaaaatgtttgttatatgaatttcacttcaatacattttatgtacagatgtacatatactcatttgctgcgtaacatgggtcaatgatgaattacatataggatgatggtctcataaaattataatggatctgaaaaactcctatcatctagaaaagtcatagccataatagcacaatgcattcctcacctgcttgtgataatgctggtgtaaacaaacctactgcatcgccagtcatataaaagtatagcacatacaattatgtacagtacttaatgcttgatagtgattataaatgtctatgttactggtttatgtatttactatactctttatcattgttttagagtgtgctccttctacctataaaaaaaagtcaactgtaaaacagcctcaggtgggtccttcaggagatatgccagaaggcattgttatcataggagacaacagctctctgcgtgttattgtccactgtacctttcctatgttcaggtctgtttagatacacaaatactgacctttgtgttacaattgcctacaatattcagtacagtaacatgctgtatacatgtgtagcctaggagcaataggctgtaccatatgacctatctgtagtaggctataatctaggtttgtgtaagtacactctgtgaatacatgactgtatgcatgttctgagatatacacacacccattaaagctattgatcttgtgttttacctttatgtgacactttacctttaaagttctctttgtgtgcatgtgtacaggggttgggaagaagcagttcagtatcatttaataagggggagaaacccaaccccaagatacttgatgaaatctaaggaatacagtctaagtaacacctacctgctcctcccaccaatataagaagagctaaaatcattaatgcatgtatgtataggaaaataatgaaagacaaatatggcaaaatgaggtcagttcaaaggatttatctgtgtgctaagagatgagatagaggctagtggcatgagaaaagcaaaaatggaaataagaggaaaatgaataggtagaactgagggcaatgacctggctcattggaaaaaaaaaagattttttggtaaatattctgtattccaaccatgtctaatagggatttatgaagtgggggaggagacactggaagagagagagagtaaatatgaatgtatttgtattaaaatctctagaataaatgtagtcatataaatctctggaatacaaattttcacttcagtacttcactgtgcaaaatagtttctgaggcaatgaaggaacataccagggctattagagaaagctatgggattggcaaatcagtgagggaggacttgccagctttgaatgcctagtaagtttatttacagtatacccctgcttggtccatgaactgtagtcttaccacagaaatagctggaattttgagaaaaactgtttttgaagttataaatgatcagctgctgtaatactggcttataagaccagatagtgtggccacaagtgaaaagagaataacctaggaagttcccctcttctccatgagttgtcattaactgtttgattgttcccagcagtattataactctcccttttccctggagcagtctgccatttttgcaaagtgaggaccaatttaatggggtttacttaatggattgataaggctgaggggcaaaggtttgccacagggaataaattgatggttaatgtatttttgcctccaaggccagaaaggagacataatgaaaagagtgaagtgaaaagataagactagggtttaaacgacagcttgtggtcctctgcagatgattcatttctgctgcttggcatgtgctttagacctatatgtttacaaggacaaaaatgggaaaattactccctgatcctctatatatgtacaatatatataaggacctattcctaaggtccttgtaaatccctagcccttaaataaatatacatttgagagaaaatatcacaatatagatttaacattgtatggagtagggagtagaccagtaattttttttctcactgaacgaacatttaaaacattaatatcctcttgcatcactaagagcagtaagactgcaccatcccctggttattagtgttcatagcaagctgtgtgaatcttgttggcaaaactttactagcctttgtagcagcccctgacccaggggcatctctacaaatcccctttgacagctgttttcatatgcactgagaatagacaagaagaggtagattttgactgaaacaggaggcattttggtgagagttatttcaaggaattttattgggaggaactttttttcagattgataataaaaacaggtccataggcaaaagctttataacagtattttaatggcaaattaggtgtgtttgcatcagttctgtaagctttcaatgctggtgttttaggagacaaatgtcctactttcctacagaattgtccctggtgttactattggagagcaaattatgtactgcatgggccctgggatatctttaattagtcagtgacgaaagctgggaaatctttcaccaatattctttaactttcaggtttaggatggctctaacctggcctgggtaaagaataatggacttggtgaccctccaaggccacttccatttcagtgattctattacctacttctgtcaatatttctccacttcctcctcccctgcagaaatgagagaaatacaaagcaatttgtgatcagcttccctaacaagccccctacacagaccacgaatatgagctcaaagcacattacttgaaattgtttaaaatgtaatcccttccaccttactcttgttttcactcaggacagagaacttgtttttgaaattcagactcttatttctatactcagaggcatgcaaccacaatcaagatggggtttggttgaattcaagttttttaaacctattcttcatgtataacatcacatctttttatgtgtatatatatatatatgtagaattatatgtgtaataaattacttcagttaagttgtgtgaggctagggtaggctgcagtaataatcaacactcacatttcagtggtttaacccaatagaagtttacttcttctgagagtccaggttgctttccagggaacccgtttccatatagtgactcaggggcttagactgctttgatctgatagtttcagcctcatctctgaaatgacatatgttcacttcccctcatgggccattggtcagaattaattacctggctttgcctaaatttaagggggcagagagaagccgagaaataagtcttccatgtttccagaaggagaggagaatttttgatataggtgaataatagggatatatacaagtttagtgaatgagtctgcttaagaaaattttgagactatggggtttttttagatataggatcatgacatctgcaaatagggatagtttgacttcctctctttctatttgggtgctctttatttctttctcttgcctgactgccctggccagaacttccaatactatgttgaatacgagtggtgagagagggcatcctggtttcatgccagttttcaaggggaatgcttccagcttttgcccattcagtatgatgttggctgtggatttgttatatacatggctctcattattttgagttatgttccttgatgtggtttggctctgtgtccccacacaaatctcactttgaattgtaataattcccacctgtcaagggtgggaccaggtggaaaaaattgaatcatgggggcagtttcccctatgctgttctcatggtaatgagtgagttctcaggagatctgatggttttataatgggcttccctcttccttcggctctcattccatctcctgccaccctgttaagtggtgccttttgctgtgattgtaagtttcttgaggtctccctagccatgcagaactgtgaatcaattcaacctcttttctttataaagtattctgtcttgcgtatttcttcatagcagtgtgagaatggactaataccttcctttaatgcctagtttattgaaagtttttaacatgaatagatgttgaattttctgaaagtctttgctgcatctactgagataatcgtgtggtttttgtctttagctctctttatgtgatgactgacatttgttgatttgcatatgttgaacaaagcttgcatcccagagataaagcctacttgatcatagtgaataagctttttgatgtgctgctggattcaatttgccagcattttgttgagaatttttgcattgatattcatcaagaatgttggcctgaagttttcttttgttgtagtatctctgcaaggttttggtaacagaatgatgctgacatcatgcaatgagttgggtaggagtcccttttcctcattttttgggaatattttcagtaagaatggtaccagctcttctttgcacatctggtagaattcagctgtgaatctatctggtcctgggctttttctcattggtaggctatttactactaattaagttttggagctcattattggtctgttcagtaaatcaatcttttcctggttcagtcttgggagggtatatgtatatgggaatttatccatttatacccagttttcttgtttgtgtgcatagagatgttcatactattctctgatggttgttggtatttctgtgggggtctgtaataatatccccttgtcatttctgattgtgtttttttgaatcttctcttttttcttcattactctagctagtagtctattttattttctattttttcaaaaaaaaaaaaaaaaaccagatcctggattagttgatcttttgaacggtttttgtgtctctatctccttcagttgagctctgactttgattatttcttgtcttctgatagtttgtcttagcccaaactcttcttaagctgataaacaacttcacaaagtctcaggatacaaaatcattgtgcaaaaatcactaatattcctatacaccaacaacagccaagccacgaaccaaatcaggaatgagcttctattcacaattgctaaaaaaaaaaaataataaaataaaatgcccaggaatacagctaactagggaggtgaaagagctctacaaggagaactataacccactactcaaagaaatcagagatgatacaaacaaatggaaaaacattccatgcctattgataggaagaatcaatattgttaaaatggccatactacccaaagcaatttatagattcaatgctatgcctattaaacaaccactgacattctttaccgaactagtgaaaactattttaaaattcatatggaatcaaaaaacagcctgaatagccaaggtaatcctaagaaaaaagagcaaagctagaagcatcacactagccgacttcaaactatactacaaggctacactaacaaaacatcatggtactagtataaaaacagacacatagtccaatggaagagaatagagaacccagaaataagaccacacacaactatctgatcttcgacaaacttaacacaaacaagcaatggggaaaagatttcctattcaataaatgttgctgggataaatgactaacgatatgcagaagattaaaactagatcccttccttacaccacatacaaagattaactaagatggattaaagacttaaatgtaaaatccagaactaaaaaacctggaagacaaaataggtaataccattcagaacatagatacggacaaggatttcatgattgaagacaccaaaagcaattgcaacaaaagcaaaaattgacaaattggatctaattaaactaaagagcttctgcacagcagaagaaactatcaacagagtaaacagataatctatggaatgaaaatatttgaaaactatgcatctgactaaggcctaatatctagaatctataaggggcttaaatcaacaagcaaaacacaaacaatcccgttaaaaaataggcaaagaacattagcagacacttctcaaaagaagacatacatccacccaacaagcatatgaaaaaaagcccaacatcactgattattagagaaatgcaaattaaaaccacaatgagataccatctcacaccagccaaaatggttattattaaaaagtcaaaaaataacagatgctggcaagtttgtggcaaaaaaggaacacttatacactattggtgggaatgtaaattagttcaaccattgtatgtgacagtgtgacacttcctcaaagacctaaaacagaaataccattagacccagcaatcccattactgggtatatacctgaaggaatagaaatcattctgttataaagacacacgcacatgtatgttcatttcatcactattcacaatagcaaagacatggaatcaacctaaatgctgacgaatgatagactggataaagaaaatgtggtacatatgccatggaatactatgcagccataaaaaacaagatcatttcctttgcaggggcatggatgcagctgaaggccattatccttagcaaactaatgcaagaacagaaaaccaaatattgcatgttttcacttatgattgggagctaaattatgagaacacatggacacatagaggggaacaagacacattggggcctatcagagggtggaggttgaaaggagggagaggatcaggaaaaataaataatgggtactaggtttaatacctgagtgatgaaataatctgtatagcaaaccctgtattacttcattgacagaacccccatgacagaagtttatctatgtaacaaacctgcacatgtacccctgaacttaaaagttaaaaaaaaaaaaaaaaaagaacattttgattccttcttttatggtctttatccaagggttcatacaaaaatgggaaggtaggcctatttatttgtaagttttcaaaactgaattgagctgagttgcctgaggagggggggcagacactcaatcaacaaacacattcttttttttaattattatactttaagttttagggtacatgtgtacaacgtgcaggtttgttacatatgtatacatgtgccatgttggtgtgctgcacccattaactcgtcatttagcgttaggtatctctcctaatgctatctcccccccccaccccacaacagtccccggtgtgtgatgttccccttcctgtgtccatgtgttctcattgttcaattcccacctatgagtgagaacatgtggtgtttggttttttgtcattgcgatagtttgctgcgaatgatggtttccagcttcatccatgtccctacaaaggacgtgaactcatcattgttatggctgcatagtattccatggtgtatatgtgccacattttcttaatccagtctatcattgttggacatttgggttggttccaagtctttgttattgtgaatagtgccacaataaacatatgtgtgcatgtgtctttatagcagcatgatttataatcctttgggtatatacccaataatgggatggctgggtcaaatggaatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatagtatctcattgtggttttgatttacatttctctgatggccagtgatgatgagcatttttcttagtacctgatatggtttggctctgtgtccccacccatatgtcgacttgtcttccccatgtgtcaagggagggacctggtgggaagtgatgggatcatgaggatggatttccccccatgttgttctcatgatagtgagggagttctcacaagatctgctggttttaaaagtggcagtttcccctgtgtactctctctctcctgcagccatgtaagacgtggcttgtttccccttcaccttccaccgtgattgtaagtttcctgaggcctctccagccatgtggaactgtgagtcaattaaacctcttttgtttataaattatgcaatctcaggtagttctttatagcagtgtgaaaacggactaatacagtacccatggtatatgcagcctcaatttttgaaaaatgatttactgcaggattcttttaagttaagagtcagcaaacatttttctgttaagggccagatagtacatatcttcagttttgtaggccatacagtctctgtgacaactatttaacttccattactgtgtgaaagtagccgttgacaataagtaaacgaataagcttagctatgttccaaacaaagtttgtttacaaaaacacatagtgggttgtagtttctgactcctgctttaaatagagagactcccttgtgaataagaaagtttaaagatacctgtttaccaaaaggtgagcaagagcagagaaattttaaaactaagtcagtgacagttcattagaaacaaagacaaaactactgtgaaataagccaatgtgaaaatagtttatcatttgtcacaagtgatttacattttgtatctaattatatgtgaacctgtaagttaagatgctcttgatcacaaggaatagaaaaaaattcaaactggcttatgcatataaatgtattggttcatgctatacaaaagttctgaaatagtctttatgtagtttcatcagagcctcaacatatttctctttcattatcttgactctgcctttttgctagcatcagctttgtcccctggctggccaacattaattggggctacttgctttcatagtcacatattggagaaagaatggatatctcttttttagccattgaacaaaagcactgtgctttctctgttttatgtgcccttaaaccaattaatgtagcaagggaatagcattactctgattgtctcataccaatctgggtattgggtgcattgctggagctagggttgaggtcaaacctatccagctgaaagactgaatgaatgtttaaaagcaactccattaccttccacaatgaccgcttcaccctgttgcaacttgtagcttcaccgtttcatcctgttgcaatttgttgtagcatatatgtgcagagaggtgggaaggccataggagaatttttattattagcaagaacctcaacccagagatctttgaatgtggataccatgttgtagcttttgctgaaagccatgtagacaccgcataatgtccctgatttgcctcagggaagatcagatttcttgctgggagtgatggtggtcacaaaggtcattggatatttctgtgtgctttctgcagatagtcatactggatataattaaggtatacaagaactgtggagaataaatatgttgttaggggaatgaacagctaatggtaagctgatatccagagtatcctgtactacatcaaaagatctcaatctgagtccattctaacagtattctatttctacattccattatgctatgcttatttttggttgccatatcttaaaacaatgcatcagagttgaagaatgtccagataaaattaccataggcatatctgtcacaaaatccagaatcagaagcaaatcgacattgttgggttttattagtgtcagtgatacaatggcatcgcaaattttccaatgtaattcagagagatccaagatgaacaaaaatattggggcttttcagtctggacaaataaatactgaaggaatatcattaaaacctataaaataagaaattaaacataaggtatacataaacatatttattaaattctaatatattaggacagatggacacatattttagctcaaaacaattttaaggcaaatgaaaagacatgcaccttcataaaatgagaaatcaggtcgtagaaataataagcacctccagcaattgctactagctgggcacatacccttgaaaaacaagttcatggtagttaaagactgatctgtctgtatcaaatgatgaagggcaatgaagatgttttgtagacatcctggaactttgagtttagcagcagtgagaacagctttgctgtaccttgaactatacccctttatggttcatgtagcaggactggtattttcttcttctaaatatctactttctttgcttgctgtacctgtttgtacctaaccttcaagctgttccattttaaaacactgtcagtccaactgcctgatgaactgagaagagcttaaaatggacaaagggcatgaacaggcactactcaaaagaagacattcatgtggccagcatatgaaaaaagtctcaacataactgatcattagagaagagcaaatcaaaaccacgatgagataccatctcataccagtcaggatggcaattattaaaaagtcaagaaacaacagatgctggtgaggttgcagagaaataggaacgcttttacactgttagtgggaatgtaagttagcttaaccactgtgggagacagtgtggcaattcctcaaagatctagaaccaggaatactatttgactgagcaatcccattactggacatatacccaaaggaatataaatcattctattacaaagatacatgcatgcgtatgttcattgcagcactattcacaatagcaaagacatggaatcagcccagatgcccatcaatgatagactggatgaagaaggcatggtgcatatacaccatggagtgctatgcagctataggagggagtgagatcatgttctttgcagggacacagatggagctggaagccattatccttagcaaaccaactcagaaacagaaaaccagacaccacatgttctcacttataagtgggaactgaagaatgagaacacatggacacagggaggggaacaacacacattggggcctcttggcagggcagagggagagagagcatcaggataaataaccaagggatgcggggtttaatacctaggtgatgagttaataggtacagcaaaccaccatgacatacgtttactgatgtaacaaacctgcacgtcctgcacatgaaacccagaacttaaaataaaaatttaaaaaaatgcatacaaatataattgaatagaatacctatacaaagatataaacatagaactgtgtaatttaacaaatacctttctttaagactcaaaaactcattctcaatatattattgaccataataatgctgcaattgtcaaagtctggattttcacacagataggtttgaaattcagccatgtattttgataagcgctattgtataggaattggagtgtactttcattcctgcttgcccttttgttctttctggacaatatccaaagcacagtatcttgctctaatagctattcttgactggatttctggcaacggcatttccttgcattgctcataggtgccttgtttagtgccctgcccatttttagtcctatctacttctaatcgtggtaaaagagggtgattgttcatagcagaggtaataaaacactatctgtaaagaggcaaatagtaaatacttcagggtcataggccatacagtctctattgcaattactcaactctgccattgtagcatgaaagcagccatgaatgatatataaatgaatgagctagctgtgtatcaataaaattttatttataaacaaaaatttgaattttatattattttcatttgtcatgaaatattctttaaaaaatttctaggtcattaaaaaatgtcaaaaatgtttttagctcatgggtcatatatagaaacatgggatgggctggatttggccagtaggagtagtttgtggaacacctagtttacagtgaggatattgagagggagacagggtctatgttttggctttgcttcaattcctttacttgtagtgctcttatattgtggaagtcagctttattttgtgttagctgtttcctcacttaaggtgataactctgtccatgtgttcaaaatgttaagtgagcctcaacttgaaagaactagaggaggtggtttctactttgtctctcatattgcttttccatagtatatgtttggaaactctgtaagaaagcagatcaaatattttctccatgcattgttttacagtaaaagcctgcatgtagcaccatgtgatgtacgagttgtctgcaaagattaaatcctaagtggacatacacaggacatgcatggaaaccagcagaatctgacgaatggatggtatagcaaggagcatatatgataatataatgcagagcatgcattctaatgaaatatattgttgccagtagcattattttgattacaaaaatataattaagtttaattgtaatggtaataataatgaaggagaaggtaagaaatagggaagccttcaagaacatagattccttctttgccatgctatggtaggatggtcatccccttatcagattgctattcacccagtatgaactggtgtaggcatttcagttatttgcagctgacatccattttgacagagccagtctccattgtgtttgaattggtacccatgatctattttgaaaatttaaatgtgtgttaatcaaaactgctagattgagtcttgcaatggagcataagaacaaagttgaagggtgaagtatcaccactgattgtagaaaatatttttaaaatgattaatttccaaaactgtggatgataaaatataaatatggtcagttttcagaaatattgcagatacatgtaacgtcctgttactaacccttggaaattctgataaaatgtaacacctcaggatgacacaaaaaattccaacttgccagaaaaaaagactgtaactgccaggggtggggtgcagtacagtcagactgtgtaaattaggaatgtgggttttcatgaccatgtaacaaaggaggtgaggtctcaggtgtttgtaaagtgaggttttggaattacagatccctaaggagagctggtacccttgaatttctaacctttaataaaagggtgaacaacaacaaaaaaatcctacccacagagaaatgacaaggaatttggctctttgcctgagatttggatggaaaaaaaaatctcctacagagatttgtaactataggcttacaattcgtttgtgtttggagtttcattttctatgatccccaaacttagaaggtagcaaaaaattggttctgagctagtgtctcccctgagtttcctggcagaagcagtcaaaagagcttttgaggaacatacagtacaggctacaaggtattgttgcagaaaaagtaaccctttataagacaaattcacaataaaatgttaccaacatgtgactaaacagttcaccctgatgaaagtcagtagacacaacaaacaatagaattatatccctaagaattagacatagcagaatagagatacaggagataattgaaaattaatgttcatcatagtgactgaaaagaagtcaaaatcctaagaattgaacaacaggctttgagaacaaaagatttacaacagaagaaaataaaagttttagaaaggaaaagtatgatttgatttgtgggctaattattggataatatggagctacagagattagtaaactgataaatagtctgaggcagtcactcacaatgcgacagagggatgaagggatggcaaaatatgagaggttaagagacacgcaaatgaaaagattcaacatatatctaaaaggggtgctaggatagcattaggagatatacctaatgttaaatgatgagttaatgggtgcagcacaccaacatggcacatgtatacatatgtaacaaacatgcacattgtgcacatgtaccctaaaacttaaagtataataaaaaaattagcatggtggaggagcaatattcaaagagataatggctaataattcttcaacactgatagaaaacccaatgcagatttaagaaactcagcaaacatcaagcatattacgtaaacaaaaggaatccacatgtgtaatgaaactggagagccccaaagaaaaatggataatgttaaaaaccaccaaaaaggcagatcatctataaaggagcagcaaatagagcaactatagacttcacaacaaaaataattgaggccattcttgttcatatggcaatgcaattttcccaacaccatttattgaatagggtgtctttttcccactgtatgtttttgttgactttgttgaagaccagttggctgtaagtatgtggcttcatttctgggttctctagtctattccattgatctatgtgtctattttttaaattatacttaaagttctgggatacatgtacagaatgtgcaggtttgctacataggtatacacgtgccatggtggtttgctgcacccatcaactcgtcaactacattaggtatttctcctaatgctatccctcccctagctccccaaccccgacaggccctggtgtgtgatgtttctctccctatgtccatgtgttctcattgttcagctaccacttatgagtgagaacatgtggtgtttggttttctgttcttgtgttagcttgctgggaatgatggtttccagctttatccatgtgcatgcaaaggacatgaactcatcctttttatggctgcatagtattccatggtgtatatgtgccacatttcctttatccagtctatcattgatggacagttgggtaggtttcaagtttttgctattgtgaatagtgccacaataaccatacgtgtacatgtgtctttatagttgaacgttttataatcctttgggtatatactcagtagtgggattgctgggccaaatggtatttctggttctagatccttgaggaatcaccacactgtcttccacaactggtgaactaatttacactcccaccaacagtgtaaaagcattcctatttctccacatcctctccaacatttgttgtttcctgactttttaaagattgccattctaactggtgtgagatggtatctcattgtggttttgatttgcatttctctaatgaccagtgatgatgagctatttttcatatgtttgttggctgcataaatgtcttctttttggaagtgtctgttcatatcctttgcccactttttgatggggttgtatgtttttttcttgtaaatgtatttaagttacttgtagattctggatattagccctttgtcaggtggatagatttcaaaaattttctcctattctctaggttgcctgttcactctgatgatagtttcttttgatgtgaagaagctctttagtttaattagattccatttgtcaattttgggttttgttgccattgcctttggtgttttaatcgtgaagtctttgtccatgcctatgtcctgaatggtattgcctaggttttcttctagggtttctatggttttaggtcttaggtttaagtctttaatccatcttgagtgaatttttgtaaaaggtgtcaggaagggatctggtttcagttttttacatatggctagccagttttcccaacaccatttataaaataaggaatcctttcccccatttcttgtttttgtcaggtttgtcaaagatcagagggtatgtggcaccatttctgaggcctctgttctgttccattggtctatatatctgttttggtaccagtaacatgctgttttggttactgtagccttgtagtatagattgaagtcaggtagcgtgatgcctctagctttgttctttttgcttaggattgtcttggctatatgggctcttttttagttccatgtgaaatttaaagtaattttttttctaattctgtgaagaaagtcagtgttagcttgatggggatagcattgaatctataaattactttgggcagtatggccattttcacaatattgattcttcctatccatgggcatggaatgtttttccatttgtaagtgtcctctcttatttccttgagttgtggtttttagttatccttaaagaggttcttcacatctcttgtaagttgtattcctaggtactttattctctctgtagcaattgtgaatgggagtttgctcatgatttggctctctgtttgtctattattggtgtataggaatgcttatgatttttgcacattgattttgtatcctgagactttgctgaagttgcttatcagcttaaggagatttttataccattaccatgctgttttggctgcgatagcctcatagtataatttgaagtcaagtaatgtgatgtttctacccttgttgtttttgctcaggactgttttggctattagggctcttttttgtctttatatggattttctatctctcatcatatacagaaaccaactcaaaatggattaaaaacttaaatgtaagacctgaaaattaaaaaaaaaaatcctagaataaaacctaggaaaaactcttctggacattggctttggcaaaaataattcatgactaagacctcaaaagtaaacccaataaaaataaaaatagacaaatgagatgtaattaaattaaaacgtttctgcacagaacaagaaataatcacagaatgaacagataacttgcaaaatgggagaaagcatctgacaaaggactaatatcaagcatttacaaggaactcaaatgtctcaataacaacaacaaaaacagccccattaaaaagtgggcaaaggatgtgaacagacattttaaaaacattcaaatggccaacaagcatatgaaaaaaataatcatcatcactaataatcagaaaatgccaattaaaactacaatgagataccattttatactagtcaaaatggatattattaaaaagtaaaaaataacggatcctggaaagattgcggagaacagggaatgcttatacaccactggtgagaatgtaaattaatacaacctttatggaaaacggtatgtagatttctttaagaactaaaaattgaactgccatttgatccagcaatcccactactaggtatctacccaaaggaaaataaatcatttgtataaaaagatgtttgtactcatatgttgattgcagtactattcacaacagcaaagatatgaaatcaacctaagtgtccatcaatggatgattggataaagaaaatttggtacatatgcaccatggaatactattcagccataaaaataaatcattttgcagcagaatgaattttgtttttggattttttttttttgcagcaacatggatggaacaggaggccattatcttaagtgaaataactcagaaagtaaaatactgcatgttctcacttataagtgtgagctaaataatgtgtatacatgggcatagcaagtggaataatagatattggagacttagaagggtgggaaggtagtgagggatgagaaattacttaatgggtagaatgttcactctttgggtgatggctacattaacagccctgacttcaccactacatagtatatccatgtaacaaaattgcacttgtagcccctaaatctataaaaataaagaaaaagaaaaagaatgagaccaaaagagaaaggaatattatcttcaagagctgaggaaaataacaatctagaacttctgtactgaatatcataaaagagtgtgagcaaaataaatgtaaatgtcactgaacactgaaataatttactactcatagacacttggtgaaagaactactaaaaatatatgtgctagtagaaagaaaattgaatccagaaagaagccagatgcatgaagcaatggtgaacagtgaaattggtaaatagaggtatatctaaataagaggtacatctaaataatgttgatgaaccacttacaggttacaagtatgatatggtttgaattatgtcccctcaaattcatatgtggaagtcctaagccccagtacctgtgtatttgaccttacatttggaaatatgtttgttgcagacataatgagttaagatgaggtaatctcatcttggatagggtgcgcacctaatacaacatgactgacgtccttataaaaaggggaactttggacacagagacattcacacatggaggatgtcatgtgaagattggagataagctgccacatacctgcaacaggaacaattagatgctaggggcagggcctagatatagatcttttcctaaagtctgcagagagagcacgggcctgttttcttaatcttagacttctagccttcagaactgtgagacaatacatttctgttgtttaagccactcagtttgtggtacattgttacagcagccctagcaaactaatataaaatacaaaatggatcaagacacttgaaaactgtaataggtaagtataatcagaattacattttctctaaggctcttgtattatagtctaggaggaggagtagagatgttgatcacctttagactttaagtcaagtatgcatgttaaaaatttaggagtaatcaacaaaattatttaaatagaatctgtatatccaaatcagtagaagaggacagaaggaaattgtaaaaacttcactcaatatgaagcaggaaggagaaaaaaagaagaaaataaaaagagtgataagtaagacatacaatggtagaaataaattcaagtataaaattaagttcaaaatgtaaaacaattaaattcatatgccaaaggtatagaagctcatatcaaaaattttttaacaaaattataaagctttagaaggctagtagggcttgatcatcgtcccaactattggttggagggttgttgagatttcacatgaatagttggaattttaacatgggagcaatattctaaccaaggggtgagcaaatgatagcccacagcccaaatagggcctgctgccttttttttttttttttttttttttgtacagcctgcaagctaagaatggattttacatatttttaactttgtattttagtttcatgggtacatatacaggtttgttatataggtaaagtcatgtcatgagggcatgttgtacagattattttgtcactcagctgctaagcatagtacccaatagtttttttttttatcttatccctcctcacactctgcaccttcaagtagaccccagtgtatgtttttccccaccatgtgtccatgtgttctcatcatttagctcccacttacaagtgagaacatgtggtatttggttttctgttcctgtgctagtttgctaaggataatggcctccagctccatcatgttcctgcaaaggacatggtctcgttcttttttatggttgcatagtatttcacggtgttcatattaaatttttaagattaactgtatgctcttgaccagggagaaatgtaaaacaacacagaataattgaaaataaatgaataaaagagatggatgagaaatatcaaccgaaagaaagccagcattacaatgatgatataaggaaaaaatatttaaagcaaaaagccttattagggacatggaaggtcactacttaatgataaaagacaaaactcactatgaagatatatattttaaacaagttagtctcaaatatataaagcaatatttgaaagaaatactaggaaacgttgaaatattcacactcatatttgaagactttttaaaaattaaactgaagtaatttattaaaataattttattatactttaagttttagggtacatgtgcacaatgtgcaggttagttacatatgtatacatgtgccatgctggtgtgctgcacccattaactcgtcatttagcattaggtgtatctcctaatgctatccctcccctcccccccaccccagaacagtccccagagtgtgatgttccccttcctgtgtccatgtgttctcattgttcaattcccatctatgagtgagaacatgtggtgtttggttttttgtccttgtgatagtttactgagaatgacgatttccaatttcatccatgtccctacaaaggacatgaactcatcattttttatggctgcatagtattccatggtgtatatgtgccacattttcttaatccagtctatcatcgttggacatttgggttggttccaagtctttgctattgtgaatagtgtcgcaataaacatacgtgtgcatgtgtctttatagcagcatgatttatagtcctttgggtatatacccagtaatgggatggctgggtcaaatggaatttctagttctagatccctgaggaatcgccacactgacttccacaatggttgaactagtttacagtcccaccaacagtgtaaaagtgttcctatttctccacatcctctccagcacctgttttttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccaatttttgatggggttgttttttcttgtaaatttgtttgagttcattgtagattctagatattagccctttgtcagatgagtaggttgcgaaaattttctcccattttgtaggttgtctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaacagactttttttttgggatggagtctcactcctgtcatgcaggctggaatgcagtggcgcagtctctactcactgcagcctccacctcccaggttcaagtgattctcctttctcagcctcctgagtagatgggattacaggtgggcacaaccatgcccagctaatttttgtatttttagtagagacaggttttcaccatgttagccagtttggtctcgaactcctgacctcagtttatccacctgcctcggcctcccaaagtgctaggattaaaggtgtgggcctttaaaggcgcctggcctgtttgaagattttaacataactttcagtaatcaatatgcaaggagaaaaaaatcagtgcttatgttaaacagacttgatttaatggacataaatagaactctgggcccaataattacagaaaatattagagtaaaaataattaaagaaataattagagaaaatactttttcttttgagttacatgtgaaatatttctaaaaattgactgtgtactaggtgacaaatctcaaaaataccccaaagcctctataaacacctctttctctgaccacactgcaaagaaggtatgcatcagtttaaaaatagcaaaaagtccttgttaattttgaaattaaaaatactttgatgtaattcattggttaagaaaattttatgtgggaaattagaaaatatttagaattgaataatgatgacacagcatagcaaaacttgtgggatgctgccaatgtcagagttgaattttcagtgtagaatgtgtaagagaaggagaactaacagaagctgtgtccactttaagtagttagaaaaggaacaagatagttgattaaaaaagggaaggaaatagaagtagaaatgaatgaaatagaaaacaaagaaatgatagagaatcaacaaaaccagcatttggtctttgaaattattagtagacaagcataccaaaataaacttattgtaacactgattttacaaaaagacttgacaagtcatcagtattaagaatgaaaagggagatgctactgtagatacagtcaaatttaaaaacacagtaacaatatcttgaaaaactttgtacaataaataaatcatagaattgaacaaatggatactgtcatgcaaaaataaaatatattaaaagtgcctcaaggaagaataattaacctggataaatctagtacctacattaaagaaattgtatcaatagtcaaaaatctacatacaaaaaaatcaccaggcctagaggatttcacaaattagtttatcaaattttcaaagaacagataatctccattttatataacttcttcagagaattaaaaaagagggaaaattcccctgaactaattttcagagtctaatataatctttttacccaaacaagatagatacactttgagaaaaataaattacagattacctcacatacatggcagctaaatgtcataaatacaatatcagcaggttaaatccattaataagttttattaatgaaatactgcctcatgctgatctgaatttataccaaaaatatttaagaatggtttaactttttaaaaaattatttaatgtctttgataaccttaaagaaaaaagtaatataaccacctcaacagattaaaaaagcacttaatataattcaatataatttgattttaaaaactcctagcaaactcctagaaaactatacaaaaaacttttaaaattagataaatgttattgaccaaaaaccatttgagacaaagtaatcttgcctgctatcactacctctaagcaacaggaaataagaatagaaaaatgaaagttatgcgtattggaaagtaaacaacccaaaacttattgtgaaagaatgattgtcttgatataaatttaaaaataatattcaggaccgggcgcagtggcacacacctgtaatcccagcactttgcgaggccgaggtgggcggattgcctgaggttaggagttctagaccagcctggccaacatggtgaaaccccatctctactaaaaatatatgaaaacaacaacagcagcaacaacaaaaacaaaaaaccggggtagtggcatgcacctgtaatcccagctactcaggaggctgaggcaggggagttgcttaaactggtgaggtggaggttgcagtgagcagagatcataccactgcattccagcctgagtgacagcgagactctgtctcaaaataataataataataataataataatagtaataataataatcatgcaaactgttaaaactaaaaagagttcagcaacatttcttgataaaaaatagaaaatacaatactataaaacttctagaaaaacacataggaattcattttcatgacctaggattaagaaaagagttcatcataaaaattataaacttcttttctgggaaggacactgtgaagaggatgaaaaggcaagccacagactgggagaaatattggcaaatcacatatctaataaaggacttgaatccaaaatatataaagaattctcaaaactcaggaataaggaaaacaacagcctaatttaaaaatgggtaaaagatttaaacaaccacttcaccaaagtagacttatagttggcaaataaataaagtacatgaaaagatgctcaacattattagccaatagggaaatacaaattaaagccatgatgggatgtcactacatgcctatcaaaatggcaaaaataataattttaagaatacaattatcagtgctaggcagaatgcagagtagctgaaatttgcatacattttcagtaggaatgtaaaatggtacagctactctggaaaaacagtttggcagtttcttataaaactaaacatactacttccgtacaactgagcaattgcgcttttgggcatttatccaaaagaaatgaaaacttgtacacacaaacctgcatatgaatgtgtatagaagctttgtttctaataacccccaattggaaacaactcaaatttgcatcaacagatgaatggataaaacatattgtggtgtatctacatagtgggacactattcagcaataaaaaatgaacttttgattcatccatcaacttggatgaatcataaagacagtatgctaaatgaaagaagccagtctcaaaaggctgcatattgtatcattttgtttatatgacattctgaagaagataaaactacagtgacagagtggttgctagggtttaggagtagagggagagtgtgactacaaagggatggcatgaggtagtgttttggggtgatggaactgttctgtatcctgattctggtattggttacataaatctatacatatattaaaattcatagaactatataacaaaaagtcaattttactgtatattaatttaaaataaaatttaaaaatttaaaaattacttcataaaaaggaggatatgtacagtatcagaaggttgatcatacatcctagtgggcctcaaacaggcccactttatgcttttatcctggtgtaattattaatagtgtcaattgtagaattctgtttgaatggtaaattatatgcttatcctaaatatgaaactgtattcttactgtaaatatgaaaccattcattttaattttaaagtatacaagacaaaattaagaatgtattgcttttgattaccatttatatgtagtagcatggaaattgcatggaagagaaataaaatctttaggaagaaagggataacaaaagaatgggggcttcagctgacataaatatgacaaaattagaaataaaaaattcaaaaataaatataaggtggctctcaatggaaattccagaaaataagaaaatggtattttgattaacagcttatgtttatgttagaaccttgatcagttcttgaagcaaataggtgataaaaatggtggtcctcttggtttgctgaaaagtgaaatgatatgtgctgatgtcacatatcctctgactgttcctgatgaacctacctcattgtctgatgtccatgaatggcagttgctatagaagtctgtgcatggcagttatatgaacaataaccattgtgacaaagggaaccactattaccctaatggaaagagagaaattagagacacagtagccacacaaaactaaaatatattaaatattagtgttgtctacttctttaatggggaaaaagagcatatcattagtgtcaagcgcatcccacagtaggctctctttagaagaataactcagtgcaataatgtgaattgctttgtctttgattttgaacatgattaaattggcaggcagtgggtgggagtatgttgttcaggatagaagtttgcataactggtaactgtagcatttttctcagacactatcattgtgtcaaactatgatgcacaatgatacacaatgctgtgatacacaagctgtgatacacgatgttagttatcattgtgtcaagatctcatccttaacatctgcagtgatttgtgctctctgcactaagtcaaaccttcttagcctggcatctaaaaccctccatattatggcccaccctatctatctaagctctcataccaatgtttcccatcacacaccatttactgtagtcatctgtctccttcattattctagaagcacactgagttctttctcccctcctcacatgttgttttccttaagtggaatgccctaacttctcttccacactaatctaaaccctgcaacactcaatccaaacctctctggtccatgaagcctttcttggctagatcaaccttcactgatctcctttgaactatgacacttactattatgaatacagatttatagtaatgacattttccattgtttgttgttgtttcaaatgtattactattctcttcctcagaagattatataggctattggcaaggcagtgctcatatctcataagtctttttgactccttgtagcgcatgatagatgctcaataaacatttctgactgacttgaatgcccattccaaattatgtttcactgttttaaacatcacaaactgatcacttttattgtcagctactcccagaacttcttttctctcctgtgattttcactctttagttaatcattgagtgttttagagatataagaccaaaacagtatatccaccatgaagtcattttacagttctatgcttctatctgcatttcctggtgctgctttctatcttataagaacacaacactaccaaaagcaaacatgacttcttaaagcaattttaaaaagtagcctcttgtcctccaagggagcttaacctctgctgaagaacaagaaattaacttcagattctgaccaaatttttgacaagagcctaaagttccttggaggaatggtataataatcatgcttgtggttgtagtgattgcaatgttagcaatcctggcctgaaaatatttttactgtaggcatagaacatgaacttttcagtaagccaaaaatagtgaatggtgatcattgatggaggtgaggataaaaggttagaaccagaattaaagtctcagctgaactcagagatacatgcaaaagttggatcagtacagctaggcagtcaagatctaagcaatggtacaggcatagcagagatcataaaagttctcaaaagaacaagaattctttaagttgaatcaacgtcatccagaaccattttatttacttcccatttgggcatgagcccatctcagttcaagtcagctcaaggccatggaaaactaaagtatgtgtcttaatctgctttgattgggaagtgtggaaccacaggaaaaaaaaatcacacttgcattccagcaaaagagcattctaacaacaataagaacagaatggtacaagcaatatgtatgtacaggatttacttgaggtgtgccacaatatattgtaaattggaatgcagaactgctttgtagacgactcaatgactattgattttgatactgctgaaataagaagttattcatgcgtataggttctgtctgatacaattcacagcccaattgattagcctccaataaatctgaaaaaaaggaggatggcaagctctgctttaaataatgaagaatcattacagcttattaagatattctggcatgaggactgaatctgtcttagcatttcttccagcatagaaagtaggcaatttgagaactagaatcatggtagaagggatgaatagatgacagttactgcccatgttgctctgctggtaatgcctggcaaggtaaacattcaagacctgtcagtgacttggcctttcagtcagtgagatgactatcaactctcactagtaaaggtgagaagtattttattattcatagacaccaagcagagcctatgtgttcatgaatcttttggctttgctctttttcttgttcttcttccagcctcatttttgctcttctacagctatcattgctcatgctattcttcctttccactctaaatactctctcactgcctgcctaacaattcaaattttactcatccttcaaggctcagcacaagtctgactgtcacataaagcactatttggtaattcccgtggactagttatgcttgttctgatcttctagttttcttttgcagtaaaatatcagtcagcattcagtcattgtaattttgtttctttcattcaaattgaagttgaatattgaaactcacacatatatttatctaatgcttccacagtgcctggcaccaccatagctacacagctataccatattcacacaccacatttgtttcagaatagggtcattgtagaatttattgtccaaaccaggatacttttgagtgtaaaagaggatgcccattaataattatcctggacttcctttgaaatgcttctaaaaataggataagctaatagatgggtagagagaggattaatgaacagatgtgtgataaagtgcagtaatatgctaatggcagattttaggtggtggtcgctgtaaaatcattttcaccatttgtgtatttttgaaagatttcatgagaaaatattgaaaaaatataattatgctgagacaacacaggtaaactgaaatgttatggtcaacccttgctcagagctgctgttattgacctcagagagaaaagtatgagtaggtagacagaggaaaaggagtgaatagaaagcagtgtagctaagtgggtgggtatagtataaactaacacatgaatttaacacctagaattaggtatctggctttaacatcaagacagttccaggccagatgtggtggctgatgcctgtaatcccagtgctttgggaggctgaggtgggaggattgcttgaggccaggagttcaagaccagcctggtcaacgtggtgagaccctacctctacaaaaaattaaaaaattagccagatgtggtggcacatgcctgtagtcctagctacttaggaggctgagaacagaggaccgcttcagccctggagtttgaggctgcagcgagctattattgcaccactgcattccatcctgggtgacagagcaagaccctgtctcttaaaacaaacaagaaagagtgacagttccatttgtctgataccgagaatgatgtagtttggttgataaggagcttttggccattctatttcaaatgggttctaagagggagcaatgatataaccaagggaggagaaccagtgagtaggagtcattatatgaacctccaacctggcacttatgtagcaccagacctctgtgaagcatgtctttgggaagcagaccttttggtttgttgatttcagtagcagtagttggcatatcaggtggtaagcctagaaacattcattgaaaagccccaagaaatgttggttctcttatttgttagtttgctttgcatggcagatgtgtttctgaaaggaaaatgtggattttatttatttttaaaaaaacaggctgtattttcctaaggtctaacccagtggttctcaaacttggcttcacattgtaatcatctagatcgttttatgacatactggtacctggggccacccccattggttttgatttataataactgcgtaaggagtgtggtctgggcatcaggatttaaaaaatctccccaagtgattctaaagtttgagaaccactgatttcactcttaaagatgctgacatatcttctatttgaaggagctcttgaccatatggattgctccccagtgaggctgaaactgttatggagagaacagggttgagtccctctttgtaggagagaaaggcaagtaagaaagaatcgtgtgaagttttgctctgtggatcaaaatttaaactacagcactacttctaccaattttcatgtcttttgtcttacctcctgcaatccatagtcatatatttaataatcattttatcatgatactatacccctaatttttccatcttgtatatttggatatttatttattggattttctcagattgaggtccacctgttgttttagagcattatatatctaattaggtcatgtaatgcaaaacacctgtcacctgactactgtcatgactaatggtgaaacactgctagatggggatggtgaggaacattgtactatcctgtttcacctgtttgatggaggtgtcttaggaagtgggtaaaagtagtattttactagaaactatcagcaggaagtagatagtaaacagtctattttaggcacctacatttttttcctccctcgatcaataagaccagtcactacttacattatctgttgcctatctgtaattgcttgcaacagtgacatgaacatcctttttgcagagttctagtacatggtttcaggtcatcagaacttgagtggtttggtcacttgtcaggtaggaatgtcattgggtagacaatgtatttgatttgctggtgaggacactgattttaaaagtcattgcttatttaacataaaatatcaactggagttgcattatgattttaatctttttgggatatcaattattagaacacaaaattgttgtctgttatattagtgtccattttacattatttttaatatgcccagaaaactgttagatttatctcctctatgtacgttttcaaagtaataacctgagctttaatggaattgggattcatatttgagaaaatgaagtctgtgatattatgaaaacccatttattctatctacctttcctttttgtttttcttttctttttttcatagcttagtttataattattgctctaaacctagtccgttatttatcggggaaactcaactctacgtttgattggccttggctttattcaatctaactataataatttgattttttttatataaaatattcaatcatgctttaccatatgatgaacttcatttatacataaaagctacttgctgttctacctttggaaattgttaaagaatctcagtaagggttttctagccatctgcttccctttgaaaccttgtgttaatgtagatatctacagtggtgactctagggttattaaactgcagtgtccagttaaatgccgttgttcataattatctagaactccagtctacattaagaaatcacttctattgttttgatatcaatgtgtcttaaagtggactttctagttttactgcatggaggcatatacctatctcacatgcatctgtctttccagtggggtacctctctttaagagagccattgtaataagattcatacttaccaaacataatagttgtggtgcaactaatcacattattaaagtcgtcttcactttgttagaaataattctccatgatagttctttaaattggagtttctctagtacatttaagcatctgtttataaatctgtaattgacagaaaataaaggaggtgagaaaaataagcccaagtgctataaactactgccaaccggtccagaaattgaaataaataatctctaatactgtaatataaatcaatggggaaatgatgcaatttacaaaaactcaatttagacttgaattttgtaaaacacattttttgcccagggtgatgaatatttgtatttggattaatggtatcgtaaatttttttaaacaaaagactatgtcttttggttaacaatttaactattttatctaaaggaaaatgtgtagtgagatatgaagtgaacctattgtctctagcctccacattaatttgtaataacatctataaatttttgtttgtaatatttataaacatttcacattttgatggtaataaacttaaaaacatgtcaaccagagagcaaagaagcaaaatcaagaagaagtttgttgttgttgttgtttcagcactgaggatcagtgaaatgacttaacatccatgaaatgataagttattcagttatgaaagtaacctccaagtactgcagttagttaggagcatcaattttgacattcagtgcaagaaaaaagtcacttttctataatgaaataatattgcagtaaatagtgagattcctgtaaacctgtaattcatggcactttgcacagctatcttgatctactgagtgaatttgtaagaaacagtaagagataattttctcattttgtgcagagtgtttccattctttctatgactaaatacagatctctgaactaaattataagcacagagtaatattcagggtacatgaggagaaaaagcaatttagtgaccgttttgtcattaaaaactgaagcaaaactcccaagcctgaaaaccacaaaatctgtttattgccagcataatcttggcagtgatgagttatattcacgttattcaatgagacaaaagaagggtcaactactttttcaaaaacattttacttgctttataagcatttggaaggacttactcctgtttcctcagggctttcactgaccttatatgttggggtatattctgaaagtgagtaactttgggaagttttagcagcctaaaggaaagaaagggcaaggctgggacaatattttcactgcactaaaggttgagtgtgtttgtacacatacaactgaattatgtttctctggccaattgtaaatggctcaagggtgaggctctcagtctttgatttatttggaatttcacaataatacagggctagctcatagtaggcactcagtaaatgtttgtttaatgacactgagaaaatgtgtcacatggtgtctgtacagtgccaagtccatagaaagcactcacagttgatttttttaatagtaaatgaagtcattcagttcttggatattttggttgactgtacatattccaaaggcatggattcaggttaagtgctcaccacttcagaaggtgcagctgacattttaaccccaaattgttaatacttaactctttcttacccccaagggaagccctttgacccatggtgatagagcctttccagaaagaaggaaaaactccatttgatatggccacagaatctggcaggaggattcacttttagatttcaaagacaagtagagaatatggaagtaacatgagttgaatttcaaaacaaatcgtgacttcaggtttaatgcatttcaacaccaattctagtgtctcttctgaatacagctgacctgcttggcatcagtttatatacctgttattctgcttatatgttttgtagaaatatagactgacaaactactgccgacttagaattctgcttgagaccagctcaagaagttaagcagtagctggtatgcttcattagaggatttaattggccttaaaatgcaatgagttgtgtgtgtgtgtgtttactctctttactccgagtgcttcttttcaatgttcttaaatatacagtaatatatatttcaaagttattattgcacttatgttccctctttgaggccacttatttgcttcagaccttttttctgcctttttgattttggtttcaaactatttttttttttgcatttttattatccctctacaaaggtaattgaaattggtttggagagccttttaaagaccacttttttcaagctcagaatttacctccctgtgattgaaaaccacagtagagtaatggagggaaagtaaacaccttggcttatatagtaataattaccactgcaaaaatgtaaaaattattaattcaaaaaacttcaaatgctctctggtcacacagtgtaaaattttaggactgcaggagagttcctatggtcatttggtacttcctgagccttctggaaatttaatagcctctgagcttttctttagcctgaggtgcaaaaggatcctgctgcttgcttcattgggcttgaaaatagtgggcagaaaaaaatcttgtgcaaacacagtatgcatagtctttcatatacagattactttgcagacttcctttcagtagaaagtgttagataactttcagtggttggataacttacactgaatcaatggcaccgtcttgtttgctgtccctttagaccacatatttttaagatgggtgacaggttcagagatacaggctagactggagagctaagtgaagaaatccaagcctaagcaggaagcaagcagacagctttggtctcattaatgcctattttcaagcagaaaacaacctcacctaaccaaagggaaagtgcgtggttcctgggttagggggtgttctatattgataaccagaatgcaggatgctgaatgagtgaaagtgtttgctgtacacaaagggatgggtggctgggtggagatggtgtcaggaggtaggaaagggtcagacactggtaaatatggatggaaaaaatgtggactgaatgtattttgaacaaatttgatcattttggggggagaaaataataaggataaccgcacttcaggagggaagaatattatgaactgtggattttgaatgcatttaaatatttatgaaaatattttctttagactttttttcaatattctggatagcaaagaaatgttctcaaactttatttcatttatttttgcaaatttctgctggaaggatttggcaatacaggcagcactgtactaggcttctcaaaacatagtaggttaattctcctgtgtgactttcatcaagtaacttatctttttgtgttttcaaccatgaatgtacttattattcaggctagctgtgagattaaacagtatatgctatttattcatttgtttagtcacttattcactcaacaaatatttatagagaggctaacgtgtgccagacacttcatagcacaatttattaattcagtgaatgtttattaagcacctactctatactgttagagcagtgaatataaatatattatagaggtctctctttttcaaatttctcattctctctgtgtcttttaaaactttacttttgatttctttatctagattttattataattaatttaaaaatctccttgaaagtaggcaagttatcagttatatataaataaataagacaatatatgtggaatcaatttaaaaagtgtaaatcagtgtatatatgtggagtggtgttactattatttatagtcacttatcacccttgatggggcaatgataaacagctcatagagaagcatagaatgactagatccccaccccctcccatagaaagtggcatagcaatagctggatggatcagaaagaatgtgacaaatagaaaaaaaaaagtttttcttccctctagtctgtcattccattttaccaaagctggtgtactttgggatagtgtgattgttaagcctccctgtgggttgcaagtatgcttttaactgtgactattgatgctgctgctacagaccccctctgattttcctttacgtgctttatgctgtgaagaggttttttaaaaagaaagatccatctctagctctctcccctttaatagggtagatcagattggttttgtagggctgagttttcaccagtactatagttgtactggagtcacatgcctgcagggagcccctgctgaattgtaaatgtgccaatccccagagtgtagctcagtgtacctctgcaagcagtcagtagtttttcattaagcagtgatttgattagataaaaataaaagttgcttgagcattcatttttgcagcagtgcataacaaatttatgcaaattcctgtgtcagtaatctgcattcaaaatataaaagtgtgattaccaagccatgtgcacctgtattgaagtttaatcaggtacaaatattaatggaaagaataaagcgtttaacaaaagtcacagctgttcgaggtttgtaaaatattgcaatgagagcgttagtacattaatgataattttagcattttcagattaagcaaaattttattttaaaggaaatcccaaataaggcaattctttagtggcacttgggaaatgcagagaaataagattgggctaaatgactcagctgtttaatagtgaaggtgtgatcaaactgtttgaaatatatattagagaacaggtatttattaagaattttaatgtattctcaaggacaactagaatgattctaggaagtaaatggatattttacacctagcatggtgtctagcatgtaatagatgctcaatataaatgtttgtaaaactttttccttcattcatgctgattcattgcgtaaatcatttaagatattgtaaaaggagtaatgtatcgacttccaagtttgtaaatgaaaggctgtgttttatattttacaatggtaagaaaacaaaacaataatatttattgaatgctaggaactgtgccggacacattacatacattcttttagttcattctcttaacaacttatatagtaatagcttacttttagagatggaggaactgagcctgaaataaatcaaatccatggccacaaatcatagctagtctgactccaaggtcctggtttttcctctgtatcacagaatacatattatcccataattatctcagataatgcatggttacttctaggagagcactggtgtaacttttggctacttgtataaaattcatctgataacctaagaatctaaatcagaacgccacaaaacttaaagcatgaatttccaaatgtagcaaaaatactatggtgaaggattgacctctgcaaatgtgatttttaaaataatattaattttttctcatctttagaatagtgatctgagtgacactggacaagagagaggctaaattgtgattttctacgtctctgtctcttacaatttgtagttgtatgggatgagtcagaactttttttctgaatattgttctttaaaattgaacataatcccatcttcattcatagcaggactaaaaactaaaaggtataatttaatgcttcaagttttccatcctgttcgtttttgggaatgaaagccccattcctgtttattttcaggggaaggacagagtgagaaagggggtcatttctgggcttaagtcagatgtggctttcgtgccttgatagaaataattcattcaattggagaaaaagtgatagccccaggattaagttattctgtaggccatagtggttcacagaatttggaagacctatatcaatccttagctcagaaatacagttttccagtccttagatctaacattttatccaggcatgcaaagctcaaatgatctggcttcaatttaccccttcagggatatctctggttagtctttacaacaaactgacactagccagactagtgtacttatcctttactgaaactttccttcttttctcatgtcttttttctccttttctgtcatgttttccctctacttgtctccattcctcactccacccagatatgaatcttttctttcaaggtccaactcaaatctcatctgctccatggagactttcttgaaacttcagctcaaagcaatcttcctttatgtgtattcctgtaacattctctgtctgtttcattgcctatgccttttcccttcctccttccctcctcccttcccttgcttgctttcctctttccttcaacaattactgagacagtgtctgccaaccagaacatatttgcttctgggaatacaatggtgcctcaggaagatacaggccctactcttacggaggtcacacttaaatgaagcagacaaccactgatcaaagaaacaatcaattgcttcctggaagtaaaagaatatggttcgaggagagtggatgacaaaggggccatatagactaagaaaactgacttagggaagggggacaggaaatgcctcctgaggaagtaataattaagctgtggtctaaagtttgagtagtcgttaaccaggctatggggtagagcctgcaaagagcattggaggcatgggaatggcatatggaaaggccctgtggaaagaggatgagtgtacttacatgactctttttttgttgttcatgttctctctcctcaaacatactgtacaatgcttttggatgtgaacgatgtgttgtatttatttttaccaaattcttttgaaaggactttaattatcattgagtgcaaacttcagcaggccctgagaaaagttcagtggtttactgaaggtcacacacatagagacatgggtctcctgtacaccccctcctcatgcccagtgttctttcattgaaatgattctttataattttgtgtaaatttagccaacatacatctggaataagtctctgcatgtggaagatggttcatttacaattggtaactgtgcggtcatgtatagaatagaggagagcaggaaggtacagaatcaaaaggtgtttcattacatggaaagttttataggacaaagaggtacatgttagggaggaaatttacatttgtaaaggaccatgctaactaagctttggaatgcatagggtaaggattcaatctttgaagaaaatctgtgtgaaataagatatgaaaaacattatgatgattagaattcagagagccttggatttaatcctgttccaaatacatttcttgaaactgaaagaaaaaaatgataataatttggtagtgctatatttgtgtgacaattctaaaatttggcctacaattttttgacatttccaaccactgacaggtatgggcttatgtcccttccacttgaatctagttgaccaaatagaatacagtgaaagtgacactgccagtttctgaacctaggtttcaagaatatggaagcttccacttcttcttttaggaagcttgctcttacaccctagccaacatgctgtgaaaaagccaaacttcccatgggaaggcctatatggggaacaacaatggcctcttgcccacagccctgggtgggattccagaacctaattatattcaatgtgaatgaaccatcttcagagtagatcctataatctttagttgagccaccccagcttagaattcagagagcagagaaaagctgtttctgccaagacttgccaaaaattgcagatttgtgaataaagtaaatcattgttctttgaagcaactaagttgtggagtggcttattcagcagtgattgataattaatagatttggggagatcattcagatctgctgagcactggaaagttagaaagatctcagttcttatatagggcccttcaattttagaaggagaaggcaaattgaggaaatcaagaacaatctgataaatggaaacaacaccaaaataaattcatcaatcagagggagcaattatggagtcccagggaaatataacagtaaggattttatttagagtgtgtgggtagaagatatagagaaactagataccaatgttaggattccaggagaataaagttaggaaatgtatgagaaggcataatttatttaagaacttagggaaaataggatagggccaaagaccaggtcaccagcagagatataagtactgaggtccttgaatatctggctgcacctggtagtgtctcttcctcaacctgactctggcttgaagtttagcccctgcatgcctagcccatctgcttccctacagggtcttgacacatactatgccaagcaccttgggggcactgagggtttcagtttatagtccatgtatctaaatttgaaaattaatgagaagatggtgaatagagtcaatatatttcaaaattgcatgtcagatatggaaataaagtttgaacttgtagtttaattatacatgtaattatctttcatttacatgcaatgtcaatttttccatgacctacttataggatgaagatgaactcatgtaatttagagttagagttgaccataaaacaagtctggagaagaatattcttagcttagaaagggtggaatatatgttcctttgagcttttgggtgaaattgtcatgactgaaattataaattaggtaagaaattatgccatgtctggtaccaagtagttcctgcctttgatgagcctatttatttcaatgggtgaatatatgtaatagattaagacaattgagaaatggataatgtataaatgcgttactgtaaacaaaatggtttcatgtttgatggctactttcatgtttgattaagttgggccttgggacatacaaccatttcatttctcataggtttaggaaagtttagtgttagcctgataggcaaaatggctgactgactaggaaaaaggcaatggaagatataatttttgagagtattttggaagaattgattcttctgagaactggatgatatttatacttttctgaggcttgctcgctagtgcaagtgctattctaaatggagtgctttgcagattccagacatatgccacattcatgttgtctagatgatgaatgacttattgatagtccaggctttgtactatttgagatggtagttcttttaatagccatgatgtcattgagataaaacttagtgggatagatgttattaatggtcaccattcagccttttatttgcaatgaagccaaagggcagttggagggggatgaggtcagcctgaatcactgattcccttgaagtcttctgtgtgttcccattttgggatcctgtgaaaaaacagaagccaaattgaacaccaccacattttggatgagtttccatttgaggagctccaaaaactcccacaagtcagattcagaagagttttcaggagattgccaaagactgtgcagtattgctggcaggaatagaaacaacaagcagatgttttagcagagtggagcccattctgagagactattcccgggcattcaatgaaagagactggagaggaggttagttcagaacaaagatgagagagcctgacttgggcgtgcacttgcctaaaaatagacttacaaatttaagagttccaaagcccctaaagtaacttcagatggatatagttgctaattaatctcttgaacttcacatgaaaactccatctggcactgtaatcttgtgacaacttgctattgttgtggtattggtttaatttggtttggctttcttcttttttggaaacacacttctccctgtgcttatcacagtttttaaaaacccaaattaaaaaaaaacccaaatagttaaaaattcatagctgctttcatcaccagctggttgcatgacctttgataagtcgccagattcactttcttcatatataagaggaagaaagtaaactagatggtattttaggtctattccaactctacaatcagttaatttatttgaacacaagctacaagattatgagcccgtaaaaccaatatttataaattttctcttcatttctgaccactgatgaaaatgggaagaatatagaattcctctacaaatggcagattaatcactttaacagtaagacagagctctgagggtgaaatttgcatgtatatcataactcagagatgtatttgttcagcaaatatttattgggcacaaactatatgataggtgctgtgctaggtgctggaaattccacagtgagaaaaacatatggttcctgccctcagggagtttaaaatctagttcagaaaaaacaaatattaaatactgtaatcatataattataagtgggactaagtgctaaggaaatgaataatagtgaacctggcctagtagggaataggggttagaatgaggtcatggaagatttgtctgaagaacatattccaaagtattacagtacccagtaccaaagaagtccacatggcagacttcattattgaaccagttgtttttgctctgttctatgactctaactccaggcagcgaaatcaaaatcctcactattagtccaaaatggacttgggctagaacaagtagatggatcagggaaaaccactgtttatgaacagaaacaaaattcagagaccacattatgtcatagcattggagggaccttttgtatgccagggttaatatgaatgcatacttattttacattttccacaaggagcataagatatattataatcttatggatgcttgtgaactgaccccaggagttatgatctgtgttcaaatctcgttatttaacctttctggaaaatatgagaagtaaatgaggtaatccatgggaagggtttagcacagtgcctgaacctagtaaaactcaataaatttttctattgttgttcctgttagtatttaacaaaacagcaatcacccccatctctctctttctgagtaatacataagaaagttaccagtttccaaataaccattcttccttatacttcctatcctgaataatgtaagttagcttgatcaaggaaaaacaggggttgaagcttctagggcttcctggaaaatttctatgggatgggggcaattcttgctatggttttgtgcagaaagaggctgaaggtaattcagagggaggttataaactaactttaaaggcactggagttgcttaccatttaaaataatgttgttttggtggtggtggtaatgttggcgtgagagtgtgtgtgtgtgtgtgtgtgagagagagagaggctctaattgattttgaaaaattataaaatgtatattcaattatcatttcttggattttgaaaaattacaaaatatatatttgattataatttcttggagttcataataaatagggttcacttattgtgacaagggccccactatccttctttgaaattatggctataatttagtttcctagtacaagctttgctcatgttaccttctcagtatgtaatcactcatgatggcaatcatctatttgagtcatgtcacatggtttagtggtgattgttactgtctgagaaaatatttagcatttagctaagtatagttctttctaggtatactatgggcctttgttaggtatactatggagcaagtaaatgtaacttaattgagttttctccctcaaagcaggtgtgggtgcgttttcttggtgtaggctcatgatcaccttcgttatctgcagctttgctaccaaatacttctctttagttcttggttgaacatggttctgtattccattgtgaaacaggggatctttttttgtggggggaatgcttgtgttctagcccttcagaattgtgtttctcctgcacagaccccttgaccaggtcatggtcttttcacatggattatggttataactttgctcatgtgccctgtatacataaaatgatttcccacccaaactcttctagcctagatacattcatcctagatgcttttactctatcattcaagttcccttcctggccagagtccttatcaataattcttaggctatactgggcttgtctacttgagtgtaagtttctaaaaaggaggccccacaatatcttttttttttttttggagagcccccattctccagtcctagcacatagctgagctctaagaagatgctcaacaagtacttaatgacttaaatcctatcctctgagacatttcaacataactcaatgaaagatcagaagaaacaatctacacgaggatttgtatcataatctcttcacagttatatatatatttggggagaggaagaagagcacattatagatccttatcagccatatccagagaaagctgttactttcttctgatcaccaaaccaagtatgggacctcagacagagctgggtttgaggtactctaaggtaatggaatcagtgtaaacactatctaaaacatccgagtatttttctttggtcctcacacctcaggattcctgaataacttatgtactaaaaatcagaaggccagaaaaattgatttgaatttattgtccagtgaacttgctttttgttaatttaagggcagtagtttgaagggtaagttttcctgaagactctgcattccttgacctaaagtctccattaggaacataaacaatacgactgtatgtactgtgttttgaaaccactataaatggctctaatgtgtgaatcaggttatagtttaatttttctttgctggatcagaggcacttgagaataaaacatatgcagctgcaggatattgaaatatttcatatgcatatatatgcagcatattttctagggaattttaccccttagcaaatctagccaattctttttcaattctatgacttaacattaccttttctttttgtttttattagcgttcaggttttagactatttgtttccacaaattgtattttattttggcttaataaataaagaaattgagttacttcaaagtacgttgtggatgtcatttggtagcagtggataaatggaaagttaaatgacttgctcaaggtccaaaagaaagtcagcagcagggcagagacaaaatttctgtcctttttgccaattgcctgtcagattcactctgctaatgaaactttttgcaacagaacagtcttccaatgtttccaaggagccagttaattaaccaaataaagagaatgatcatagcgatttttaaaatgtccatctctctcacatttttcccccaaatttcattttgagtgtggatcaaggaggtggtttttacaatttaaatatgattggcaccattgctgttaaatgaaaatgtggctactgggtattgaaatatattttttaaaattggtaatcaaaaaccttgttagcatttgtgcccatctcatgagaagttcatagtgctttaaaattaacattgattaaataatgaactgactggagagagaccatttataaaattggagatagggattagaggcagttgtggcaatttctctgccaggctaggaacgctcattaatgagctaagagggctggagaattcatgaagggcagtatcacagatgattactcccattacgatgaaattggtaggccaatggatatgacaatatgatatttatgattatatctggttatattattgtagaagttaaatctttctgtatggaaacagtttagcacttataatgtgtttttaataaaatactcgtgtgcaatggcattttataggaattgtaaatgttaaccagtagactgaattggataagaaatgcaaaggcagattactttcaaataaaaaggggtagagtgtcaaatatgagtttcattagctaattggtaatataacatgcttgtttcccttgagcacctgaaggccagaccaagctgcagaaatgttgaggtttaaacaagcattgagcatactatgctttacagcctgagtgatcacaagggttaggaaaccaggacacaatctatagtctcaacaaatcatttaaagtatcattgcttaaaagctcacctaatgtttgatttttccttcccacaatttatgtgtttattccaaatctaaccaaatctctgaaatgatcaacaatatcatactcacggtatcttgtaatagatgcaatattctgggcagagagtatcacaataatctcttctatctggaattacaagggaaagttatggactgctttcccagaggttgcttttttcactgatcttgtggcaaccctatgatacaggcaagggctattatcaccattttgtaggctaggacactgaggctccaagaggtgggaagtaaatgacagagtcaaaatgtgaacctatcataaaaacaaaaaaaaatccccaaactcgtcaggtactatgcttagtacctgagtgacgagataatctgtacaccaaatccacgagtcctgagtttacctatataacaaacatgcacatgtacccctgaacctaaaattaagaagttaaagtttttgagaaatgtgaacctagatgctctgcccccaagttcagtgtccattctatgatccatgaatgacacaaataacagaattgtagttaaaattctcaagtgaaagttgtgtcagaacttcaatttagagtccttttagatttttgttttcaaatgtttgaaaaaggcacggtctgaaaaataatattggtccccctaagtccccccaaaactgccccagtaggactattataaggccagattactagactagaatttactgggattactttgtattaaacccagagcaggtagaacttgatttaagtaaatgcaatgtaacaaaacccaaatttacaacctagataatataccaaagatttgctttaagtgacaatttcacttgtatgttttaatcagtttacaaaaatggataatccatctctggggactttgagggaaacacacatgttatgtaaagcggaattaacctatactatgcaagagtcatgtgaaagtgacaggttgttgttcaaactaaatcttacctcctgcttgtgtgattttttttggtatatctagagtaatatagcactcttccctaatattcatccactggcatttggcatctagttaattacaaatgattgtagatttttattattgaaacagcatctaacagatttacttgtgtgtgtttgtattgggatgtacaaggaaatgtgttgtttcgaaggaatgtaatgtgaggtgtcaggtgacaaagatgctttctagggcttttcacccaacttgttccttgttcaagataacttttatttaacttgcctccaaatcaagccctgaatatcatgcaacacaacagagagatcttctcataaagtagttgtcttttagactcatcttgaagtgtatggagtcattttaatagccatagggagttgggcctagtcccagcaaatgcccagttgaaaattttatggaagatggagtaagtctttttttgttcattgtactaatatttactgagcactcatatcagacactgttctaggtattgggcacataaaagtttaaaagcttggaaaaaaaattctgccctcatgtcacttacattttagtggaagaaacagaccattaccaagataaatatgtagaatatataaaacctgtacagagtgggaatgatcaaaagaaaaaagtgaaggaaggagattgaagtgtatggataaagttttagttaaaggggccagggaagacttcactgaggaggactcacatgaaggaagtgaaggaactagccatgtggatatttgggggaagaatatttcaagcagtggaagcatcaagtgcaaaggccctgagacgagagcatgcctggggtattagaggagaagcaatgaggccagtgtattcagaggggaatgaatgtaaacaagaagaaaagatgaggtcagagaggtaatcgggtaactgggtaggtcctggtaaaaatcttggtcttctatccaagagaaagagagagagagagagtgaagctctgacttatgttttaacaagagcattcacattgcaatgattgcaatagactaaagaggacaagagaagaagcagagagaacagttaggaggctactgcagtaatgctagtgaaagaagatgatggttctagatggtaataatcagagtagagctcttaagattttctgacagactgaatgtgggatatgagagaacaaaaggaatcaaagttttggggctgaatgcctacaaggatggcatttatgtgttagtgaaatggggaaagctgcaggaggagatttgggatgtgacaaacatcagagctctgtttggagtatgtttggtttgagttgcctattaaacgtctaagagaattgttgtataggctttaaatgtatgagtctggattcaagggagacattctgggtggatatgtaaattggagacataatcacatagatggtatttaaagccataagattgggtgaattcacctagaaattactacatatagacaaaaggaagatgtctggtgacatgagaaaaagattttaaagtagtatgcatataatgttctcttttcttgggaaaaagtgcttatagaaagaagaatggaaatatgtttaccaaaatcatctctgggtactaggaatattggtgattttcattttattattttatgtttttccatatttcccatattttctttaatgaaaatggattgcctttataaccagaaagcagaataaaacaataaataccattaagaaaagaagatttttatctagagttgttctccaatgtctaaaataaaacatttgtttgtgtacagtcccttccacatgcttacatcctcagatacccacagtgaacatgctgaaaaaaaggttatttgaatcaaattacacatgacatgattgggacttgccatcaaggactgacaatacagatgtttctgtccttacatggagttgaattaatagaactagataaaatgtgcctggacggtaaagaatatgaagacctggggacagttaaacccaacaggactacatccagccagaatagattgggacccttggggctgagtcaaaaatcacatcctttgggaaaagagaattaattgaatgcttgttctactctcttgtgacattcttttccctgaaggccttttgccttctttttctagtagctcccattcagggaacagggtatctgctagttcagcaagctactcttaaatgttaataacttattcttggccaatttttcacacataggaaagtgtatcatcttatcatgttgagttttaaagatcatataatttttttcttttgaacatagaagctctaacacttctctttgcattctcttcatctccccatttgattataataaggattaccctcccccttctctggtggtgactcagacatagctaaagggggcttttctcaaacttcttttggaaaagagaaaaccgtcagtgtttggcttgaggacaaaccgagaatattttagctaagatgtaggacggttgatacagttatgagtgactgaaaagggaattgtagtggaaaagccatttgcgttttgagctatggcatttgctactgtgttagcactttgttaaaagtgtgtaaatgcatggtaagttttttaagcagaaacttggaaaattggtacagaaatttatttttgcatatgcttgcctttccattaagcagtaagtgtaatcctctccctgatgatctgatgatctactttactttttccttttcttcctaagaatgccgtgacccaattccaaatgttttgttgcacaaatgagctatgttactccctcttctggactccaaatgtcagaccaggctccctccaatattctatgaattttggcgatttttgaaatcaaagttagaacagtagatataatctatattcacccccagcctcctgctgagacatacataccacatacacacgtgtgtacacacagaacacatgttgaaagaaagaaacttctacctttgtcttctactcttaatagcaaagattgagtcctaagacggcccacacttatatatgaatttagatcaacaatgtaatcaaaggcatcaaattgtaaacattctgcctagaactggacttgagatcttacagaatgaatacaggtcttggagttctgagatctgagtgtaaatcttgcatctgctacttgctagcagagcaaccactgacaaactacttaagcatttatttaattctaaggccttacatacttgttctgatggcaaccagtatcatgggggttgaagttagacctgattcaaatctactacttggacaatttgggttaagtgatttattgctttagactctgtttcattgcctatggaattaggataatacctgctttttcagggcttttgtgaggattaaacaagaaaatgtatacaatatgtctaggagcagcatttgggacatatggtatattaaaaattctctcattattattgttgttgttatttctcttcttagtagcacaaatattttcttacctgtgaaaaccagaggctttcactaagtcaagccaatagcaggagaaaaaaggtagaatttctcatttttcaatttttgtggatacatagtagatgtatatatttatggaatacatgagatgttgtgatacaggcatgcagtgtgaaatactcaactcatggaaaatggggtatccatcctgccaagcatttttccattgagtaacaaacaattcagttacactctttattttaaaatgtacagttattgttattgactatagtaatactgttgtgctatcaaatagcaggtcttactcaatctttctaactttttttgtgcccattaaccatctccacctccctcctatcccccacaacacttccttgcttctggtaaccacctttctatgtccatgaggacaatggttttgatttttagatcccacaaataagtgagaacctgctaagtttgtctttctgtgcctgcttatttcatttaacataatgatctccggttccatccatgttgttgcaaatgatggaatctcattctttttatattccattgtgtatatgtgccatatattctttatccattcatctgttgatggatacagatcccttccaaatattagctattgtaaacagtgctgcaacaaacatggaggtgtagatacttcttggatatacttatttcatttcatgtaggtatatacccagcagtgggattgctggatcatatggtagctcaatttttagttttttgaggaatcttcaaactgttctccataatggttgtactaatttacattcccactaacagtgcagaagggttcccttttctccacatcttcaccagcatttgttattgcctgtcttttgggtataagccattttaactggggtgaggtgatatctcattgcagttttgatttgcatttctctgattatcagtaatgttgagcacatttttatgtccctacttgccatttgtacgtcttcttttgagaaatgtctattcaaatattttacccatcttttgattggatttttagatttttttcctatagcatagtttgaactccttctattttctggttattaattgcttgtcagatggatagtttgaaaatattttctctcatgatgcgggtcgtatctttgttgattgtatcctttgttgtgctgaagctttttactgcaatgtgatcccatttgtccctatttgatttggttgcctatgcttgtggggtattactccagaaatttttgcccataccaatgtcctggagagttttccctaagttttcttgtagtagtttcatcgtttgaaggcttagatttaagtctttaatccattttgatttgatttttgtatacagtgagagatggggtctactttcattcttctccatatggatatccagttttcccagcagaatttatcgaagagattgccttttccccagtatgtgttcttggcatctttgtcaaaaatgagtttgctgtaggtgtgtggatttgtttctgggtgtattagtctgttctcacactgctaataaagacatacctgagactaggtaatttataaaagaaagagatttgattgactcacatttccacagggctggggaggcctcaggaaacttacagtcatggtggaaggggaagcaaacatatccttcttcacatggtggcaggaaggagaagtgcaaagcaaagagggaaatgccccttacaaaaccatcagtctcagaagaactcattcactatcacaagaacagcagcatgggggtaacagcccccatgatttaattacctccccccaggtccctcccatgacacatggggattatgggagataaaattcaaggtgagatttgggtggggacagagccaaaccatatcattctcctccggcccctcccaaatctcatgtcctttcatttcaaaacacaatcatgcctgcccaacagtcccccaaagtcttaactcattccaggattaacccaaaagtccatgtccaaagtctcatctgacacaaggcaagtcccttccacctatgagcctgtaaaatcaaaggcaaagttaattacttcgtagatacaatgggggtacaggcgttagataaatatacccattccaaatgggagaaattttggccaaaatgaaaggggctataggccccatgcaagtccaaaatccagcagggcagtcaaatcatctccttctctttctcctccttctccttcttctccttctccttcttctccttctccttctccttctccttctccttctccttctccttctccttctccttctccttctccttctccttctccttcttcttcttcttcttcttcttcttcttcttcttcttcttcttcttcttcttcttcttcctcctcctcctcttcttcttcttctttttttgagacagagtctcactctgtcacccaggctggagtgcaatggtgcaatctcagctcactgcaacctctgcctcctgggttcaagcaattgtcctgcctgagcctcccaagtagctgggattacaggtgcccaccaccacgcctggccaattttttgtatttttagtggtgacagggttttgctgtgttggccaggctggtctcaaactcctgacctcaggtgatccacctgcctcggcctcccaaagtgctaggattacaggcatgagccatcacacctggccagggaggtcaaatcctaaagctccaaaatgatctcctttgattccatgtctcaccttcatgtcatgatgatgcaagaggtgggctcccatggccttggacagctcctgtggctttgcagggtacagcccctctcctggctgccttcatgggctggcattgagtgtctgtggcttttccagacctacggtgcaagctgtcagtggatctaccattctggtgcctggaggacagtggccctcttctcacagctccactaggcagtaccccagtgggaactctgtggcagctctgaccccacatttcccttctgcacttccctagcagaggttctctatgggggctccacccctgaagaaaacttctgtctggccatctaggcatttccatacatcctctgaaatttagccagaggttcccaaacccttcctgatttctggtcaagaaggtttgagacttgcaccctctgaagcaacagcctgagctctgcattggccccttttagtcttggtgggatgcaggacaccaagtcctgagactacacaaagcagcaaggccctgggcctagcccaggaaaccattttttcctcctaggcctctgggcctgtgatgggagcagctgccatgaagacctctaacatgccctggaggcatcttccccattgttttggcaattagcatttggcttcttgttacttatgcaaatttctgcatctggcttgaatttctccccagaaaattgggttttcttttctcctgcattatcaggcctgcagatcttccaaactattctctgtcaccttttgaatgcttttctgcttagagatttcttccaccagataccctaaatcatctctctcaagttcaaagttccacagatctctagggcaggggcaaaaagccaccagtctctttactaaagcatagcaagggctacttttgctccagttcccaataagttcctcatctccatgtgagaccacctcagcctggacttcaatgtccatatcactatcaacattttgttcgaaaccattcaacaagtctctaggaagttccaaactttcccacatctgttttctgagacctccaagtctctaggaagttcaaactttcccacatttttctgtcttcttcttagctcttcaaattgttccaacctctgcctgttacccagttctaaagtcgcttccacatttgagggtatctttacagcagcaccccactctctgcaataccaaattactgtattaatctgttcttgcattgctaataaagacatgtcccagattgggtaatttataaaagaggaggcctcaggcaacttacaaacatggtagaagaggaagcaaacatgctcttcttcacatggcagcaggaaggagaagtgccaagcaaagagggaaaagccacttataaaaccatcatatctcaggagaactcactcactatcataagaaaagcagcatgggggtaactgcccccatgattcaattacctccccctgggtccctcctcccatgacacgtggggattatgagaactacaattcaagatgagatttgagtggggacacagtcaaaccatatcactgggttctctcttctgttccattggtctatgtatgtatgtttatgccagtatcatgctgttttggttactattgctctgtagtataatttgaagtcaggtaatatgattcctccagttttgttctttttgcttagaatagctttggctattatgggtcttctctggttccatataaattttaggatttttttttctatttctgtgaagaatgtcattggtattttgatagggatggcattgaatctgtagattgctttgggctgtatggacattttgacactactgatttttccaatctatgaacatggaattttttttcattttttggtgtcttctgcaatttctttcattagtgttttataattttcattatagagattttttacttctttggttaatttctaggtatttaattttatgtgtggttattgtaaatgggactacatttttatttctttttcacattgttcactgttggcatacagaaatgctactgatttttgtatattgattttgtatcctgaaattttacttaatttgtttataagttctaataattttcttgtggagtctttaggtttttccaaatgtaagatgatatcatctgcaaacaaggataatttgacttcttcctttccaatttggatgccctttatatcttcctcttgtctgattgctctatcatggacttccagtactatgttgaataacagtggtgatagtgggcatccttgtcatgttccagatcttagaggaaaggctttcagctttttctcattcagtatgatactagctgtgggtctgtcatatataacttttattatgttgaggtatgttccttctatccccatttttttgggggtttttatcatgaagcaatgtttaattttatcaaatgcttttacatcatcaattgaaatgatcactaggtttttatccttcattctgtcgatatgttgtatcacattcattcatttgcatatgttgaaccatccttgcatcccagggataaatcccacttggtcaggatgattaatttttctaatgtattgttgaattcagtttgatagtattctgttgaggatttttgcataaatgttcatcagagatattggtctgtagtttttttatatgtttttgtctggttttggtatcagggtaataatggtctcatagaatgaatttggaagtattccctcttcctgtattttttgtaatagtttgagtagaattggtattagttctttaaatgtttgatagaatttagcagtgaagccatcaggtcctgagctttttttgttttgttttgttttttactgggagactttttattatggattcaatcttgttacttgttattggtgtgttgatgttttgggtttcttcctggttcaatcttggtaggttgtatgtatctagggatttgtccatttcttctagattttccaatttatccaaaaaacgtttgaatcttctatattggtctgaattttaaaagaaatatcctgctgagcttttgtctaaataagaattaatatgttagtatttctaaaatgttccactttgtgcttttcttggtatggattcaagtttatagtggtaaacacatataaataaaggctgctgcctcctactctcctttatagagccattgtgaatggttaataagggtgattaacccttaaagacacacacaatgccccagcattttaaaaataacttgtattttagatttatctctggtctttgtgggagaaccctatgactctctcatgaaatacattttgggagtgaccatttacttgcactagtgagaattagagaccatactttgttttgtggaccttttcagctgtagtcaaagtaaaatgactgcagtgtcttgagtagaactgaaaattgaaagtacctgcatcagtggtattgatcctggaggacttcattcctcatacttccctaaaatatttgtcctctgtttctgaatgacagtcagggataccccctgaaaaatgctgcccattgagcatgggatatcatcttgatgaattatttcaaaactctatcaaagtgttttccaaatatctagtgatctaatgaggccattcaggtcctgattttcatccaggccttgtttttagatattagctgggaaaagtacagagtgaagactgactgtctgcattggcacagtcagagggatcttgtggctcagcagttattggctacctaactggaaatcaaaccaatatagcactttatcaagtatatgtagtagtaaccacaaataagtcaacattttattaagaggaaaggggttggggaaacaattggctcaatttgccttactgagatatagaaagcctgtcatagaggacctcttctaaaatatcaaggattcaaagccatcacttcaaagcttaaaagatttaagggaaaagataaaaatcctatgacttcccattggaataattcctggctggcctgcctgcctgcctgcctgcctgcctgcctgcctgcctttcttccctccttccctccttcctccctccctctcttcttcctttccttcctatttatatcagatatagaaattttccttgcaggttctatcttcattgatttctgtacacttttcccatagtatgacaccatcatcatgattaacatcattggatacttattatgtcctagacactgttctaagtaatttgcacatattgactgacttattcttagaaacctaaggaaggtactattcttgtggaggcacagagacacaatgtgcccaaagcttcccagctagtaaatggtgtagccaagattcaaagataaggaatctggtttcagactctgtgatgataactactgtgctattaactaccaacctcaaaagtacacatgaaaagatgatgcaaataagccgttattgttaggccaaggttcgtttctatttttgctttgttttttagtagtgcactgaacaatcaacagtctctcagatggcatttagctgtcccagtttacacatttgcagggtggctggccagtgcttaaggtgtgacttggaactgatgtggctggatgtcaaatcagtgaccttggcagatatttggatggagaatatttgcttgtcaggtgtaccctgtttgcttttcctccacagggttcatgtagaagtttccatagtgtaagacacattctccacttttttcctgaaaacctagtacatttcaggaaattagaaccagtgagtttctgggggccatccatcaggtgcaatatcaggtgctgatttgtcactgactggcaggctctttcccaattcaaagcatgagaggactccaaacttctttttgtggttggagtgcccctggaagttgattcatgttctcattgcaatttattttacattgcatcttggcataatgactttgactaaaagggatattttctgatgtctctgctttaatttagaaataaccaaactgatttttccaacatatctccaaaactgaagacacatgtgcctaggaaaacaggggtttctaatgaaaatgctgacacaatctcatgaatgctgaggtttttaacagtctgccattcagtaaactagtatttttgtgtcctatgaaaataccaaacatctgcttgcaatgagcgtacttaacaccttttgggtttctttttagctaagctgaatgcacttgggaatgagtgaaacttcagataacaccggcaaaaagtttgaaataaggaatttttatttgaaaaccattttgtaagcataatggtacccatagtacaaattacaaacaccattcaaaacaacatggtagcaagatgttttcaaatggtgcaaagtccctgctcacaggtgtgaacgccagcaatgggcctgtcagctaaggctggttagtagaataagtggcaagaaggtaaaatataattgaaactaagaggcaaaactttatattccagggttcaaaataaaggacaggaatcagaagctaaagtgaatgtcaaagcctaggtagacacagtgggacagttggcaaaagaaaacttaaagtatgtattttttaattttaaaattctttatttttaattgacataaaattgtattttacatgtcaattaaacaattttatatgtcaattaaaagtaacacgtacaacatgatgttttgaaataggtatacatcatggaatgtctcaatttagctaattaatacatgcatcacctcacatattattttttgtggtgagaacacttaaaatccactcagtgattttcaagatacaatatattgttataaagtatacatacctggttgtacaatatatctcttgaatgctttcctcctatctaattgagaaaagcatgtgtgattattagagttgcctaactagtcttcctgcctcaaccctttcccccaccctaattattttctacattgctaccagaatctttcctgaagaacatatcaaatgatgcctctcccctatagtaatcacctggaaacattcagtgattccctatagtatactgaaaaaggtttaaacttctttaagggttttcatgattgggacccaaactattctttcagccttctcaaacactgtttatatccctggacatctgatacttatgctcagtggttctaaattgggactggtggcatttggaattccgttgaggtgttttgggttgccaaaacaggtgaagaataatatgggtatttagtgatctggagcaagggatgtcaagcatcttgtgttgagcaaaacagacccttaccattttagacttgcccgatcaaaatgacaatagcactcttgttgagaagctgcaagtttctagctaaactggattgttttcagatcttcagagatagtgcatgctttcctagtaatgtacctttgcttctgctcttccttctccttgctatgcttgcctctttattcattgttacctgttgcattcccatcgatcctcagggtctagctttcccgaggaattcattcttctttcctaccagagttgctgagcatactgtggtatagtagaaaaagtagtaacatgagaatcaagacacccaaatctttgccctggtactgccactcaccaattgtgtgacattggcaagtggtttttcttctctgagccttagtttattcatccataaaatgagcaggttaaaaaaattaggggattgaactagatattccctaacattccttccaggactagttttctatgggccccttatcacctatctcattttattttaatcacagtctaggatgtctttagatctctcaacatagcgtcttgtacattgtgtacctcaaatagttgacctgattggttcagagggctttatattccttgccttttgttgaagatgacactggccattgatgttgtaacattgttgtgctcaatccagtaaatatatatgtatgggctaaaagaatggcagggaccagttttctaaggtcacttaataagacaaggaagagccatgttgggtaattaatttgttgggaaattactaacattacctaacctctacagaaaagatcatacacatttaatgaatgtaaaagaatatagtaaattttaggtttttgttacatgtagaaaagtcttctctgacaaagtagcagtaattatgaaatatatatcatgtaggtttatattcctgtggcctgcaacaggctatttgtcttaaaattagaagttttgtaggcttcaaacgtgttcaactggcacttgccttgatataatagttcccttagagattggttggaatcacatttatgttgtccagttgtgtattcacaactgtgagtctgcattatgatgtatgggcacaatgctcagtacctagtttgcataatctttcccagatgcggggtttttcttaagccttcttaaagggctgtcactaaacctaagcatcatggcttggtttctatttgaatctgagaactgcctcagctgttaacttggtgaagccaatcatgttttcagctggtatttctctagtgttaccactttcacagaaaggtttggacacatgctgtgtcattaatgcccagttttttcctttctttttagtaagtcacataaatgtattacctgattgtcatgacatctaggatttttttttgtcctaggcctatctaccttgaagcaaaaaaggtgaattaggctttgatcacctcctcctccagcctaggtttaattagtgacctttgaattcacggggcccctgttttctccattgctgcctgctcccagaataatcttagcccttttttccacattccaagccatgttttagaaagttaataatagcacaacaaacatttccatagcatggtatgattctgtgtacaggttgctacatattatattcagtgaatgataagtgctaagtaagaataactcaaaagaatgagagatgtaagtcatcctatgttctagtttgcaacataaatccccaggaagcttgatgtaatgttcatcaccaccaccacaaccaccacccccatcatcatcatagcaactacaatttattaagtatttgctctttgtcaggcaacatctataatataatttaaatatcaaggcaactatattagttagattctattatgatctccattttatggatacggaaactgagatttagagaacttaactaatttgtctaaagtaatacaactagtaagtgtcagagccatgatttaaagcgagagtctgactccaaaacctgtgccttaactattatgctggactgcattctgttatagagaggaattcgttgaagagactcacttattttttaacttttatgttaagttcaggtgtatatgtgcaggtttgttgcataggtaaacttgtgtcatgggggtttcttgtacagattatttcatcacccaagtatgaagcctagtacccattagttatttttcctgatcttctccttcctcccaccttccaccttccaataggccccagtggagattcacttattttgatgaccatccaagggagtgaatacttctaaaatgcccagataactcattcaaagatggtctatttcccataaattccaaggaaaatgttctgaaaaggatcatgtgtattttgagcttctttttaaaacctagggagaaaatacaatatccccatgatccctgcttctttctactctgtctttaggttttttcatatcaaaaatgctgcaacctgaaggaactctgggctgtcggatctcctaaatttaacttttaaacctaagttgtaatcagcatagctttactcccacataccttctattttaccagccatatctcccctccagcagagtatcagcaccagggatgttgggcagaagcccagtagggggtggccccagtgttatttattgttttataggctgcagaataaagtatatgtgataattgatttactcttcgtcagcctttgaggctgataactcaattagcctgtcagatactgactgtgtatctttttcaaaaaaatcctcaaaggtgattttgtattttgtattagataaggtgtgagaggtattttttgcttatattgtattaaaagttcttattttctctgacgatcagcagcagaacaagcagtgttaccataatagttgggtttttttcttctttttaatctgtgtgcttcaagagagaatgatgatattttgaagcaggcacataaggaaataaaaatttaacaatctcaggtgaaataattttgatttccagtccccagctgagagagagagaatatgtattcagctgattggcagggctgcttgtgctcagtagcacaaattgctggattagagaaagggccagaagggtggtgagggaaagtctggtccatggctgagttatgattttaagacagtagattttgattgggcataatgatcagaaaaaaacttttgagtgcacaaacctctgcatacatattatgtacataataaaacacaaaaatgttatggacactaaatattttctttctatactctatggatgtccttttataaccacagggtacatatatccccattttgaagactactgacctaggagttatactttgtgtgaccctagaagagtctattagatggtctggacctcagtttcccatatataatataagagggatgggctaaaatacagtttcaagtttcattttatgcacgggtattcctatggactttagcctttctttcaggatgaggttttaactgctgttttggaggcattatgagccagattattactgaagaataaggataatattaattgttgcaattagtagccctcctattgcatttgtacattcacatttatatgcatgattatttcaatgtggcaaaaatacaatttactaagttaaggcagtatcacaatttgttttccctatgtgctttacgtatttccaccctatcttttaacaagtgatgttttgttaaaccactcagatatattcattgatacagtggttttaacaatggaaatttatttggctcagacctaaagcctttatataaaagttagtaccaaaattcaataaataaagctatcggttatttggttgtttattggatagagatcaatattgccttgttaaaggtaatctgagtgttagaccagtttgtatgatccatctttgctacaatttccacatgtttaaagcacagagatgtataattgttagtttgtctataaaatcctatgtatatattaaattgtctaaagtcatataaaatcataccctctagaccatagacaaatgggaaatcttctgtgtattttgatatttaagccaagttcattccacttgtgttattgggtaagttaatagatcatttcttattagagtttttgagttagggagacttaaccctgcctttcacacatccattatgaagacattgtaaaaatacttcagggtaccacaggaagtacaattttttctttttctttttttttgagacaaggtcttgctctgttgcccaggctggagttcagtggcacacacacagctcactgcagcctcaacttcctgggctccagtgatcctcccacctcagcctcccaagtagctggggctacaggtatgtgtcaccacacctggttgacttttaaatttttgtagagacagggtctcactgtgttgcccaggctaatcttgaactcttgggctcaagtagtccttctgcctcagcttcccaaagtgctgggattacaggcatgagtcaccacacctggctaaagtacaactttttagtctttgaaaagtaaaacatatttggatctatgaaatcaagaaaacaacttaatgtgtgtacctctccccttctatatctatataataatattgttatagtgtagttccattcagttattttagtttggaatcatgctttttattgaaattgttggtaattttatttgtatgtattaactgaacattgattattttgctacccagaatctattcacctttctttttgaaaccacacttttatttcctttgtagatcacccctccccacacccagcccacgtgcttaccataggcatatgaggtaggcctaagccaattagagccttacatttccataggcttcaatgattaatttaagggtgggcacattacccagttagagcaaaagagatacaatgaaacttcagtggacacacctgggaaagaagttcgtgctgttgtcaataaacttggagttatgtaaatataacttctggagttgctacagccatcatgtgaccatgaaagacaaatctgaaatggatgagagcagaggttaaattgaaagaatgagggatgagatctttagccatccaatcagacctatttaactggaatttttcattatgtgatccaataacttatcgttttgcttaagccacttaagggttctgttttctgtcacttggaactggaagaatccatttgatcatccctgtgcaatcttaggggaaggcatgggctttgtataactacccgtagtgccaaatctttcaacatggaaggagagaaagagacagagtgaacaaacatattcaggcgctttggcctgaattaacggaatgggtagaagtgaggcatattttttctctttaaatggtagtttatttcacgtttgtttagtgatgcattatgccacgctctgtgccagacacgacattcagaggtgaatgataattcaactctgaagttcacaatgaagtgggagattattccaatacaaggaacactttccagggtaacgggaacatatccaagagacatctaactaggatatgagacttgaactctgctctattgtgtcaatagtaggcagcgaagtggagaaggccattgcaggcaaaggaaataacatgagatatattctttaagagtccctgagttttgagtgccttatgtagctactggcaattgtagtagggatttatagtggaagaaagttttgtgcatgactaagtagtagtacttgggtcactgagacagcaattaaagggctgatactcctatttataaatgataccagtgcctagatctatgtctgaatgatagaatgtggatttagcttctccctagaatccaaaccatattatctgaatgcatgtttgtgcctcctgcagagtgccagtgcagcacaaatgatataccagagacgtgatctctatcctcaaggagggcaaaatctgaaatgcgccactttgataggaagcagaagagtggtgggatcgaggctgcaaaatttacatattcattgatatgtgactgggtatttacttcatttgcaaataataggtaagtgcattgtgcagaatagaaggcacatgaaattatgtaatttgaatgggaaatggggaaaatatctgtaaattactaagatgtgtggtgtagtaatcagctttctcttctgacaaaatatggcacatcaaccctctcatttattatgctctattacgttcttttaccagtcacgctacaagtttcacacactcccaccatgaaactgccagtcttcctactccatcactgcattgctagtgaaatgacttttaatgtgcaccgagtgtcagcagtcttctaggtgccctggaggaagaagacctctgcctgggcattcattctaaattaagcataaaagttagtgctcaattgtgaagatgtgcaaattataatttcaaaataccttaccatcttaaagctacgttccaacagctgggtattaatactacccagatacttgtttacttcagttatcttacaagctgtctacaatcagggtggatggtgttttagaatagaaaaagagcttatagctgtagatgatcaaataatcagtggccattaaaacacacaggggagttgcgttttggaattttaaaatgtttgaatcaaagggaacataaaaatagtaatagggaaatacagtctgttatggttcgcagactatagatgtgcctacattttgaaaaatcggccatttaaaatccaaatttaataaaacaaatggggtgattagttgcatttctgaagggttttgttgagggagatttgttaaaatatgtattgcatctgctgcttttaaatgttggctttaatagattatgaactctctggtgagatgaatagcaaggaaacaaaggtcaagtatttaatgtcaattgaaaaatgaagatgaaccatctctgcaattataatgtgttaatggggaaaaaattcaatttacaattagcaaagcactgcattcgaagaagcacttgtgttttgaaggccatacaagggaatcctggcatgtgtaatagcaaaaacataacatgtttaaacagctcatatagttagttaagccacgttttccaagacatgccataagtaaaagggtttatgaaaaaaaaaagagagggagagggtaagtggggtgggaaggcaagaagtggggagagataatgcttagaaaataatttggttgatcacagtaatgggtatatgagggaggattgggatcctgagagaagaggtattctaccatttgtctggctgtcatgtggacttgggagcaagagtcattcccagtggagtccattgatgtccctttcccttgacaacttactaatttatttattcttacatatacatattcccttattcatttgatggacacattttgtgagcaattatgatatataggaacataataactggggaacaaagaatgttgggggtaggcaaaatatcagggcacaaatttggaggatccttgcagtagtgcatagaaggagcaattgcatcttcactatttacagagatatagctaagcttgggccacattactgaagtcttgaagacatccaattgtacttgcgcatcatgaaagtctcattagggaaaaaatgcctttggatgctaagctggaaaatgaagacaatgttgctctcttggctttgacactaagttagatgtttgaccttggaccaacacttaagctttctgtgcctcagtctccttgtctaaaaaagaggataattctgtaatgctgcttgccatggcctcacatggatgaactcaggattaattagattaaagaagtgatcagtgaagcacatgaaagctcctcagaggtactaagtgagcaggacgaataacaattggaatgttagctatagagctgtaattggagtttgttttaaataggtcacttcctgaaaaccagggcaaatggtacttaaaaaaataaactttgttttacaatagttttagatttatagaacgattaagatagtacagagttcccatataccctacacccactttttcctgttgttaatatcttacataatatggtatatttgtagaatatattaatgaaccaatatttatgcattatcattgagcaaattctgcatatcatttagatttccttagtttttacctaacgctctttttctgttccaggattacatccaggataatacatttcatttaaccatcgtgtctatgtaggatcctcttgctgtgctgacttctcagacttttcttatttttttatgaccttgacattttaaagattatggtaaaatacacataacataaaatgtaccatcttaactgtttttaaggatacagttcattggcagtaagtacattcacactgttgtacaaccatcaccgccatccatctccagaactcttttaatcttgctaaactgaaactctatatccactaagcaataagtcactatccaccctccccctacccactggtagctaccattctactgtttctataaatatgactactctaggtacgtcatataagtgggatcatacaatatttatccttttgtgactaacttatttcacttaacaccatcaaggtttatcaatattgtaccaggtgtccaaatttcttcctttttaaagctaagtaatatttcgttgcatttatataccacattttgttcattcattcatctgtggatgaacacttgggttgcttccactccttggttattgtgaacagtactgctatgaatatgggtgtacaaatatctctttgagactctgctttcaattattattattattattattattattattattattattattattattattttgagacagagtctccctctgtcacccaggctggaatgcagtagtgtaatctcacctcactgcaacctcggcctccccggttcaagcaattcttgtgcctcagcctcctgagtagctgggattacaggctcccgccaccatgcccagctaattttttttttgtatttttagtagagacggcgtttcaccatgttggccaggctggcctcaaactcgtggcctcaagtgatccgtgtaccttggcctcccaacttactggtctgctttcaattcttttggagctataccaagaagtggagttgctgcatcatatggtaattctacttttaatattttgagaaaccaccatactattttctatagcagctgtaccattttacattcttaccaacaatgcacaaggttgtacatattgttgccaacacttgttttttttttatttttgatagtaactatcctaatgggtatgaggtattatatcactagcatttccctaatgattagtaatattaagcatcttttcatgtgcattttggccatttgtatatcttctttggagatatgtttatttaagttgtttgcccattttataatcaagttgtttgatttttgttgttgagttagatgagttctttacacattctaggtgttagcccctcggagatctttaattcagaaaagaatttctatgcaatgaaaagagagaaaagtaaagagtaagtaaatgaatgaattcatattggcttcccatcgagcagatctctgattcataagaattatctccaatatacttcctaaatatttaattttttcttttttaaaatataaaactttgcacacacctgtagtcccagctactagggaggttgaggcaggaggatcgcttgagtctgggatgtcaaggctgcagtgagctgtgatcctgccactgcattccagcctggatgacagagtgagactccgtctcaaataatatatatatatatatataaatatatatgttattgtgaacagtagtgctatgaatatgggtgtacagatatctctttgagactctgctttcaattattatttattattatttatatatataaaatttgagatatatagattattatttgagatatatatataatttttaccagccaattaaaatggatttttacttactaagcaggtagactggggctaccttggatttttacttactaagcaggtagactggggctacctttcctaaaaatcacttccttatccatgaactcaagtgaccagatgccttcaaaccaagtttcaaattgcccaaatgtcttctcaggagagaaaaatttgtccctgtgaagcaggcaggcagctcaggggacagatggatgccagggagtgtccctagagatgataattgtaacccatcctaacataacccttctcttcctttatgccctctctcaaaccacttatcttctaatttccattgacttcttctccctttttaaaggatgaaaccacccaactgatgcatctaaagtactagtggcagaactgggcttaggcatatagctcataacttgttattaggaagatataatagatagaaatgtgttttttgacagaatttgaagatgaggaagaaaattatagggaggctttaagtgttcctagctttcagcttcccttctaggaaccatctgatggtctgggttcatgtgcttggaagcactaagtgcagcatctccacactgagcaggctgatgtttgcatcgtcttccaggtacaaacagtctcctcaccactgaggggcactatcagatgtaattgggtctagcaggaataagacctaggaagaaagaacagatagaaaagaggtacacaagatgaaacatagcattctaccactaatggggattaggggtttgaatagtgcctagggcatcctgctttttcagaatatttacaaagaatggaatgtctagaataatgaagcctgacatagtgcttggtgctgtatacataatgtctcacttaatactctcaacccaatgaagtatgtactgttattatcatctccattttaaaaaggaaggaactaggcacaaggaagttacatagcttgtccaagataatacaggaaaaattagggaccaggtcacatttgtcttattccataactcttgcttctaacccaaccatttgtttggcttaatgagtggtgagttaaaaatgtgagcaatgatgtgaaggcagaaaaatgtggtctgcaacatgggaggtacaaagtgggggtggggaagtatagtaccagaaaaaaaaataactaaagttggttcagagagagaagagttagatggttattaaggaaacccctggaagaaaatatttggcccctgatgtctcagtaactcctatatcttcaatgtgaaagaagactaaatgaaattgataaaaatgattttttcatttcaaaatgagcataaaggtgttcttctccctctaattagtacagattaattagatgtaaactatagtccacaggccaagaaacaaattcaggtagggatatataggtggattaaaaaaacaccaaaatatgaatatcaaacaaatcctaagaaaaacagtacttacacattgcagaattgcttaccttatgttatttctggggatacctaagccatatctgtttattcagccactgatagcctctgaaaagtaaaagccacttttacaaatccggggtaacactggtgtctctgtaatcacaggacacagatcaagctagagtttgttactctgatatctctctgtcacagaaatatggccccatatgcaaggactgagtaagctagttgccagaatggctaggaagggggtgtcagtttcagccatggtattcttgtagtattatttaggctctgtgggctgccacgttccaacaggtctcactaggcagtggttgtgtatttttgttgcaggattacttgtaacaccatttcatttctaagacttgatgttctccctctctatttctatagagcattggaaattggcaaaaataaaaaataataatatagccaattcgatccaagctgacaacatgttcctatttttctccatctgccatgaattttatattctgacaagggcttgacctttggagaagcagacctctgttgggttacttctttggtacatttttatcttccaggtattttggaaactatttacctgtgctaataatttgccatccaaataggtcagtgcttcactgacttattattatttgtgtattctaaggaagcctatttggtatgaacagactcattcttacttttagagtttcttattctatcagaattcaaattaacagaacttctatatcatttgcaatgtgtcaaaatgaaatggagtcccttgagaagtttcccaaaaatggtatagtaggaaacctcaaagcaaagctttctactttacttagttttatttttttttttgttagtcagagagactcctatttactgctttaattgacttttttcatttttttaaacctcattgagccacaccttatagagctacaggtaacattattaaacacttaatgtgagacagacattgtattccagtgttttgcatgcactatctttataatatccctagtatatttttagctccactttacagatgaggaaattggggttcacggtacttaagaaactctcctgaaggcctgcagctagtgatatggaagctaagattcaaaacctgtccatctgactttgaagcagatgtttttaaacagttgactgatattagctagtgtattggctaagttactgtaacttggagaccccaaaatatagtggtttaaataatatagaaatttctttctctttgatttcacagtctgtatagagtagctctgatctatgagatcatttaggggcccagatgccttccatcttatgactccaccatgatttaggaatgcccctcatctgcatagttaaaactggatcactgttgcatctgcattccagcccatgggaaggaaagaagaaagagaggttatggaggtcaagtattttcatttctaagaatgtgaagcagaagatgctcacatcaattctgcttatatccttttggctagtcacatagtcacacctagctgcaagaaaagctggcaaatgtagtctctaaataggcaggcgtgtgtctagccagaatgctgtggtccaaatgttggttttcccccgaaattcacatgttggaacctaataccaaataagatagtattaagaagtgggggcatttgagaattgattaagtcatgagggctccaacctcacaagtgggattagtgcccttataaaagaggttcaagggagcacccttgccccttctgccatgtgaggatacagcaagaaggctccatctctgaagcggagagcaagccctcaccagacactgaatctgctggcaccttgatcttggatttctcagccttcagaactgtgagcaataaatttcgactgtgtatacattaccctgtctgtggtattttgttatggcagctcggatgaatgaagacacagaacttgggaggggcttctattactaaaaggaaggaggagagaacaaattttaaggggcaactggtagtccaccataccaccatagtgtctggtgttatttatcatcatccccttccagaatacaaaaagtcaagtagagggcatcagtaggagactatcttctgtagaaaagagaatgatctggtgtcagatactctggacattgcaggtaatgttataaaggttcagggatggaagctttaaatagcacctgtgttgacttaaatattcatgctaatattcacttagttttatatcccttcctgagaagttaggtttaggggacatttattattttagtatttatacagtagtcaaacttttgttctgtctacagccattttttcagttgttaccattataatattgataacctgaaccatcaagttaatccttttctttaggcttttattcttgtaaatattcatcagctcagcattttctttgctgagcaccttattcaactagaaaggagaatgttgccccctggaaatatcagcaatgatttagatgtgatcgttctcagatttcctcatgtctgtgtctcagtgtgcataaatatacaggctaactgttgctgaggcaaagggttggagatagattccatggtttatagcaaccctatttgagttgcaaatataaatgttgtatagatgctctcccatagtggtgttagagtctgtggatttacagaagagagttcttgacctcacaggagaatatgcggtaaagagtgttctaggagtagttagtagtagcttttctgggctttctttaggaaaatttaatgctgggatttgggcattaaaagttcctccacagtttggtgcaagtgcaaatacttctttaagggaatttttaaaagccacccaaagaattggattgtggaggaaatcaaagaatgttaacatagaagcagtagaaaatgtttctctatgtgagttctcatttgaatgtagatgtgagtgggtgggcaggtaggtactttatgtaatctgataggaggagaaatttagaggtggtagacttgacaagtatccctctggttctccagaactttaggatgacatgttagacattttcttgaaagttagtgagaggtgtttcctctgcaaacagatcgctgaaagtgaccagtttctagatgtagaaaccatcccagttgcccaggtttatctctataaaccagaatcaacaccaaccgactcttgtcttagcccaagggaacaagaaggtattctgcttacctgtttcccaccacaagaccaattttagaattcatttttatttatctcaatacagctgcctttttaattggcaatgatctctattgaatttctaacttatgctgaaacggtggctgctggtggctgtttgtatgaggtatttggtattttattttggcttaaatctgtttttattgctcaaatattgtcagcagatgcattatttctaccggaatttccactgctcagtgtacaggttatctccactttgacagctctgtatcttcaatgtcaggtacactgctcccaagtcatactagatttacacattctattatacttctattgaacagctcttaatctgctcagaagaaaacatgctacaaccagcaaattttatcctcttgcatttaatgggaacctttcttggcaaggatggacagttgtatttgaaccgttccaacaatatctggccagttttggaaagattttgaaggagttaaccctgtaacagccaaactctggttgatactttaatattgcctgaacacccaagttctaaccctgctctatttactgagttactccctcccccagctgccaataattcctaggaaccttgcctaatataatccctgttttagtcactataagttaggtttgatttacaatggaatttcatgctgaaattgggtggcaagatgcacatgtatttcttgggataactttactgcataatcttatattgattgtatttcaaaggaagtgttttcaattgtgctactcttagcttcatgcagcagtgggttgtgttataatggggttattccacatttattggctgagtttgtctctggagagatgtgtttgaaattaagaggaggtggggcagagttttcttctacagtttgcattctgaggtaggtaatatctgatattcaggccagttcatttttcttattgtttcttctctcctaagacactgtgaatataaagtaacaagagacaggacagaggctattgctagtctcctcatttgtatgatgggaataataatgcttaccttgcagagatgtgatgatgataaaatgaatataaagattgtaaacatgttcaatatatagttaatgctggtggaagcttctgagtagaaggtagactctaggattatccacacataacccttcatgtattttctgatctcctccactgagatctgtcctttgaatactatctctttaagtatgtatgctggggtattaagtctttttctttactgtagagttatctagtgtgtctttttatatcttctttgacatctttatctactgaaaaatctctaaacatctgtaactgtgctcagaaacctcttatccctgaagacccccagaagggctaagcggtaaccagagcagaggcaggagaagaagttgtaagaaagaggaagaggacaaaaaaaggaaactcaatgtttatgttgacaaatcagcttatttatcaagcatcttttttatgtccagcactatgctagaggtggaggaggtgctctggacttcaaggattatcgctctttcttttgtttttttgaaacagtctgactctgttgcccaggctggagtcagtggtgcaatcacagctcactgcaacctcaacctcccgggctcaagtgatcctcccacctcagcctcccaagtagctgggaccacaggcgtgcactaccacacctgggtaattaaaaaaaaaatttggtagagacacgggatttctctattttgcccagactggtctcaaactcctggactcaagcaatccttgtgccttggcctcccaaagtgctgggattataggcttgagttgccatgccgtgcctggcctctcttttttgaagtgttaagtattttagacttgaaaataatcagataatagccatcaagtaatataaaaacaagtcctaaggcaggccatttttgcttcaattataatttccaggtataacacccccatgttaatttagcctatgttggtgttttctctggtgtgggaaggttatttcaagtattgtaagatagttgggcactgtctatcttctccctccttattcagagtcttccttctgccctcagttttctgaccttgcatctgccttcagttttgcagtcctaactccttttttccccttatcaacccccactgctagcattttaaatgccattgactttataaggtgtcccttcctatagctcagcagttctaccttgttgcagctgctatatagcactgacctcttatctctttcaaaaggaaagatgaatctaagaagcgactgtggcaaagcaaactattcagaaactggcttgatgctatctctgagagaggtttgcttagtttgcagaagcaaatgtcgtgcatgcttccatgttgcttagtgtgatttgtcacttgggattctcaagcatttgatatgaggccctgactggcttagctcctcatcagaatgcactacaatttgttcacttcaaacccaccaggaatagagggcattcactttgacatctgctcttcagaagcagcccattaatactgtacttgatgtgtcaggttcttaaagaaatacttttagttcttttatccacaatcagatgacctggttcaaggtcagtgccaaccctaagctgtttttctttttgcttttcccttttgacagtcattatatgcctttgcctgtttgtaatcctcagagcctctcagctcaggcactggtaagtgtggtgcaaagattgaggtgggaccaacattattggcatccccggattttggccactctcagaggtacctcagtaagctacccagtgatctcatatcctctcttccttcctcaatctgtatctgttccaaactgcttcattcccactgctgtacatggcttctaatatagaaattatcatatagttaaaacctatcatatgccaggtgctaagccaaatattgtgcatgtattatatgtacatatattatctcattgaattcctgtagaacctctgcgaggaaggtggaaactcaggctctgagagactaagcaacctgcccaaggtcatatagctgggcaatgtagaatgcagggctgctaatagcttaacaacttaaccccttctggactagtactctttataaagataatcacttgtttattattttcaggcaacaaacacttattgcacattattttgtgactgccactatgctaggcattttggatatattaatagattaaaaatacagtagctactctcataggtatcaaataagctaggggaacgagacaaacagacaaatgaaatgccataaaaatataagatttgaggtgctaaggaaaccagaggggaacttaacccagaccatgaaggttatgtaccctatgttgcctcgcaggatgagtaagaattccctctctcattctcattctcattcatattctctctctctctctctctctctctctctctctctctctctctctctctctctctctctctctcgtatccctatgttggataggtccttctccttcctttgtacttttttgtgtatctcagtaatagcacttatttattcttttcattcacttaacaatagtttgagtacccactttgtgccaggcaacgttttcagcactgggaacagagcagtgaacaaaacaaagttctgcccctcttggattttactttctagtatggagatagacaggaaactaatagataaatggatatggaataaaatgtcaggttgttaaaagtaacatgaaggaaaatagattgagaagctggagaatgacagaaggtgctatcttatagggaagacttctttgagaggtgacgcttcccatgcagtactgtgattatgtgtttacatttctggctcgcccttgatactccgtacctctggaggtaatgggctaagtctttactttgtagccccagacaagagaatgtaggagtttgggggtatcagccaaggcatagttgaaatgatgagtcagtgagtctacagatgtcaagaatgaagaacagatgatgggggaggtaagggagtgagggagctagaatgctgggagattattgtcagagaagaggagatttacatttcagatttaaaagattgaacaattcctgatgattctgtggtacacttacatgtgggaatgactgggtacagtaaggggaagcccactgagtcatgtagctcaagaacctgtgaggctagcacagttgttcttaaacttgggcatacattaaaatcaactagagagctttcaaaattgcagcatgagatcttgccttaggagattctgattcaggagctctgaataggtttcagaaaagggatatatatatatttttaaataagttccaaaggagttttagatgcacagagccaaggttcagaatcactggacaaggatgttagaagtttgattcatgtgggttttaaagccatgaaagattatgtcaggactgagtggaaaggaggcctataagccaggtgtaatggtcctcaatgcatcttggaactgaccagaaatcagtagatggctgtgacaaggagggagagagtgtggtggaacacaggggatgattttggaaaaagaagagttttacacaaggatggagaagtgattaaaggctttcaccaattcagggctatgtagaaatttagggcatcagtatgcagtttggggtactttgcatggaagaaaagttctggcattagtctgcttagcagatctgacatcataacagttaggcatgatctgctccacctagatgtgctgtcagccttgggcttaggagacaaagtcctcagctgcatttatgaatttcagagagacactggacaagtaacttgagcaaacttctctaaagtgggcctgcctttagggaagaatatataggtaaagcctagagcatttctctgagagtttttggaactagtactatacataacaactaactagaatcattggttcagcgtcaattatatgcaaagtattaatcaactatatgcaaagtactcatcaactatatgcaaagtactgagaaagaagttactttctcctgaaagcaggttgtggggcaaatagcggctatttgataataatactggttcattgggttctgaatatttgaagtttctgatatatcgaatcattttggttttgaagtaaagattaccaagagctttcactcagcctgtgattttccctaggcaggtgagacttccaatcttaatagggcttacttaaatgatgcaaaaggcatgcacatgaaccagtaatttttattaataacattatcatcattgtaattacttgcaatcttggaaagatcctggggttataatgtaagaaaagcctgtatttgatttctggctcttgattcttagtgttgtgccccattaggcagcatagggaatgcctctgagttctaatcccctcctctgttaaactgaaaataataataatagtttctttatgctattgtgagaagtaaattagataatatatgtaaatgcatgaagcatatattaagtggctcaataaaagccgcctttcttctcagcttttctttagacaccttttccaatctcactgtagcaagtaaaaattattaaaattggaaccacaaatctttttaaaaaatcatttcaacttttaagattcagggggtacatgtacaggtttgttacttggggcgtattgcatgatgctgaagtttggaatacaaatgatcccattaccattgtagtgagcatagtatccaatagttagtttttcaactcttgccctcatccctccctcttccttcaagtagtctccagtgtctattttgccatctttatgcccatgagcacccaatatttagttcccacttataaatgagaacatgaggtagttggttttctgtggaaatataaatctgactctgcttgatgtgtttagaaattgttatcccctgtcaatgggataagttagtctctagcttatacagtatatgcatttgttacttgcctgcagtggaatatatttgaaaatggatcaccaattgatagttagactgttgacttctggaatgaaatgtgagaaaatataaccactcaagctacattcttctattatttgctaaatatccaaattgttaccataagggagaaatatgcctcatgaattgccatgtgactttggcatatgactgtggtaatctcatttttaagaactgcatgtaaatttgaagtaagaaattctagtttcaattaaaaacaaactgagctgaaatatccaaaattcactggctatgagcttatctttaacagttactaatttatatggccaagaggggttgtatttgcaaggccatccccttaagagctgaggttaaacaagtgagtggcatgggctataaatgaattgaaaattgccttctgttccagcccagtgcaatggtttgtgttttgtaataagccctagttggtgaggtaactcatgtcaccaggaggagctgtccacagactgcttgatttgtcactgctgtctgaaggacacaacaggctggggaagctggcactctgcagaatttttatggtgctgcatgcatgcattggtctcccttatcaagctgtaattcaataataaatacaaaaaaatttttgtttaaataaatctagggttgtgacacaacctgaccaaagctaggagagttaatgctgatgctgggatattaacttagccagggagcagtttgggtgaggggaagaaaaagatggatgctgggagagagtctctatttgtgatagagtattcatctgcatggctgtttttctggaatgctttggtctgtgccattggctcaatgtagtcatttttcaacttggtgtctttttgttcttcacgccctcaccctcctttttaaagagagaccaaagagcatgaagggtgacgagaaccactacaagaattttgttgcgataagcagaagccagccttatagagtgggttctgccattttctcccagaatggtgaatggttacaagaaaattactgggacaggtaatttggggaatggatggatttgtgaaacatttttttttttcacaaagaaaactgctttttattttttgttattataaaagtaatatgtgttcactcaaaaaaaaccttcaagcagtacagaaaagtataaagaaaccataaaaatcacctattataattttccccctcatatcagagataacatctgttaacattttggtatatctccttttgtctcttcctgttacctttttcacagtggtttattaggagaaatttctagaaatgtaattcacattttaggaacttgtgattcctatataaaagtgatcctccacaagacagtgctgatttccactccagcaccactgtgtgaaagtacagaaggaagcccatggtcacaatttattgcataatgaccacgtgccagtcactgctctaagtactttgtaaatattaactcatatcatcctcataacaaccctatgagatgggtactactagcattcccattttacagtcagggaaactgaggtttagaaaggctacacagctagtcatgagactgaaccagaaggttgatcaggctttggtataggagaaagaaatagcttctctctctctccctctgccttgcctgccctgccttgccctgcccttcccttccctgcccttcccttccctctccctcctctctccacccccacccctcccccatctgtttacctcaaggcccagggagaaacaaccaatgaaggaagaagtagcagcctagtggataagcagagagccagaggagtcccaagcagctgtgaatctttaaatttaggagttctgggcaaagatgtccttgcattattttcgttcctaaatgagcagaacagaacttcctctccagtgctgggctttgtgagctgaatttgaaccaacaatgagagggaaaatagcaacagatatagatacacttatgtttgtgtgcaaacacacacatatacccatggcaaggagtgtccctctgtggctctgatttctactcagaatcagaacaccaggagaaatgatgatctttgtcaaatgaggtgctcccttagtttcccagcattaaactagagtgggtatagataaatgttcataaatgcagtgatggagagagaattgaaagtctcttattatattccagaataattttgtatgaagtagcagaacatgtgaataactttctgtgtgaccttaggctactcccttcctcttactgaacctcagtttcctcccctctaaaagagaccatagaactaatgtatttgagtgttaagaaccctatctctactttaaacagttcctaactgatttgactttgggttttcttctcctggaccactcttattttttatttttttatgccttttcggggctacttgatctgttattggtctgctgttgctagaaattgttctgtggatgctaagaaggtgagttgcttcatatagtctatcaagtgagaacaattaggaaggcccctatggtcctagaagacagcttatcatagtatctttgagattttactcaaacctttactttagaactattgcctcttttagaggggaggaaactgaggttcagaaagaggaagggactagcctaacagaaagttattcacatgctctgctacttcataagtagcagatcttactctagtaagatgattcaagtgtctcatttttataaaaatgattggggcacaacgatattatgtgatttttccccaaagtaacatatctaattagtagcaagggcaggatagaccccagatcgcttcactgtctagtaaggtttcccaaagtgtattccacttaacacaagtccctcaatatactctgggtggagatcggggcatgaggaagaggattctgaggtcaaataagtttgggaaatgccgccctgtctaaggaagccacaatgtgcattgaagactctgagaaatatagagtaagggaacatatcactaatattgttatagcatttatggctttcagagcactttcatagccatttttagttgtgtactagaagagacaaagcaaaaatgcatataaagtagatcatgggattgaaaaggggataagtgtagccatataaacaaagggtggctgacagttgtggaggttcagcaaagagtcctgcagttattagaataaaactgatgattttgggcctggtcacagtaatcagattgctgaatcttcattttatttgaatttatttaaaggataactccaaaatcctgcaaagagaaaggaaaaaaaattcttaagatatttatagtattaggggcttttaaaatggatttccatccattgataaagaaataaatacccaaaagaagcaagaccagaaagtaactattactaagctgtcttgtattatttctcttggtcaaaatttattaaaagtttgaaagctcattgtcccattaaatgttggtgttaagacttcagttctttattcagaatgattggaggttatattttacacttaacattttccagctggggaactgaggtcacgacaagaatggccactcaagaattctgttggtccagcagttaaggtcatatatgggcttcttttgtggctcaggcagtagactgccattgttttcatatttcaatttgattttcttgttcataattcaagttgggagtgaactaagtggtatattttctccataagcccattgagaggctgagaatctgcttttctgcctctagattctaagttaagaagaacaagggcagggtgcatgtcattcctcttcaccattatatcaccagtggatagcatgggacctggaacaccatatatgtttaggatataattattgaataaataagtgttctgtagagaaaggaaagtggatcaaggtggaaatcatgtacctatttgtagtctactcaaagtatacaagcaatgtttgttgttgatgatgtgtttttctcatgataattgggttgtatttgcaagacctcacttatggaagcaaattaattgctatttaggttctctgactgctatttgggtaggtggcacagttggatgatagaaattatagtttttctaaccagaatctcttagtgacaacgtatattagatcagtgggtttctagtgaattggagtagaggtaaagtaatatcctatatttggattttcgaaacaacacctattaattatcctcctgcaccatcaccattataaagatgtggaaactcagtgtcagtaacttaccatgagcaccttactggttaatggtaccaccgtaactctgaggtaaatctactgttttacagtttggtgttcttggccacccctcctgctaccactaatcaacaacatggggatttgtcttggagctgctacttggtttcagtactgaaaaatatttcagggactctgtaaaattcttgatgggtcatcagccattgactaactcacctgaattccaactgtgtctggtaaagttctaccaaggatgaatgtattaacttctttacaagctcaaaaagtattagaggaggaatatgatattaccaagtgtttactgcccacttctcatgtagcataggggatatgtgaaagcatacagaaacattctgtacttttcaggagtttgcagctctgtacaggaggtcacatggaagtgcctggtatcttcagagaataacgcactatgatacagacatgttgcaagtatggcaagcatttaagtggtgctggaggtcggaggagggagggatcaagaagtaaacttcttgtgatgacaagatagtggcttttgggagcagacttcagtattctctttttgctctaactctccctttctgattcattttttttttctaccagtttggtggttaattagataagcagtgcccctacatctaccactaactcactttgttgatttcctattccacagtgactcctcagggaggaagataggtggtggagttcataataatggtaaatatgtagatgcctacaccttggggatacagattttggtacatgatattatggaaataggtgaacttagttggagaacagttttcaaaagaacaagctatgttttgatacgtgtggagggatttatgctgtccttgatatcaaaattttatgtttccataaatatgtgcctatttgtaagtagtatttcatgagggaattaggtggatggaagcgttgatagtacaaaagattttcccagtagtaacagttaatgcatgctttcccttatagcttaaaacaggtgaagggacttgaagtgagatgcttttacttgcattagagtagtttctctgtaaccatgttccccttcctctttattcaggttttcagcatatacaatatgtgtattaattattaggctttgctgtggggccattttttatgaacctccaaatgttgctgagtgtggaatagctctggggcttgataaaaacatggcctttattttcccaccagtctttccaaataaacctacctcataggaaagtataaagtggtttacagaagaagatttggaagccaagttcccatctttggagtcaaatggttcagcattctggcctggagaatggtgggtagaggggaaaatatgctcctttgtgcctttatgccttctcagactggctaacatcagagctgcatagcacatattctgagctgatggaattgggtaaaagcaggtttaatttgatctcagcactagatttaggagcaagtcaactctgaggaaagattcagtttcagcagagtggagctgagaagaaaccatttgttttcatgaaggaaaaataatctttgaagcaagacttctatccctctctcccttccttttttttttttaacttcagcttcattttcttgatctgcaaatctcaattcctcaaaatctcaagctatttttatgtgtctttttttcctttcataatgtataaacattagcaataaaaagtgatggatcaagttgttagaaaagggggcaactgtagctttttaggaccccaccttgaggaaatattctgttatttgaatccctcctggagtgtaaattccctccttaggtgatgaggtatgtataagtttgccgtaaaattatttttgttacactggggactcagatacacttctactcctactgctgggacttggtctgcatgaataatttgtgtgaacaagttgctcctgtctgtaaggaaactgttaaatccttgactttccagacacaaggatgtcatcttcaggatcctcactgacttatatggacaaatagtattgaaacagatgacaatctgaagttcctacagtaggttcaaaatccaggcagatatccccaacaaaagactaatgaaaaagtctactccgtatgagaaccatgccagggaaggtctttgaattcctacttctctctgttatgctaagctcagctatagatctcacttccatgagaacaaggctagtccttgtggcatttgcaaggaattaggctgggaatttgtggactatggttctaatttcatccctgacattaactgactaaccttgagaaacttgtttcacttttttgttttattttctctgtctataaaatgagggtgtaactacatctgccctagctgtttcacagagatattgtaagaatgcaacataaaaatggggtgttttaaaacctgttgaaagatgtaaacaaaagagacatacaaactaaaggtattgtcaggtatcattattgttaaatatttttggagctcttcaggagcaagttctttggcattgtctccctaaggagacaatggatatgagacgctatgaggaaaaagtaggtaataatacaaaacaggagggttggcggtggtagagagactctggacctttctggaagggctcaagtggctgaagggaaaacaaacattcatgggctggcccaaagggtaaagaaagttcctgcacccctaatctatgcattgtgcggtgatggggaaaatggtactcccattctttcagtaaaaatggttgatatctgaacccagctttggtgactcctttgccagtcctaagctagcactgctatgcaaaaagagacaacaaggggaagaagtcctcacaaagaaattcctgggttagggtaaagccaggaatgcaaaagcctaagggaaaagagtgttttttggttctttttttgtttgtttgtttgtttgttttgagatggagtttcgctcttgttgcccaggctagagtgcaatggcatgatctcagctcactgcaacctccacctcccaggttcaagtgattctcctacctcagccccctgagtagctgagagtacaggcacctgccaccacccccagctaaattttgtattttttgtaaagatggggtttcaccattttggtcaagttggtcttgaactcctgacctcaggtgatcccgcccgcctcggcctcccaaagtgctgggattaataggtgtgagccaccacgtctggcattgttcttcccatttcttctctcccctacagataacttaaaatcctttatctctccaaaagaccaagtaccatttagcaaatcctgctacctaagttgtaatgatctcttcagccccccccccccccccgcaaagtaatgtttgctatgacagaattacagtatgtctggaagagtttgtacttctctgtgatttggtacgaggcaatttaatctacgtgacaaagggagatatctgatttgtgggagcgctgcctcttttgatttccctctgtgctactgaaagaatggttggaatgataagaacagtatttttaaagtgtgttctgggcaatactaatctctaggtgttttttgtttgttttcagaaaagggcttctatggtcaaataaattgggaaatgattcatgctatgattccctctaggaaatgtgttgtgcatgttaggataccaaaagctttgagcagtttaacagtaaaggaatctgtttaactttgtttaatctagcatttcataaacttatttccttttggaagcccccttttcatataataccaatcactattaccctttaaggcctttaagaggtagattcattctcaaatacctgcatagttcagattgctatgccagacaacaaagcctcaagttagagaattcagtattgctggttagccttctccaaaattaaaattgctgtgctaagacaaagatagaatcagggcggtgatgttttctgtccaaaaaactattaaaatgttacagtgattcaacaacatcttcattatgagataggcaaacaatgaaagcggtccacacttattgcacgctcagtatgggccagccactgtgctaagcgctttctcttgttacttctaggcataaaaatgacccagcaagatagattgaatgagtcttcattttagagcccagggaactgagagctagagattatgtaaatcacccaaggccgcagacctagtaagaggcagatctgggatatgaatttcggtctgttcaactccagagtcgatgatttagatttaaaatatttaaagtcagactctgttttctaagtggaaaatggcatttcaagaaatctcaaaattctgtatctgaataatgtatcagctaagactctaaggcattcaggaggctgtcttttggttaaggggggctccacctgcatcgccagagtcagtctaagtataattataggtatcagcaacctagagaacagctggttcaatttaaagtgccctaaggatcacaagcatggtcctgtttacatttacaagctgataggccagttgctgtggctcatgcctgtaatcccagcactttgggaggccgaggcgggcggatcacaaggtcaggagatggagaccatcctggctaacacagtgaaaccctgtctctactaaaaataaaaaaaaaaaaaaaattagccaggcgtggtggcaggtgcctgtagtcccagctactcgggaggctgaggcaggagaatggtgtgaacccgggaggcggagcttgcagtgagccgagatcgtgccactgcactccagcctgggtgacagagagagactccgtctcaaaaaaaaatttacaagctcatttttttgcccacttactaagtttcaagcccatttccatcttctttcactgctgttccttgaggccacctctttaagccacttgcttgggtgcttataaatacaatgtccctcagatgggtacctttaattgtccctcctaatatcactaggtccctatccattcctttttcattgctctggaggggtggcttaaagccttattttgtggacataatgaaaacatgtccacatgcctctagactaagctgtctacaactgaagaaatatgacatccaactaattataacttaattttatcatacatttattattatatatatgttctaagtattttacatggatcaacttatttaatcctcatggcaactctatgaaggaggtactgttgttatcctcattttacagatgagagaactgaggttcggagaagttaagttactcgcctaagattacacagctagcaagctaagtctcaaacccaggtctatatgacctggtttgatgaataattaatggtattatgtgctattacttattttattatactagtcttgctgcgcctggattagccttcctccaaccagaatcttgcctttattgttagtatgctcattgcctcctcccggctctgccactttggtaaatagctgtctagtttgatggttctccaatgagcatcaatgtgtatcagaattacctggaggccttgtgaaaacctggattgctgggacccatccctagaacttctgacttaggaggttatggagcttggcagggggaggagcagtgaatttgtattcctgacaaattcccaggtgatggtccagagaccacatttcgagaaccattgatctcctgttaccactcaattaaccaactcttcttagaaactggttttctcttgagcaactcactgtttattaaaacagaactaaatgtttccattttgacttatttaaaacatcacctaaacatgtatatctccaagtgatttttaaattatttttaattgacaataattgtgtatatttatggggtacaatgtgatgttttgatctatctatacactgaagaaagattcagtcaagctaattaacatatccatcacctcaccaacttatcattttttcagggcaaggatgttaaaaatctattctttcagctatttggaaatatatattattattaactgtggtcaccatgaagtgcaatagatcacttaacttatccaagtgattttttaagagcagtttcactgtactgtgtcttgatcgtattcttgaacctaagtagtttggcatgcaaatgtgatttcagggatttacctccaattaattcccccaatggcttatagccacccccaccaccattcacatcatacctgaaagactttatgtgctatttaacttgattaaggaaatggtaaattgaagcttatttactacaagaatacttagtgacaggcaatatggcttggggattaagtacagggacattgtaattagacttgggtttgaatctcaactttgcctaataactagctgtgtaactgtgctcaagtgaagtaacttctctgagctctatttcttgtacagtgggagatgataatgaaatcaccctcatgaggctataaataagattatatatgtatagcataccctatcatgccaggtatttaaaaaaaaaactaaagaaatagctggtttatgttagtgattgcaaacctctaatcttcaggcctgtgatattccaaaaattgttgcaagagatcagtgacactgtgtgcataccaaaataaaatctcaaagatagaattaataagaagtagcatgtatagatgtacaattcatttccaatctaatctatgtagatgctgatttaattagtaaaatacaaattcacttagaggtatgactaatgatatgataactttctgtcattatgtagtacattttcatcaacagatattaaaagaccaacttttttgatatttaagaaaaatcttcacactttaaaaagttgtgaagcactggtttatctgaatagtctgttaatgcactatcccccagcagagagcaggcctctgaaagaggggaggccaggtcagctttgatgagcaaaggagacagaggacattctagagcatggggtgttgcttaaggagagcatgatgtggagggctggctgctgtagtgggggcaatctgagaaacccagggccagtgggaggatattagtcagggaagagcaggggcaataatgccaagatgtccagggaatctaccaaccagctaatctgttcctaggtgactaaggatttcaagtgaacaaccagccacaccaatagtgtatctagctttagagaaggactatgcgaattcattaggatagcagagtgtgtcttcctgaaggacttgggtgcctaaagtggaaaaatgcattgttgctttattctaattgcattattcagtcaaatcccttcaaaatgatcagcaaacagcccctgaaataggaaagtattggtggcaggagtgaaatttagagttgttttgatagaataattttcttcaggggtttgggctctgattgctacttagactgagtaaaagtattgctgaataaggtgctgagtaaatgcaagttgtcattaagaggaccgtggctagtctcttaaattatatccactattcagataaatgttgcatgccttcctaatagtctgcttccttatcgacttgagcatttagttgttgttgttttttttttgtttgttttgcttttttatttgtatttatgtaagagaaaaagggcaagtggtactcataacatcttgccagagcttcatagatgacatgagtatttgtaaatagggttggagttatatatattttcctagtctagaagtgcaagcttaagtttgcattcattatttgacacagtttggttatggtaatagtatatggtttggtagcagtttaggcttgatttagatgagaaaggaacaattgtgtttcatgtttttatttctaggaatagctgaattcagtttcatgtaattggtactcagaacacagctatccaagcctttctttatagtttctcttccatgtttccatttttatttccacccactcctatatagggcattaaaaaatgtatctctataaccatttaaaaacatgtctgtaaattttccacccagtagattttacaacaaatattttttctcaaaatagcttcgccctgcaacccaaaacactcctgaattattttgcactcatatctacccttcctaccatcccttaataagggctcagagaatgcagactcattaacatcagcctaaggaaaacagcatcacaaaaatcagtccaaggccaggcgcggtggttcacccctgtaatcccagcactttgggaggctgaggcaggcggatcacctgaggtcaggagttcgagaccagcctggccaacttggtgaaaccctgtctctactaaaaatacaaaatttagccgggcatggtagcacatgactgtaatctcagctactcaggaagctgaggcaggagaattgcttgaacctaggaggcagaggttgcagtgagctgagattgcgccactgcactccagcctgggtgacagaacaagactacatttcaaaaaaaaaaaaaaacaaaacaaataaaaaaaaaagaagaaagaaaatcagtccactttcaaagaaaagttaaaatatgcattgtaaaactggatagaactgatttgtacgctttttttgtagttaatacttctatgaaataatatatttaataaattttatatgactatcaccatttcacataattgttttcattggtgtgacggcccgcacaattttaaatcatttcagccgctgtatgcacagttttgtattttgctttttcaactaacacagcagtatttttctatgtttgttcatagtacaattttctaatttttaatgtttgatattccatcttgtttattcagcataagttacttagccattcccattatctgttgtattttaataatttgtgaggttattcatttattttctattaaagcagctaggcaaaagtttgactttacagtcactgtcctctagaatatcaatccctaagtgtttctgcttgactgttctaactctcccatttctacctgggtcaatctgaattctgccacgtaaaacatggttacccagtgaaagatctttacacacagtatattaggttgctaggggaaacttacagtagcaagctttctgtttgcttatttcacatacattctctcattaattcttctcaatgtgtctataagaaggtattgaattatttacaaacacttgggataaagaaggaggataggaagagttgcctgctgttggggaggaagaaaggaaagaataatcgaggtgatggattcattaagttcataacaagctgtccttgcaggaggtaagtctgttaggatatcttcttttcctttcctaccctaactctaaaatttcgtctggaccaactcttctgcctgaactataaacctccaccctgtgaacaatgtattaattttcaaatatttcttgtgtaggtgaatacaaccaccttcatatccacacatgtctgtgctcagtttggcaatgaatcaccttctaaacatccagaacaatcagtcagataaggatcacctttgattaagatcttctctgccaggctctattggaataggtgccagcttctcactacttagagcttacgattgtgcacaatgacagctaagatttgtctgggcaggaacatatttttcccactcttaaagtcaacatttgaggtgtttctaagtggaagaaattccctttgctcattctgacttttcattcagttcaagctctccatcttttgtaagaaatgttgttctccatcgtgctgaagcattaggttgctgtttccccaggccaatcagtctgaagataactttatgatgctgctagagcatgacaccatagtttatccattcttccgatttcatcagggtgcctgacgcttgttagacaactttggggatgcagactgtttggtccagccttgttgcaatcagcagtttttagcaaggattacctagacttatctttgagatccttgataatttaatcagtaaaaacacgacatggccttttgtaggctgcagtgagtgcagatagagtgccacaaaggcctctggcacgctgcaagagtaaaaggtggcagggcactacctgcccactcccaaatgctacatgcttcccctctaccacatgcaaatctttgcacttaatcatgtcattgccaagtcccgcttctggtactttgtatctcagctaaagaagatgaagaagtctttgggggaaattgtcttgtgtgggtaggtatttgagcaattctgcctgcaggtgaagaacttcagcttgtggctgcaccacaactcatgcagtggcacccacaacatgtaccaggaatacctggactcagccactgggggtgctgtcacccagtactacagagaaatgggtgcccagcaatgtggttgggcccactggatccagattgtgaaggtagaagggatcttggccagcaggtgccagcaatcaaacagttccacaactccaagatcaagtttgtgctgtcccaccgcatcctgcattgtcaacacaagccacacttcaccaccaagatgcccagcccaacaccttcttttaggtgcagggccctctcactcctggtctgcccaaataagcccaaaaactcccaggcgctaaagaaaatgcccaggacatggtgttgaaatatgcaaagagttgataccatgtgggacatctgataacgttagtataccacaatagtctttattgttgtggacacagagaaggaactcaaagactctttttgatgatcctgacataatcaggaggagacagtgaacaaactttatttcacaggaggctctgatgatgagtggtaaatttaggatatgttcaagattattctgctttcctccctttacaataagtcaagtattcattaagcaaccactctatttaagaccttgtgcaaagcactgtgggagacatgatgatctattaaattgggttttcttctttcaaacttaaattctagttggagtgacaagatctgaaaaattaggtaacacaggagataaatagttcaaggcaataatagaagaggtgtcatgagacaaaacattattatttgacaaatgaatggcacagacaagtgttctagaggttgcaagaagatagagctgagaggcatgctaatatagtgcctttttctcctgctgttttctctgcctaaaacgtccagtgtatacatccctctccacctgtaaaattcctatttctcttttgagatacagtcattgcctattcagtgcaatcgtcatcagcccacccagagttaatcacattacctctcataagcccatagaatcttagactcactgagagtataaaagcacatgttaatgcctagtgttccattattggaacgctaagcatgtgggaattatttatatcctactgctcaaggtcatcaccacggtctgattgaaaaattaaattgcaacctcaggtataaatgggtttattattcactgtaattattcacttacacattggattcctctaccagactgagaccttcaagggtaggggcaatttgatagtaatttatctttctgtcccaagaacctaccttagaattggacacatagtgttcagtacatttattgaaatgaaatgagtgtagtggaaagagtactggacttggaatcagaattaaaactgtcctgggcttggtaaatgtttgtttttctgaaatgtgtgtcatgtcacctctctgcactgaataaaatgatctctaaagttcttatagcactgaaaactgtgcaatcctagcctgggagtagttatcaaaggttttccataattgctgttgataataaataataatcacaacagttaacatttactgcatacttactatgtgctaggcatagaacatgaattatgtccttcaaccctcaaaataaccctatgtggtaggtactattacactcattttccagatgaagccaagactccaagaggttaatttactagaagtcacacagctagaaactgttgaaacagagactctagttcaaatctttttgaacctagaggcctttgctcttaatagccacactagtcattctcaaccctggctgcatatgagaatcaccagggagtttttaaaaaatagtgatagccaggcccaactctgcagagattctggttcaattgatctgggatgaggactaaacattggcagcttttaaaagctccccaggagattctaatatgccaccaggtttgagaactatttcattacatttttcagcctttgagagtacacctgggccttgtaaaagtttgcagtttagatggacaagagaaagaaggacattctgggtgggaattctgtttaagctttaaggtgatacacaactatctgaatgtgtcttatttctctgaagcaggtgccctttgttgtatcaaagctacttacagctgagtatatataggccagacttagttcctgatgcaattgcatttggaaacagtttcaagagtttcctcagttcagaaagggatggcttctgcactggctgctattaggtcatctgccactcttctgacagaggtcaacgggaaaaactacttccttgtgtagggacagcaggttggttctctttgccccatacagtagactgaaaacctgtcagtttctaagcaaccgtttaaatctggaattcatgaatcagattaccttactgagaaagctggaatgaagagaattttgaaaaagtcatggaatggcttccccctcctttgtggtacaacacttgccatggggctggctttacagcattcttgaagacattgttctctggtcactgcagtaaaagaagcagcttatttggggttttgttggctgctgctgctgaggttggggatagtttcctgagaatggtatacctgagaggatcgagaacagcaaagaagttggtagtaaaatgatattaccttctgcatgtggccattgagaggatttactgagataatccacgtaaaggggttagcatagtgcctggtccgggggtagtcctctgtaaatgctgttggctgcttgtatttctgtgtatttgtcaaaacaggatagtgataagatggcagaaagatgccaacagatacagtttgaggtgatgtttcttttatgacaaaggattagaaactagagggatggtatgaatagcagcagatagggcaccatgcttcctggtgaaagcatggtgctcaggtttctgcaaatttccttgggggtatgcagctgtgggtgacaccacttgcttgaaataaggattttgtcaggatctagaaggtccttttgccatttttactatattttattttaatcctttcctgttacttcccgactattttgcagactctgactacaaatctacctactcaccaaggtcaaataaatgaccacaactctttcacattcttaagtatttacgggaataataggtgaggggaagctcactttgcaggaaacatcatttagtgggataggcctgtttgaggtctacccctgcagggctctggtgatgctttggaatagggtttatctttatttggaagtagtaagaccttggcttcaaatgagaacaaaacatctcttaggagagttttttcctttgaaaatgctcaatatacaataatgcaaacttgtaaaaattttaattagtacagcaatgtataagaattaaaaatccatgttctattttccacaagcccaccatcagtctcaaccccccagacgatcacggttaactcttcatcatgcatccttccagatctttacccatccatctataaataaatatatgtacaaaaataggattccactatagtatatagtatccgttttccctctcacataacaatatgtcttggagattttttctatgttaatacattggtctctgtatctttttttttaaagcaactatgtaatataaatggacttttcattttgttccatttttttctttatgaacaaaacatttttaaataaaaacagcacttatgtgttaattcaattatctaacttcatacagccaataagtggggaagtcaagatttggaccaatgttggccgattccagaactcatggtattaactgctaggcattgctgtcatttccacaaattattttcactctagttttctaatgtaagcagtagttatgaggcaacaattaaatctcagagttgaaaggaacctttaagacaggttatttagtttaacatctcactctgcaagcaaattattagatgtttacttattaggaaaaatcattcctgaaactttattttggccaaataaaactccattaatttatttgcatttgcagtggtagaaactgtgggttgcttaaacaatagtttgtcttgcctcctttatattttatatcaccattttttcatattatcataaccctctgacataggtagagtaagctattattatgcccatttcataaatggggacactaaacatcagggaaattaagagacttagatttatacagtcagttgtggaaggccacttgaatggcaggcaaaggaccttagactttcccctgaagggagtgaggagttattgaagacttttgagcaggattgaggttatgggtttaggtggatggaggtcagtaggtggtaacatgacaactggaaaacattaggaataggagtcgcaagagccaagttagcaagccaagtcagccattcaagtgcaagtagataaggagcatgattaatcttgatagttatcaggcttgaaaggagaggatagatataagaaaaagtaagaagacaatcttgcgggagatgggggactggagagagaaaagaggtaaagatgattccagagatattggccagaagaaaatcaatgttggagggaagagtagtttggattagttgttgaacgctggcagttagatatttaagtagaaatgcgaagcaatctttggaaaatgtaggactgggacttgggtgagagcagttctgaggttcagcatcaagagtggtctaccttcacagagcttttcacacactcagcacattaagtctgaaaagggatcttaaaagtcgtgtacttgaggtccctcattttacagataagaccaatagatgatataaattgcctagggcttcacacagttcctgagaggtgatgataaatcagatcttttgagtcttagttgtttacttttacctgaaaacgagaagttgcaaactggtaatggaccactgatagttatgtttggccagtagggttatattactgttcacaaacacttgatgcctctctctgctccgccttccccttaacatcaaccttagccacatggcttactttggtcaatgaaatgtgagctgggtcaaatggtatttctagttctagatccctgaggaattgccacactgacttccacaagggttgaactagtttacagtcccaccaacagtgtaaaagtgttcctatttctccacatcctctccagcacctgttgtttcctgagtttttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttagttagatcccatttgtcaattttgtcttttgttgctattgcttttggtgttttagacgtgaagtccttgcccatgcctatgtcctgaatggtaatgcctaggttttcttctagggtttttatggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaacacaaatgtccaacaatgatagactggattaagaaaatgtggcatatatacaccttggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagagcacatggacacaggaaggggaacatcacactctggggactgttgtggggtgaggggaagggggagggatagctttaggagacatacctaatgctaaatgacaagttaatgggtgcagcacaccagcatgtcacatgtatacatatgtaactaacctgcacattgtgcacatgtaccctaaaacttaaagtataataataataaaagaaaagaaaagaaatgtgagcagaaataatatgcattatttttgagatgagcattaaggcaaaatttaagtgtataatccaccagattttcttttccttctatcatgaggtcatcaatattctagatagaagtagctctgtcagcttgaacatgatatggaacagagacacaacttacctatgatgggagatgatatgcgtaacaaaaaaaacttgttgtaagctaagatctcagggtcatgtgtcaatgcagcataacctagcctgtcctaactgatacagcctacaacattctgaaaaactgaatcagtggctaacattaaaaaatttggagagttaacagaaaaatccagacttcgggtttctgatgagaaattggaagaggtggcaacatttagccaacttacatacacatggcatgatttgtctgaggctgcatagcagttcttcccttagaaatttgtgttgagtgtagttatacccagtatccactattcctaattgtatcttatacccacccattttttctttatttacatttacatatttacatattacatttatttacattatctgcctgggccttgcaagcatttgaatctgccactctggctttattatagctttccactcctcagggagaaaatgctagagacaaaaacaacagaggactggagacagaaatttagatagtacctacctgtaagtgtgagaaaaagaatcagtagagagacaaataataactgcctagaaaagtaacagaaaaaaaaccctgaattgcatagtgaccaaaacaaacaaaaaaacaaggaagagtcaggaaagaggggatgatcaacatcaggtaaaactacagagttcaagaataaagacagtgaaaaaaaagcaggtcacatgtaacccattaaggaataattgcagtgctttggtgattacggaagccagaggataagagattaaggggaaagtgctgctgagaggatggaggcattgagataatttcttttttaatgtttgctattgaatggaaggagaaaagtaattggtctctaaaatggcagcagaatcaagccaaagaggatttttccccctctttttttttctgtttttgaaagagggacaaatttttgcaaagcagagtaaggaggaaccaggtgattgagggagcaaagtgtgggagatgtctgggaggtgtggatggagaacacatctgatgcagttattttagaaataagggataatagactttcatctaagtctgctgacatagtgtatggggtcttagcgaatcatcagaagtgactcaaaagaagcagtgtctgggtcccacaatgggtattgggtaagggaagaatgatgaccttgtctagaagttcattgaaggtctgctgtctctggttacagttttgaatgaagagcagacaggcagtgaaggatctgatcactgagagactgaacgctgtttgtggcaggaacctgagccctgtgctcagatatattcttggtgctattctggccctcttttctgtcagttctgcaattgtactaataagaaatgtctcttgtctcccataggttaatgagtttggggaggaaaaatgcagagtttactatgatggcaggaagggcaatgcaaatggcctgctgagaaacttgaaatgcaccgcagggctttgaatttcatttcaaccgacaaacattctgctcatcaaacagcaccccctgaagaagcaatacagaattactaaatatactatcagtagtttccagcctgtgatcctagacccctggaaaccctgctgatggtctgcatacagagtcctacactattagtgcttacaatatgatagtgtctatatttctgtcaatgacataaaatggggacttactaatgctatattaccatctcatgattatgcttgggtttggaaaaaaatgcaactgacccatagaccttccctgtaatgcaacaaaaagagagccactctgtgtcatgatgtttatggagaccatgctgtcattcctactatgaccacaatgagagtattaccagggacttcctgatggggtcttagtgaagaatgaagacaagattgttctgtttttttttctgccttaacaagagcagcagcacttatctcactacatccagtaaagtctgttttgtggaggcatacaggtggagaggggacttggagatgaaagctggtaataggtggcccataggatcatttgcctatggaagggattgaagaatagaaacaaaattatagtcactatttaagtgttatggggtttgagttatgtgtccattctgtcagcagattcatttttctgagtgttgaatggggccacaatatagaagaggagggtagtgtggtggtgggaaatgtcctgcctcgggagggagggaaggatgtgtagagaaggaggggcctgatttttggactgtagagtaaaagcaaagagagaatgactggttttcaactgtgtttgactttattgttcttatgtcactggactatgctaggcacaaaaattaagaattagcaaaatgagcaaggcccatgttctcttcagcttattcactcaactataacagtgacacttggtgatattctattagcgaactagattacttctcagaatagcaactgttttccttgattacgtgaatgttgtaagtgacgtactgattcatacttttatggctggcctcatatgggagattgaaaaatcctttctgaggaagtggtatttatacagggacctcaaggatgagtaggagctagtcagcagtggtgggatggggagaagggattgctttaggaaacagtatgcatgtacaattgccttgggaagggaaagagcaaggaatgcctaaggatttcagagaagatcagtggagcatggtgaacaaataggagagtggtatcagatggggctgaaaaggtagacaaacaccagaagcataaagatttttttttgtgggactcagctttgagcattcattgaaagcaagtttatgaatattgttagatacattgtactagaaaatcttcatattctcgggcttgtgttgtatgtacagtcactcatttgatcattcattccaacaagcttatgttaaatatctgctatatgccgagttttttgtgccacagagttgtatacctcccagatctgtgtaaatttcagctgccaccaacaatgtggtcactttttcagtcctttccttaggatagcatcagactcagcttcttttcattattattatcttaggtataacattgctggtttgaagaacagggcccaatgccagtgacctctgctgccagctatccagaaaatgttttccaagactctcctggtaggcaagagcaggagagagaaaggaaactgcagctgtgtcttcatgccagtaaagcagcatttggggagttattaggcttagttcttacagctcttttcaactatgagctttgacaaagagtctgtaattgtcattttgaaggtcggtggatgtcacttccttcctccttggtctttctagtttttctttatttagactctgtttttttccctgctgcctttttaaatttgttccatctcttttattcagttatcctagccatctctctgagcatgggtaccaggggtaaggaccctgttctcagtaacagggaaagaggagctgtactcagataggctagcactgacccaggaatgcacctctgcagacatctttatcctccttcacaaatagtatttgtgctgaaggaatcaagtcaatggcaaagaaaaactggctttcttacctggatacctatttaagaagttttctccacttactctggccattactaatctgacctttctctgaactgtatcgtacatccccactgtgaataataaccatatgatttgcctcttgatgatttattgcattgaattagtttctgaatatttagtatttattgattttgtttccctaacaggatttgaaactcccttgggaaagggactataaccatacttatattttatcatcttagagatgagcaaaattgcaggcatgcagtttagccactcaatggatatttgactgatttaacgagacctgccaccttattgtacaaagcaatctaacatagaggaagacctttagattcccactaccatttctttgattattaaaagacagtagaatttttgacaatgattctattgtcaacctccctcagttgtctttctactggtagacctgtatggaggcatggatttagatgaaacatctatttctttgtgtcaaattctgctcctttgtgtggcagtctgcattatacaagaatgcgcttgccttatttctacatcaaagaaagtgagagccaagaaatgttcttaatgagttctttttggttcttatgccctctgaagcagcccaggaggaagagaggacaataataggggaggacagcaatataggaaagtaggaagatggtataaatgaaagggacagatgtcacttgaggcctcaaattaacttcatcagatctttgaattgctgcaaataaatggcaagtgcggagcaaggagcagtatgtgaagaagacattctttggtcttggcagcctgtgcttgtataacaaagatgagagatggagttgctagtattctctgttgaagatgtaggagttcaatagtggagaaaaaagaaaaatctaagaaagcaaataattgggatagggaaaggggattatgtttgtttcctattgctgctgtaacaaattacaacaatcttggtggttaacacaacacacatttattattttacagcactggaaaccaggagtccaaaatgggtatcactgagaaaaaaacaagatgtgggcagggctgcattcttttctggaaactctaggggagaattagtttctttgtctttttcaccttcttgagggtgcctgaattccttggactgtggtacccttccatcttcaaagaaccaactaactctggacaaactctggtgaagagtatgtagatgacataggagatacagggcaggaaacactgagtgaaagccaatgaccttctgaagatataaaataatttgtaaattttatgagagacaaatggcttgagagcctagtcatgctgctttaaaataattttatgttttttaatgcatatgaatacatttatacatgtaatgtgtgtctgttagagtgaaagttgatactgtttagttctgtgatttaagacatagtataagataaagtccatggacacaattttgtgaataatcttaaacttacccttcttttcccagagctaattgtttaatgctttcttcaccctctgctttatagccttctgtttcattctgggacacattccacccccctcatttttttttttttttttggttcctagccttttccctttgttcctctgctgacatcatacgtgtttttgataatttaataaaatacatagagtcaatcacagcatatgtacatttttggggcaaaaattctgtttaggaagacttctaaaatatttcattccatgctagttaaaatttaagtttaaagataatatttttacagtccctgtagccaattccctagaacctctttaatttatattctgtttctaattctacttctgatgcttcagtgctctgacatgtggcctgcttagaaaaaaaataactttgttgaggatactatatgacttgtgacttttccctaacttgctttggtcagagccatggatttaatttttatgtgggctacagtgtaattctaattcatgactatagtctgtactccttatcctgggttattttacaaaaggagtttagattaaccaccccaaagtgactagatatatgcaaggtttctatttctattattggagaaagaactcctgagtttctgccctactgatagtgagtcaatactccaataattgtacatagaggaaggcacgcagtgagcccttcagacaaaatgctttcatcagtctccttagtctttgattagtccttccttccttcctagaatgacctcatctctctcagaatgacttaaaaagaagcatggctttaaaaaatgagaataactgctaatgactttatgatcctgaggcaaagttttctttgcacaataaatgcttagttatgatttgatagtcaaatgtcgtgatggaaaaatgtatgataggcagtttgaatcagtgtagaaaactcagaaaagaggaggtatagcccaatggttaaatttgggggctctggaatcattaagagttggtttgggttctaagctcaacacttaatggctttatgaccctaaacagttacttaacctttctcaacttaactttcaatatgtgtagtattgcctatcttagagggttaattgcatcacagggagattttcattgaaggttgtttccctaagtaacttggtagctgctttgaagtttcactaagaaatcaacttgcaaaaggcagataataggagaaaagacatatacatttatttaacgtatgtacatgggatcctttagaatgaagaccaaaagatacagggggaactcttaatttttatgcttaggttcaacaaagtatggacagctatgtagaaacatgattggacaaaaagtgtatgatctaatgaataggttgagtggggaaacccagcaagtcctgtctgtctagattcttcttggcctctctgagcacacagttcttccttctgggcatggggcaggaccctctctggaatggaagggtcttatgagctacagccaaacaaggtaggccagataatttctttatggctggttttgccacagaaagtcagagggaaagttaaagtaatatttttaggttttatggctggcttgggggaacatgggttctggtttccatgacctgccttgaagaagggtgattctagtttctatggcaagcctcgagggagaatggaactgtgagaaaggaggatagcagaaggttaaagaaaaacttgtatctgaggctgatcctgaggccttaattttggggcattgttctctgagccccaacactgcccatccaagaaatttaagtgcagagacacactagaaatgaaacagaaataaggcagcctaatgtagttgctcagtggatgggctctggagctggattcaaccccatgctttaccatttagtagatgtatgacttcaggcaagttactttaccttctgtacttcaattttcttatctataaaatgggaacaataatagtgcctacctcaaagccttggtatgaagattaaatgaatacagataaaataataagcacagtgtctgacatttaattgatgtttaagaaagactatctcttcttattactgaaactaatgctgttagtactattaataaaaagatgatatatatagagatacaaggaaggatcaaggatgactcctatttttcaagcttgagcaactggtcctgtggtagtgccattcattgagatggggaaaagtgaaggaggaatagattcgggcgtgtgtttagtgaataacaagttttgttttttgacatgttgagtgtgagatgcctgtggaatatcagtatatagttagtcagttttggccgtgcgcggtggctcacagctgtaatcccagcactttgggaggccgaggcgggaggatcatgaggtcaggagatcgagaccacggtgaaaccccgtctctactaaaaatacaaaaaattagccgggcacagtggcgggtgcctatagtcccagctactcgggaggctgaggcaggagaatggagtgaacccgggaggcagagcttgcagtgagccaagatcgcgccactgcactccagcctgggcgacagagagagactccgtctcaaaaaaaaaaaaaaaaaaaaaggtcagtttttctgtgtctggagatcacagaattgtgatccaggaatgtaatcttgggagaagtaggtattctgatttttaagattatgatagtggatgacataaccaagaaacataatttagaaagagaagggaggagagcccaggatcaatctcggggccatagagggtgaggaatcagtaaagaaaatgaatagatatggaaagaaggtaggaaggaaatctacctttcatgacagttgagacagaagagtgtttcaagaagagagtaatcaactgtgtaaaatcaggacatagaaacatcaattgaatttgactcctttgagaagcttggttatgaagatgcatagaaaaattgaatggtggcctggatgagtcatcaaggaaggatctattttttataatatagaaagttatagtggatgtttatattgcaatagagacatacactagaaaaggagaaattaaagaagagaaaacaggagggaatgggatccagagtacaatagaggggcagggatacttcctatatttctatgagataaagtacatagcacaatgcctggcatatagtaagtgttcaatgaatagtatctgtcatgtttattgttgttgttgttactgtattaactcaagagcccaagctggcttgcatgtggaaaagacagttggagcatgcacagagccaatagccttcatggaatgaaaggccttggtgagcagatagcatttagagtgccgtatcctaaacaaaggcaaaaaaatgtggttccaacatacacagatgcttctcaatttacaataggattacgtccagataaaccaatcgtaaattgaaaatataaagtcaaaaatgtgtttaatactacaacacagcagatagttcccaacttatgatggttcaatttatgactttttcactttatgatggtgggaaagcaatacacattcagtagaagctgtaaccccatcctaagtcataaggagctccttgacttatgatgggtttacatcctaatatactcattgtaatgtcaaacaattgttaagacaaactatcctgaatcagaaactgtccggaaaagcatttggttaggttggcctatctaccctaaccaattttttttatatcatgggaggatgggaggtttctttgattatcatatggatgaaaagataaggtacttttattttagcaactgtacttcaaagaaatgactctaagaaatgggtagatctagttctgttgagattcactgatcagcacatccctggagaggtagccaacactctcctagtacacgttgtccctataacatgtgtgcttaaaggagaaatgaagtgtacccattgattatatttaccttagcaaaatgtgcttccatatgataacattatgcggtaaaaatgctttgtgatttacactgtttgtgtgatgttatgttctcaatacaatgagctgaaggcttttggctattattcctttagaaacaagcacctcttgttgagggctgattttgtccatattatcttgaaatgctttttgcctattcatctctaagtataaatatgagggtttttttttaatcctgcaaaatttcccataaacgtgtgtttttaaatctttcctaaagtggtctttatgcaaccaatagaaatcttaaatatatgatcagttttccaccctgtgttctctagataaagaaaagtttgactggtattagatatgaaaaatggaatgtgctttaaaattttcaatctgtcatttgagatcaatatcagagacagatacctattagactctttccacaactgtctcttatcgttgttaaagtttataagaagttacctggccaggaaatgggtttcactggttttaaacatccgttgttattggtatcatgtatctgctctcctgagtactgagcccagccatttggtttatgtgagtttctagactcctgtgtatttgccttactctctaggatttaggcttttttggttcccatattttgcttggtctagcctgtcacactttgttctttgtacctttagacctgtgtgtgcttgcttgatttaatttattatcttgtctcaactgctgattcagctttgccttctgactcttgagccctgggctaattctcatcctaaagcagcaggttttgagccttgcctccatgctacattgtgacctcagcaccagcattgagagctggtctaactcataggtctaactcagtacaacatttctgattttcatagcagttgcggtagaataaaaagaatactgtgcttaatgtttgaatctctgggtttaagctgtagcactgccagaaactcactaaatgcctatagacaaatatcttagcgtctctgaatttcagttttctcctttgtaagataggaataatattctccttactcatttttgtgattaaataagatatcttatgtaaaaatgcctaatgtgataactggcaaatgtttgtaaaatatttaatctcagttttggacactgtgatactctcatatgtttctttgtttccattattagcctgtttctttttataagcaattacttaatttatttccatgacaaataatcataagtaaaatgtatcagtccaaaagttttctggtaaaaaatcaaagtgaaattacaacacaaacttattttaacaaggtcccaagtttcccaattaacttgtctccaattcttatgtattctgttcaccaattgcattatatctcttctgaaaacaattaatatgacaacttgtaaatttctggcaaagaaactgagtatctagaactgagcagaaatatcacagtgattacaacaaattatttttgtctatttgcttgtaaatctgttttttttttaattttttattataccttaagttccgcgatacatgcgcagaacatgcaggtttgttacagaggtatacgtgtgccatggtggtttgctgaacccatcaacctgtcatctacgttaggtatttctcctaatgctgtccctccccttgccccccacctgttgacaggccctgatgtgtgatgtttccttccctgtgcccatatgttgtcattgttcaactcccacttatgagtgagaaaatgtggtgtttggttttctattcctgtgttagtttgttgagaatgatagtttccagcttcatccatgtctctgcaaaggacatgaactcattctttatcatgggtgaatagtattccatggtgtatatgtaccacattttctttatccggtctatcattgatgagcatttgggttggttccaagtctgtgctattgtgaatagtgttacaacaaaaatacatgtgcatgtgtctttgtagtagaatgatttacaatctttggttatatacccagtaatgggattgctgggtcaaatggtatttctagttctagatccttgaggaatcaccacactgtcttccacaatggttgaactaatttgcactcccaccaacagtgtaaaagcattcctatttctccacaccctctccagcatctgttgtttcctgactttttaatgatcaccattctatctcgcgtgagatggtatctcattgtggctttgatttgcatttctctaatgaccagtgatgatgagcttcttttcatatatttgttggacacttatatgtcttcttttaaaaagtgtttgttcatatcctttgcccagtttctgatggggtgtttttttgttgttgttgttgttgtaaatttaagttccttgtagattctggatattagccctttgtcagatggatagattgtaaaaattttctcccattctgtaggttgcctgttcactctgatgctagtttcttttgctgtgcagaagctctttagtttaattagatcccatttgtcaattttgacttttgttgcaattgcttttggtattttagtcatgaagtctttgcccatgcctatgtcctgaatggtattgcctaggttttcttctagggtttttatggttttaggtcttacagttaaatcttcaatccatcttgagttgatttttgtataaggtgtaaggaagggatccactttcagttttctgcatatggctagccagttttcccaacaccatttaataaatagggaatcctctccccattgcttgtttttgtcaggtttgtcaaagatcaggtggttgtagatgtgtggtgttatttctgaggactcagttctgtttcatttggtctatatatctgttttggtacaagtaccagtaccatgctgtttttgttaatgtagcctggtagtatagtttgaagtcagttagtgttatgcctccagctttgttctttttgcttagaattgtcttgtctatatgggatcttttttggttccatgtgaaatttaaagtcgtttttttcaaattttgtgcagaaagtcagtgttagcttgatggggatagcactgaatctataaattactttgggcagtatggccattttcacaatattgatttttcctatccatgagcatggaatgtttttccatttgtttgtgtcctctcttatttccttgagcagtggtttgcagttctccttgaagagttccatcacattccttgtaatttgtattcctaggtattttattctctttgtagcgattttgaatgggagttcattcatgatttcactctctgtttgtctattactggtgtatagggatgcttgtgatttttgcacattgattttttttttattatactttaagttttagggtacatgtgcacattgtgcaggttagttacatatgtatacatgtgccatgctggtgcactgcacccactaactcgtcatctagcattaggtatatctcccagtgctatcccttccccctcaacccaccccacaacagtccccagtgtgatattccccttcctgtgtccatgtgttctcattgttcagttcccacctatgagtgacaatatgcggtgtttggttttttgttcttgtgatagtttactgagaatgatgttttccaatttcatccatgtccatacaaaggacatgaactcatcattttttatggctgcatagtattccatggtgtatatgtgccacattttcttaatccagtctatcatcgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtataaaagtgttcctatttctccacgagactttgctgaagttgctagtcagcttaaggattttttgggctgagacaatggtgttttctaaatatacaatcatgtcatctgcaaacagggataatttgaattcctctcttcctatttgcataccgtttatttctttctcttgcctgattgccctagccagaacttccaatactatgttgaataggagtggtgagagaggtcatcctttccttgtgctatttttcaaagggaatgcttccagtttttgcccattcagtatgatattggcggtgggtttgtcataaatagctcttattattttgagatatgttccatcaatacctagtttattgatagtttttagcgggaagggatttgaattttatcaaaggccttttctgcatcaattgagataatcatgtggtttttgtcattgtttctgtttatgtgatggattacatttattgatttgcatatgttgaatcagccttgcatcccagggatgaagctgacttgattgtggtggataagctttttgatctgctgctggattcagtttgccagtattttactgaggatttttgcatcgatgttcatcagggatattggcctgaaattttgttttgttttgttgtgtctctgccaggttttggtaacaatatgatgctgacctcataaaatgagttaaggaggagtccctctttttcaattgtttggaatactttcaaggaatagtaccagctcctctttgtacctctggtagaattgggctctgaattagtctggtcctgggcttttttggttggtaggctattaattactgcctgaatttcagaacttgttattggtctattcagggttttgacttcttcctggtttagtcttgggagggtgtatgtttccaggaatttatccatttcttctagattttctagtttatttgcacagaggtgtttatagtattttctgatggtagtttatatttctgtggaatcagtggtgatctcccctttatacttttttattgtgtctatttgattcttctctcttttcttctttattagtctggctagtggtctattttgttaatattttcacaaaaccagctcctggattaatttattttttgaagggtttttcatatctctacctcattcagttctgctttgatcttagttatttctttttttcaaatcacactatttattgccatacagtttgtttctcttttcttttggttcacaatgcttaaatggggaggataatgaaaacaaatctcatagggaatataccctatagacgaaatacattaactacatagtgagttccgaaattattaaagtctagttgctcagttaggatggaagcaggcctctgtggaaagtatagtctaattaaagtttgaggtgtgccttataccaggggttctcaggggagatgatctgacctgacacagcagaggttcctagatgctaaagggttgttctggtgttggtgggcaaagctttgggggttagctcaaaggcaaataaggtatggccctgatagcatgagctctccctctttgagaggccgctaacagtgcagccctgctagggcctaagttctcaaactgtctgtgaaacttttaggattatatgtattttggattccagtagttgaggtcaatagctcagatatggggcctgataaggtatggcctaacattcttgaggggagagggcttatcacagcaaaacatgtcactcatttagcaaatcatataagtgcttggaattattttaaggctacaaaacaataacacaacatgaatttctccaagtgctctggaatatatcattgttagatgcaccataatttgatcataatttaagctgatcacataatgtttttaaatttagttggtcaaatgaaagtcattcaataaacataactggtgaagtggaggtcatattcgttagttttagtaatttcctattacaaaatatattatcagttgcagatatcagttgctccagtaatcctgcataacaaaccacctgaaacccaaaggcttaaaacaatgatcatttaatattgctcatgaaagtagagtttaggtaggtcattcttatggtcttggctaaactcatctgtctgcaatcaactgcaaattgaggaggctgctttgttgatcttgtctgagttctttgacatgtttatgcatgcttgagggttgaatggattttgtctaacctaaaatggtccttgactgaaacagctgggatgactgaaaataaggaagcctcaactctcctccatatctcttacagccttttatatattacccagttttagtttaatgaggaaaatgtctttggaatatttctgaggatactatttagaatttgtttttatgtttttttattagttatttcttgtcttctgctagcttttgaatttgtttgctcttgcttctctagttcttttgtgatgttagggtgtcgattttagatctttcctgctttctcctgtaggaatttagtgctatgaattttcctctaaacactactttagctatgtcccaaagattctggtacattgtgtctttgttctcattggtttcaaagaacttatttatttctgcctttatttcattatttacccggtagtcattcaggagcaggttgttcagtttccaactagttgtgtggtgttgagtgagttttttaatcctgagttctaatttgattgcactgtggtctcagagactgtttgttatgatttccattcttttgcatttgcgaggagtgttttacttctaattatatggtcaattttagaataagtgctatgtggtgctgagaagaatgtatattctgttgatttggggtggagagtactgtagatgtctattaggtcggcttggtccagagctgagttcaattcctgaatatccttgttaattttgtttcattgatctgtctaatattgacagtggggtgttaaattctcccactattattgtgtgggagtctaagtctctttgtaggtcttgaagaacttgctttatgaatttggctgctcctgtactgggtgcatatatatttaggatggttagctcttcttgttgcattgatccctttaccattatggaatgcctttctttgtcttttttgatctttgttggttgaaagtctgttttatcagagactagaattgcaacccctgctttttttttttttttttttttttgctttccatttgcttggtaaatcttcctccatccctttattttgagcctatgtgtgtctttgcacatgagatgggtctcctgagtacagcacaccgattggtcttgactctttatccaatttgccagtctttgacttttaattggggcatttagcctgtttccatttaaggttaatattgttatgtgtgaatttgatcctgtcattatgatgctagctgattatttcacccaatagttgatgcagtttcttcatagtactgatggtctttacattttggtttgttttgcagtggctggtagtgatttttcctttccatatttagtggttccttcaggagttcttctaaggcaggcctggtggtgacaaaatccctcagcaattgcttgtctgtaaaggagtttatttctccttcccttatgaagcttagtttggcttcatatgaaattcgtggttgaaaatacttttctttaagaatattaaatattgtcccccactctcttctggcttgtagcatttccacagagagatccactgttagtctgatggccttccctttgtgggtaaccatacctttctctctggctgctcttaacattttttccttcatttcgaccttggtgaatctgacaattatgtgtcttggagttgctcttctcgaggagtatctttgtggtgttctctgtatttcctgaatttgaatattggcctgtcttgttaggttggggaagttctccaggataatatcctgaagtgtgttttccaacttggttgcattctccctgtcactttcaagtataccaatcaaacgtaggtttggtcttttcacatagtcccttatttgttggaggctttgttcattccatttcattatttttcctctaatcttgtcttcaaactttatttcattaagttgatcttcaatctctggtaccttttttccacttgatcagtttggctattgatacttgtgtatgcttcacgaagttctcgtgctgtgtttttcagctccactgggtcatttatgttcttctctaaactgtttattctagttagcaattcctctaaccttttttcaaggttcttagctttcttgcattgggttagaacatgctcctttacctcagaggagtttgttattacccaccttctgaagcgtacttctgtcaatttgtcaaactaatttttcctccagttttgttcccttgctggcaaggagttgtgatcctttggaggacaagaggcattttggttttttgaattttcagcctttttgtgctggcttttcctcttcttcgtggatttatctacctttcatctttgctgttggtgaccttcggatggattttttgcatggttgtcttttttattaatattgatggtattgctttctgtttattagttttcttctaacagttaggctcctcttctgcaagtctgctggagtttgctgggggtccactccagaccctgtttgcctggatatcaccagcggaggctgcagaacagcaaaggttgctgcctcctccttcctctggaagctttgtcccagaggggcacctgccagatgtcaactagaactctcctgcatgaggtgtctgtcgacccctgttgggaagtgtctcaccatctggagacaaggggtcagggacccacttgaggaggcagtctgtcccttagcagagctcgagcgttgtgctgggagatctgctgttctcttcagagccagcaggcaggaatgtttaagtctgctgaagctgtgcccacagccgccccctcccccaggtgctctgtctcagggagatgggagttttatctataagcccctgactggggctgttgcctttctttcagagatgccctgcccagagaggaggaatctagagaggtagtctgactacagcggctttgcagcactgcagtgagctctgcctagtccgaacttcctggcggctttgtttaccctgttaggggagaacggcctactcaagtctcagtaatggcagacgcccctcccccaaccaagcttgagcatccagagtcaacttcagactgctgtgctggcagtgagaatttcaagccagtggatcttaccttgctgggctctgtggggttgggatctgctgagcaagaccacttggctccctggcttcagccccctttccaggggagtgaacgtttctgtcttgctgatgttccaggtgcaactggggtatgaaaaaaaaactcttgcagctagctcagtgtctgcccaaatggctgcccaattttgtgcttgaaacccagggctcttgtggtataggcacccaagggaatctcctgttctgtgggttgcaaagaccatgggaaaagcatagtatctgggctggatagcagcatccctcactgcagggtcacccacggcttcccttggctaggggagggagttccaccaccccttgcaaatcccagtttaggtgacaccccaccctgcttctgctcgctctccatgggctgcactcactgtctaaccagtcccaatgaaatgaactgggtactttagttggaaatgcagaaatcacccaccttctgtgttggtctcactgagagctgcagccagagctgttcgtattcggccatcttggtaaatctgtttttatccaagaaataatctgattcaacctttgtccatttataaaatgtgattgtttcttccattcaatggattcataagaacagcatcataacacgacgcgacgttttaatgtatagcattttggatatgcaatgggtgaagtcatgttcttgaaatacagctctatatgattaaaagtacctgttgtcacatggtctaatcataaagaagatgaaagagtgaatcagttcttattgacacttagtgcatggacaggtactctgtacatagcgttctgttaaatgcttaggacaacccagtgaggcaaacatagttattactgatttagagatggaaaaactgaacctcacacaggttaaggaatctgcctatagtcatgcagctggttaagagtagagctgggattcaaactctggtcttccttattctagctccctgtgctgtttttactacatgaagcaaactaggcctgtctcctgataacagaatgatagaggagatcctctacatttacaggctgttaaagtggtttatccaactcttggcagtaaacagatgtaaccaagtgtgaaaggacagggtaatcaggggacacagaacgggcaaagactgagtaggacatattcagaggtatgttttattcagctaattcatggctactgaatcttagacctgaaggtaggtacaactcaactctttttgccttcctcaaaaaagaggaagaaaaaagagaaagatcagtgttgaggaaatatatcactatggtatgtagaatggtatctgttaattattttggtgttgtgtcactcctgtcactatcttactaggtgacagcagcagtgtttttattcaagatatatgtgtgtaatattgttttcactggaaaataaataatggatgctatagtcttatgtccccaagaaaattttataagtttttaatgcatttatcatgcatccctacagataactttccccaggaaaattcagccatcagttttgtccatgttgttaatatatatgacatccataatgttacagtgtagagtcagaaagagttcatatttaagctcttccatttattatttaggtgaccatcgtcaatttacttaatctctctgaatttcaactccttctgtcaaatggatcctaagaatattttatgggtctataataaagaggaaattaggaaaaatacatgtacagattcttttatgtcctgttacagtgtcacatggcaattaataaaagctaattccattgctgataatgacaacactcctatagtaacttaagttacattagttctgcactgctcatatccagtttggcagggcagctattattgtgtatgcatgtgtgtattgttttcacatctagaatgtttatctcttgaggatgggaagtgtcagaaactgtttttgtatctctagggccttctcattgctttatttactagcatagttacttgtaatgactatcacaggaaagttatgtagcactttgaactaattttcaagataattattaaacaataactatgtttcttcttaggtattttgtctgtaagtagtgaaagctataggtaggagtgtttatttcattatgccatttggtttgattaatagcctttttctgcaagagtatttcttcaaagatttttttcaaatatgggactatttaaatcactaaatttaaagattttaaggaaatataatattttaaaactagctagcaaacatttactgagtgctaataatttgtcagattctattctaagtcctttggacatattaaataatttaatccttacaaacactgtatgaggtagaatatcattatgatttccattttacagataaagaaactaaagcacagggaggttaagtaacttgcccatggtcacacagctaacatgtagcagggcagggagtcacacatagttaatccaactctagaatctcctatgagtttcagcattatattgcctcttagtgtatgttggtgctaaatttttaagtaaaatgaactttggctacagctatcattattactgattcttaaatattatgcatttattctgataactgatctctttcacacaccctgattaggattttccaactgtgatttgtcctgcttctcttagttgggagtccatatagtttttaccaacttttcatcaaaagccattgcgggtagctttcttcatgtatcatctaattaaaatatcactctgagactgttcctacatttaaaaaacctttacttttatctctccacattttccgatctcttcttactattctgcttacatgtaactgaagcccgcaggagtctattagccttgtgtaagcataccgttggcttgtaattagatatgcagttgaaacaaagcagtttttaatttttttttcaagagtatctcttttcctttgtctgcctatgtaggaatccatctactctgttcagggttacttgaaatttctatatcatgcattagcaagtgaacctcagcttttatactcttggatacatactgctttagaaatgtttttgtcatactaatgtaaaaatcaacagatatgtattcctgccaggcaaaaaaggttttgaggataaatgtaaagtattttcgctacagccatttaatttttttgtttttgctttatttttattttattttttgataaataatcatatataattatggggcacacagtgattgtgatgtttcagaaatattattaaaagtagctaatatctgatatttcaaactccagttgttcattgtgggagatttcattctatctgctttcacattggttttccttacaaacttgaggctctgttcttgcctgtatctttctgagaaggaagattgaaaaaaaatggaagtatttcctgaggaggtggcataatttcttttgagaatatgatgtatagaatggacagctttcttctctctaccttagacagattttcatgaagcaaattgcttatttcccgggaataggttagaatttccgttccttaggtgttctgactatagtgcaacttcaaactggaacatttgagtttgaaattaattcttagggaagaatttcttcttgaggttcaccagaaaaaaggacagttttccctttcctttaaaaacatagaaacaatgcattttcttattacctcagtctaatttctgttttgctaatttggttctgctttggatttcattgctttaaaggtatatctatttatatacatgggctcaacatcagttgaaaaaaagttgattttggctcccctgacagtttcatcttactccgtttttgttcttttgaatttcataaatttacacttaggatattttaatatataaaatgaaaattataagaatgataatttgtgtagaaaatatacatcagatattctttatgagtagaagactacttctgcacatttttttctgtcatttctatgaattgttcatcgtcatctgcattaaaatacactcacttgcattttaatatacagtgtaagtgttgtttgtttgtttgtttgtttttgaaacagagtctcattctgctgcccagactggagtgcagtgatgtgatcacagctcattgcagcctcaatctcctgggctcaagtgatcctcccacctcagcctcccatgtaggtgggactagagtcatgcaccactctgcctggctaattttgacaatttttttgtagaaacggggtcttactatgttgccaaaggtattgctgtttatttttgaatgctgaaactaattttcagggagatcacaaagaaatcttttcatatttaaattataatcattttatgaaattgcttaactgtattaaatctgaatttgtctcgtgtaaagtcatttggttattttttttaaagcgagccttctgaatcatccactcagagccagactggctgggttaattagaagcagctggtgtgcatatggttctaccagaaacctgtaagaggtccacagaagaggtttgccctaggagactcatgagcagtggctagttgtgccaagagtgtagcaagaattggttgaggacaattcagggaagttattaaatagttggagcataaagacttctgttactaaaaaagattgtaagtcaggttttcacacactgggttttggcttatctactgaggataagtgactattgggagagccaaatcaatgtaaaaaggagaagaaatctatgaagttaagaatcaacattgctatgttttctttgaaatattttcctctttgttctttagactctttaatattatacaaatatattcattatgttttgttggttggttggttggttttggtaatccatttggttttctttattcataatctacaactctttttattggaatctcagtttgctaacccaaacaaaggaaccactaatcttttggtgacaacaactaaaccaaagtcactatctctggaactaaatagttcatttaaggcacagcctgaccactccctaatgctaatcccaactcctaagtaattactgaagtattgaaaagtgttctgattctatcttggtgtataaaaactttctattttcttctgcttatttgtgatgccactcctccttgttattcaatacattgctgaaacttacttctgtaaaatttttgtgatttgattgaatgaggactcccatgttactcagtcccttttctattctattcagactccttgtccacgccgcaccctttctggtcatttatctctgggacagttttaatattctattatctagcttgtcctttggctctttgtctacattattattggcttgataaagtcaatttgcattccctgaacacccactacaaaacttcagagaaaaatggtcccaaaactgtgtgggaaagacaagaggaaatcagttataaatattttacacacaaacaaatgattcacttgcagtcactgagagttgctattctcattcatagcctctgatataaacattcacaaagacttgttgatgaataaacatataaagaatgcaaagagttggtagaatttcttattgattattgatttccattttgctcttggatctacaacatggagggtaatgcaacctgtactcttcttgagcaccacgactatgtcactgtgcctagtcaggcattaaattaagtctgtgtagtcaagggtggttattgctgcaactcccttccctcacccaacaagaaaaagcaagctgcttctttgggtgtttcccctcactccttttgaaacatttatcctctggtccttttctcatcttttaattccatgaaaacttacctgtcttcagtctcattctgacaaggctctagtatttgctgttgaaaatgggaaattaagtcgaaaatcaatccctgtcaatgtttgccttctttgaaaacagaaaaaaaatgttgttagattgatcattgatcacattagctttatcttactcctactccttcattctataaatatacttttcctaaaccctaagaatcactttttaacaaatctattgttttcattactgaggcattgaattagagtatgactttgggctttgattgaatactgactctcaaaaacctgtgtaataacactaaattggagacacagagagggtcagtgattctctgtgttacctgttttatataacaactatgtttgagcattgtgattttctttgtaaaacatatctccaggctaactaaatggattttaaaaactgatactatcaggaaaaaaaaaaaacatttaactttggtgtttaagtctctacaacttggctccgccctatgtggccaagtttatgtcttcactatatgtcctacattggtcttattcattacttcctaattgcttgatgtatttttgtaatgacatttcatttagatttgaatttttttgactatgtgttacatttttcctaatactcccagttcctcaaaactttgtacagagctaagcatactaacaaaattaaataaaaagttcaatatcccccacttagatgtaatagaaatttatgccactaatactggcaccactgatacaaaggtattattaaaactgtttattttcttctctccctcacctgtcccagttgaagccttacctaaaatgttaacagtgcattagaaaaagttcttctgtgggtaaaattttagccacgttttcaaaacaaaataactttcttaagttccactgactttgatctcgtcttctacagccagacataacattgtagttgcagtcatgcttggcctgcttgtgatggtgattaaattggatctatgttactgtttatcaagatgtgacattaaagggtcagctgaaaggggctaatgggatgatccattctgtttgatagtgtttattatccacatcaagaaacaaccacattctacatgtgcacaatggagtgctattcagccataaaaataaagtaattctgtcatttgcaacaacatagatggaactggaggtcattacgttaagtgaaataagccaggcacagaaagacaaacacagcatgttctcactcatctgtgggagctaaaaattgaaacaattaaactcatggagacagagagtagaatgatggttaccagaggctgggtaggatagtggggggctgtggaggagatggggatgtttaatgggtaaaaaaaaacccagaaagagtgaataatatctagtatttgatagcataacagggtgactatagtcgataataatataattatacattttaaagtaacaaagaatataattggattgtttgaaacacaaaggataaatgcttgaggtgatggacaccccatttaccctgatgttattattacacattgtatgcctacatcaaaatatctcatgtaccccataaatatacatacctactatgtacccacaaaaattaaaaattaaaaaagaaaacaaccacattgacctatgggctatgtttaaacagaaataatgtatcctatatatgctggctatgaatattattgattctattattatttatatacaagtgaattaaaataactttttcaaatatacacaattctttattttttatttatttatttttttactttaagttctgggatacacgtgcaaagtgtgcaggtttgctacataggtatacgtgttccatggtgatttgctgcacatatcaacccatcatgtaggttttaagccccacatgcattaggtatttgtcctaatgctctccatcctcttaccccctatccctaataatggccccagtatgtgatgttcccctccctgtgtccatgtgttctaattgttcatctgccacttatgagtgagaacatgcggtgtttggttttctgttcctgtgggattatggcttccagtttcattcatgtccctgcaaaggacattatctcattcttttttatgggtgcatagtattccatggtgtatatgtaccacattttctttatccagtctatcattgatgggcatttgggttggtttcatgtctttgctattgtaaataatgctgcaataaacacatgtgtacatgtgactttatactagaatgatttatattcctttgggtacatagccagtaatgggatttctgggttgagtggtatttctggttctagatccttgaggaatcaccacactgtcttccacaatggttgaactaatttacactcccactagcagtgtaaaagcattcctatttttccacagcctcaccagcatctattgtttcctgatttttaatgatcaccattctgactggggtgagatggtatctcactgtggttttgatttgcatttctctaatgatcactgatgatgagctttcttcatatgtttgttggctgcataaatgtcttcttttgagaagtgtctgttcatatcctttgcccactttttgatggggttgtttgtttttttcttgtaaacttgtttaagtttcttatagattctggatattagacctttgtccaatgggtagattgcaaaaattttctcccattctgtaggttgcttgttcaccctgatgctagtttcttttgctgtgcagaagctctttagtttaattagatcccatttgtcaattttggcttttgttgccattgcttttggtgttttagttatgatgtctttgcccatacctatgtcctgaatggtattgcctaggttttcttctagggtttttatggttttgggttttacattcaagtccttaacccatcttgagttaatttttgtataaggtgtaaggaaggggtccagttttagttttctacatatggctaaccagttttcccaggaccatttattaaataggcagtcatttaaccattgcttgtttttgtcaggtttgttgaagaccagttggttgtaagtgtatcatgttatttctgaggtctctgttctgttccattggtctagatgtctgttttggtaccactacttgctgttttggttactgtagccttgtagtatagcttgaagtcaggtagtgtgatgcctccagctttgttctttttgcttagaattttcttggctatacaagctctttttttgttccatattaaatttaaagtagtttttcttattctgagaagaaagtcagtggtagtttgatgggaatagcattgaatctataaattactttgggcagtatggtcattttcacgatattgatttttcctatccatgagcatggaatgtttttccatttgtttgtgtcctcctttatttccttgagcagcagtttgtagttcttgatgaggtccttcatttcccttgtaagctgtatgcctatgtatttcattctctttgtaacaattgtgaatgggagttcattcatgatttggctctccacttgtttattgttggtgtgtaggaatgcttgtgatttttgcatattgattttgtatcctgagactttgctgaagttgcttatcagcttatggtgttttggggctgagacgatggggttttctaaatatacaatcatgtcatcagtaaacagagacaatttgatttcccctcttcctattcgcataccctttatttctttctgttgcttgattgtcctggccagaacttccaatactatgttgaataggagtagtgagagagggcatccttgtcttctgcctcttttctcttttcttttcttctttctttctttctttctttctttcttttttttttttttttttttgaggcagagtctctctctgtggcccaggctggagtgcagtggcgtgatcttgactcactgcaatctctgcctcctaggttcaagtgattctcctgcctctgcctcctgagtggctggaattacaggtgcccaccaccacacctggctcattttttatttttattagagatgggctttcatcatcttggccaggctaatctcgaactcctgatctcaggtgatccacctgcctcagcctcccaaagtgctgggattacaagcatgagccactgtgcccggccctcttgtgcctgaaagggaatgctactagattttgttcattcagtatgatattggctatggatttatcataaatagctcttattattttgagatatgttccatcaatacctagtttattgagagtttttagtatgaagggatttgaatttgaatggatttttattgaaggccttttctgcatctattgagataatcacgtgtttttgtcattggttctgtttatatgatggattacgtttattgatttgcgtatattgaaccagccttgcatcccagggatgaagttgacttgattgtggtggataagctttttgatatgctgctggactcagtttgccagtattttttattgaggatatttgcgtcaatgttcatcatggacatttgcctgaaattttctttttttgttgtgtctctgccaggttttggtatcaggatgatgctggcctcataaaatgagttagggaggagtccctctttttcaattgtttggagtagttttagaagaaatggcactagttcgtctttgtacgtctggtagaattcaactgtgaacctatctggtcctgggctttttttgtttcgtaggctactaattactacctcaatttccgaacttgttattggtctattcagggatttgacttcttcctggtttagttttgggagggtgtatgtgtctgggaatttatccatttcttctggattttctatagtattctctgatggtactttgtatttctgtgagatcagtggtgatatgtcctttatcattttttattgtgtctctttattcttctctcttttcttctttattagtctagctagcagtgtatctattttgttaattttttctaacaagcagctcctggattcgttgattttttggaatactttttgtgtctctgtccccttcacttctgctctaatgttagttattttttgttttctgctagcttttgaatttgtttgctcttgcttctctagttcttttaattgtgatgttatggtgttgatttgtgatcttttcaagtttctgatgtgggtatttagtgctataaatttccctcttaaaactgctttagctgtgtcccagagattctgctatattgtctctttgttctcattggtttcaaattacttcttgatttctgccttaattttgttatttacctcagagtcattcaggagcaggttgttcaatttccatgtagtcgtgtggttttgggtgagtttcttaatcctgtgttctaatttgattgcactgtggtctgagagactgtttgttatgatttcagttcttttgcatttgctgaggagtgttttacttccaataatgtggtcagttttacaataagtgccatgcaacactgagaagaatgtgtattctgtcaatttggggtggacagttgtgtagatgtctactaggcccacttgatccacacctgagttcaagtactgaatatccttgttgattatctgtctcattgatctaatattgacagtgggatgttaaagtctctcacttttttttttttttttgagacagagtttcactcttgttgcccaggctggagtgcaatggtgtgatcttggctcactgcaacctccacctcctgggttcaagcgattttcctgcctcagcctcccgagtagctgggattaccggcacatgctaccacacccagttattatttatttattttttttttgtatttttagtagagatagtgtttttccatgttggtcaggctggtcttgaactcctgacatctggtgatctgcccacctcagcctcccaaagtgctgggattacaggcatgagccaccacgcccagcctaaagtctcccactgttattgtgtgagagtctaagtctctttgtaggtctctaagaacttgttttatgaatctgggtgctccagtattgagtgcatatatatttaggatagttagctctttttgttgcattgatgcctttacaattatggaatgcccttctttgtcttttttgatctttgttggtttaaagtctgttttatcagagacggagattgcaacccctgcttctttttgctttccatttgcttggtaaatattcccccacccctttattttgagcctatgtgtgtctttgcacgtgagatgtgtctcctgaatacagaacactgatgggtcttgactctttatataatttgccagtctgtgtcttttaattggggcttttagcccatttacatttaaggttaatattgttatgtatgaatttgatcctgtcatcatgatgctagctggttattttgcacattagctgatgcagtttcttcgtagtgtcattggtctttatattttggtgtgtttttgcagtggctgttattggttttttcctgtccatatttagtgcttccttcaggagctcttgaaaggcaggcctggtggtgacaaaatccctcagcatttgcttgtctgtaaaggattttatttctccttcccttatgaagcttagtttggctggatgtgaaattctgggttgaaaattctgttatttaagtatgttgaatattgtcccccactctcttctggcttgtaggttttctgctgagagacccactgttagtctgatggacttgcctttgtgggtgacctgacctttctctctggctgcccttaacattttttccttcatttcaaacttggagaatctaatgattatgtgtcttgggcttgatcttctcatgagtatcttggtggtgttctctgtgtttcctgaatttgaatgttggcctgtcttgctaggttggggaaggtctcctggataatatcctgaagcatgttttccaacttgcttcaattcccccccttaatttcaggtacatctgtcaatcgcaggtttggttttttcacatagtcccatatttgttggaggctttgttcattccttttcattttttttctttaatcttgtctacatgccttatttcagcaaggtggtcttcaatctctgatatcttttcttctgcttgatcgattcagctattgatacctgtgtatgcttcacgaagttctcgtgctgtgttttacagcttcatcaggtcatttatgttcctctctaaactggttattctagttagtagttcctatcactttttatgaaggttcttagcttccttgcattgggttagaacatgctcctttagctcagaggagtttattattacccaccatctgaagcctacttctgtcaattcgtcaatctcattctccttccagttttgagctcttgcttgagaggtgttgcaatcatttggaggagaagcagcattctcgcttttggaattttcagcatttttgcactgtttttccctcatcttcgtggatttatctacatttgatcttgaggctgatgacctttggatgcggtatttgtgggagggtcttttcttttgatgtcgttgttgttgtcattgctttctgtttgtttttcttctaacagtcaggcccctcttctgtaggtctattgcagtgctggaggtccattccagacccttttcacctggatatcaccagtggaggctgtagaacagcaaagattgctgcctgctccttcccctggaagctccctcccagaggggcactggcctgatgccagctggagctctcctgtatgaggtgtctgtccacccctgttgggaggtctctcccagtcaggaggcacgggggtcaggtacacactcgaggaggcagtctgtcccttagcggagctggtgcactgtgctggtagaatctccttgtcaggatcagctgctgtcttcagtgctggcaggcagaaacaattaaatccactgaagctgccacagcagtcggccttccccctaggtgctctgtcccagggagatgagagttttatctataagcacctgactggggctgctgcatttcctatagagatgccctgcccagtgaggaggaatctagagaagcagtctggccacagctgctttgctgtgctatggtgaattctgcccagtccaaacctcccagtctccttagcactgtccggggaaaaccacttactaaagtctcagtaatggtggatgcccttcaccctaccaaactcaatcatcccaggtcgactccagacttctgcactggctgtgagaatttcaagccagtggttcttagcttgctgggctctgtgggagcgggacccactgagcaacactgcttggctccctggcttcagccccctttccaggggagtggatggttctcctgtctcgctggagttccaggtgccactggagtatgaaaaaactcctgtggctacctcggtgcctgctcaaacagccacccagttttgtgcttgaaacccagggccctggttgtatatgctcacaagggactctgctgatctgcagattgcaaaaatccatgggaaaagcgtagtactcagggctggcagcacagtccctcactgtttcccttgcctgggggagggaggtaccccagctccttgcgcttcctgggtgaagtgacaccccatcctgcttctgcttgctctccatgagttgcacccactgcctaaccagtcccattgagatgaactgggtacctcagttggaaatgtagaaattacctaccttctgtgttggttttgctgggagctgcagaccagagctgtttctattcggccatcttggctccttccaaacatacacaattcataaacatacttatgagttagagctccttctgatcttggtctatctgagagaatgtgtgagatttaatttctctgtttagatttcttaagctataatctggctttgaccatgtggaactgagcaacatttctgtatagcttttattcccactataaatgttcttgaggcttttaacttctgatgatctagtctttacaaagtttctgtagtgcccaagtgttgctgttttttttttaatgattaagatgaagtgattggcaaacttttataatccttcctatttcttcttaattcctttcttttctggaagttaaaccaatgtgctacacttttctgtccttctttaaacattaaaaatagaataattgcaccaagtggtacagatcaatgttcgtagtaccaagcagcaacctaggataatcaattaggtcaaccttttccaagtaagtaccatgggtcattagttctgagggaggttgggtaataggtgctgcatggaaaaagaggaagtagctatgattaaatgatatttgaaaactgatattttactgcatttttctcagagcctttaatatactgatgtttcatgtgaatttccaggaaagaaatatagtaggcagtatttacagggttatccaatttttttgcttccctggaccacattggaagaagaaggattatcttgggccacacatataagacactaataggaacaatagatcatgagctaaaacaaacaaacaaaaacagaaaacaaaaacacaaaaacatctcataatgttttaagagagtttatgaatttgtgatgagcttcattcataaccatcttgggctgcatgtggtccacgggtcgcaagttggacaaccttgatttaaaactttttccaaatgaaatgtctcagagagctagtgacaagtattccacatagcatattttgtgaaatgctacattagatgaatcctgcaccaagtgtgtggagacatgtgtcctgattcctcttctgccacagagtagttctgcgactttggagaagttgcctttatggcttttgcatttcctatttgtaaaaaaataggaagttgaattagaacagagctaggggtaggggatcacttctcagaaaaaactctgagactttttcagcccttccaacaaagttttgacataatcttctaatctcttcaaactttaaagctactgttgctttgggagcacagagtgtcccttatctgtgttgagatggagagtagaagttgagaaccactgggctgaaatcctctttgagctcacttccatctcatacttatcatgtgtattacagatagccagtcaaacccaaagtttgttttggctacctgaaaaaatgttaatgtttttgttgatgtgatatttcctcataacagtttgtcaaaaatattctgctacttagaagcagttataaccattccctttcatctgtttcaggaatacttatgtcatcagtggtatcaaactaaataacagagagagaggatctctaagaaaaaatgtttatttgggaatagaaattgcagtgggaatacaagtgccatagtaaactattcaggaaggtaaaagaagataaagatttttaaagaaaaaatgaggattacataaatattttgagataattatcttggctacaaggatcaataacaagggtggcacaatgtgtgaagttggacaggcagcttctgggcagattgtctcatggaaaattgaaatggtctttgtgtaaggttgtggctttcgcagtcttttgtgataattattgttattggggatttatgcctgagaaccctcccttcatggccttccttgactctatttgtcatggtttttagcacaaatgactccattttgattatgacaattttcacatttttcccttttgatgaagatatttttctgaaagacttactcattgattatcctatagttaggttttcattgtccctccatgccaagatggatctgtcctgatttcctctagtctggtctggtctccagtgtgaaggaagtgattgatgactaagagtcagtgtcaaaactcttttagccatatttgagcaacaagagagactggggtgagttgctcttgagctaaatctacctagagtccattattaagttcaaatttgtctgtttagtagatatttgttattatctcaaagtattgggccgatatcattttgttaggagttatacttttgtagaaatgtaacaactagctagctggtacaaagtttaaaaaggaaactatgaagtaaaattaatagtaatataataatcatagtttgtaggatagtttttttttaattatcctttaagttctagggtacatgtgcacaacacacaggtttgttacatatgtatacatgtgccatgttggtgtgccgcacccattaactcatcatttacattaggcatatctcctaatgctatccctcccccctctccccaccccacgacaggccccggtgtgtgatgttccccttcctgtgtccaggtgttttcattgttcaattcccacctatgagtgagaacatggggtgtttggttttttgtccttgtgctagtttgctgagaatgctggtttccagcttcatccatgtccctacaaaggacatgaactcatccttttttatggctgcatagtaatccatggtgtatatgtgccacattttcttaatccagtctatcattgatggacattcgggttggttccaagtctttgctattgtgaatggtgcctcagtaaacatacgtgtgcatgtgtctttatagaagcatgatttataatcctttgggtatatacccagtaatgggatggctgggtcaaatggtatttgtagttctggatccttgaggattcaccacactgtcttccacaatggttgaactagtttacagtcccaccaacagtgtaaaagtgttcctatttctccacaacctctccagcacctgttgtttcctgactttttaatagtcgccattctaactggtgtgagatggtatctcattgtgtttttgatttgcatttctctgatggccagtgatgatgagcgttttttcacatgtctgttggctgcataaatgtcttcttttgagaagtgtctgttcatatcctttgcccactttttgatggggttgtttttttcttgtaaatttgtttgagttctttgtagattctggatattagccttttgtcagatgagtatattgcaaaaattttctcccattctgtaggttgcctgttcactctgatgatagttccttttgctttgcagaagctctttagtttaattagatcccatttgttaattttggcttttgttgccattgcttttggtgttttaatcatgaagtccttgcccatgcctatgtcctgaatggtaatgcctaggttttctctagggtttttatggttttaggtctaacatttaagtctttaatccatcttgaattaatttttgtataaggtgtaaggaagggatccagtttcagctttctacatatggctagccagttttcccagcaccatttgttaaatagggaatcctttccccatttcttgtttttgtcaggtttgtcaaagatcagatggttgtagatgtgtggtattatttctgaggggtctgttctgttccactcgtctatatctctgttttggtaccagtaccatgctgttttggttactgtagccttgtagtatagcttgaagtcaggtagcttgacgcctccagctttattcttttggcttaggattgtcttggaaatgcgggttcttttttggtttcatatgaactttaaagtagttttttccaattctgtgaagaaagtcattggtagcttgatggggatggcattgaatctataaattagcttgggcagtattgccattttcacgatgttgattcttcctatccatgagcatggaatgttcttccatttgtttgtatcctcttttatttcattgagcattggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgaggcgatggggttttctaaatatacaatcatgtcatctgcaaacagggaccatttgacttcctcttttcctaattgaataccctttatttctttctcctgcctgattgccctggccagaacttccaacgctatgttgaatagtagttttaaaaataaattaatcctttataaaactgttaagaccgtcacagacatttacaatatgtttaaacttttagttttgtcctatatttaaaaaatagtcatcttattttaggacaaaaatttagcatataagttttttatacaaatttttaaaaagatttttatctgtatatatatatatatatatatatatatatatatatatatataacttaaacaatctctctttggtttctttaaatcttgtttttattgttctaaacctatatttaaaaacaaactttaaataacctgaatttagacaaaattactttctaaataaataacccattttcaatgcactttcaataattggttttgttagaaatacatcttttgtggttcactttgtatataaaattatacatattaattagaatttttaacttttagtaaccttaatttttagtgataatctaggaagaacttttgagctgtctatcatatatcagtattttatagatgagaactattttataatttttaaaaacatgttttctcctaacataattttatgtatattaatagatgtaaattatttagttttttaaataaaatttaagtattcaagaacaaacttatggttagtaatttatgttttagtattttatcttatttgaaaatgaaccagataattaatgagtgtttaatatttaagataactttagatttttcaattatatgaaaagtttatttataaatgttaatcccatttatatttaactgttttattatttatttatttgagacagggtctcagtctgttacccaggctggagtgcagtggcacaatcacagggaatttaactgagtaattgttttgaggtcagcctccatctcctgggctcaggtgatgctcccacctcagactcctgagtagctagaagtacaggttcccgccaccacacccagtcaatttttgtattttttgtagagatgggatttctctacatgttgcccaggctggccacgttgcccaggctggtctcaaactcccaggctcaagtgatctgcctgcctcagcctcccaaagtgctggtattacaggtgtgagccaccatgcttgaactatataatatatatatatggattacttacggaaactaagatattagacaaagctggttgtcattttgagttattttcttgttaaccactttttttccttatgaacttcatttgtaaattgttaatcatttttatagcctgtgaatatctgggtgtttacctaagtaatagccttaaatatatgagcgttttgtcaataacacagaaaagatagctgtttttactaaagtagcaatattaaattagtcttatcaatgagttttacaaacaaagattattatgtttttaggttggatttatagttttattacctcaaatcatctagtagagataagtataatcttgtctaaaaagtaaacccaaaaataatatgttgacaattttgaatatattttaatttttattttattaacaaatgtaaaactgattatttatcaaagatttacttaagtcatgtgaactaaaaagcatttgggttaattactatattttaacaatttttatgagtgctcatttacctaagccaatctaaacagaatttttaaaagggaattctggttaactctgccaggtttttccaactagatacaatacatgtacctacatgtaaatatacctagacatgtgtgtatatatacacaaaagatcctataggttttattttaaaattttaattatgaaacagtaaaacatgataatacaaacttaccagtttataaaatgatagttgcttttaaattatgtttttgacaaaatgggactagtttacatgggtaaattttatttgtcccagtaggtaatctaatgaaggctatagacctaaattttggataaagaatttttaatgtggtagttggattttttttttaaaaaaacctctttttatttttatttgttttaagtgagtttaagtatttaaatgttgacattttaactaggactggctgaattgtataaggaaaacaaaatttccagatgaccttgaattttagtaacaaatttattttttgttagtctggtttgactagttaacgtgggaagggaacattttagaaaatgttattatttcttttcagctctttttcatcccttttgggcacagaaagcaatttttatgtcagacagagatatattatggttttgaactgaagattttgatctatttgatctgagtctttcataaacatttatctaggttttaagactattaatcctttaattaactatttcattgccctttgtaattattagttaggcaaacctaagttcacattttaaaagttgtctaggttggttgttgccatggagctgttgtaatttgtagtatcattaatttgaaagtcctttgagactctttttaaaaaatcttggctgaaatctcataagaaatgagtatattttaatactagcagaaaagtcagcagatttaaagtgggtagaaaaaatagagagacaaagaacttagaaggctctccatgttaactctatagttggttgtagttttttttaataagcttagagagtttgaataattgccatttaagttctgagttttttatatggtttgcctaccagttgaaaaatgtgtatgagaatagactataaattttgaatgtatagttgtctagaattccagagggcttggcatgctttagaattttgagaatcctgttcttttttttcttgagaccagagaaaatcttatcagtactgtcagggaatgtcaggagtttggactggtattttcgatggcgtcgactaccctactagcttttaattggctgtcttgcactcaccatttagaatggttatttttgctcttggaagatgtttagaaacaaataaggtaaaaaagagccaaatcatttacagacacatgtaaccaaaccaaaatgacaccaaaatcagaatattcacaaaaatttttagccaggtttatacatcaaacaaaatattaaaacaggcacaaagaaacaaaagtgaatttaccagaaaataaatgtctcacagacagaatataaactagagttctcaaaccagaaggatccttgtctttatatcagaaagtgcttgtcaaaaaagacttatggtcccagaagggatgtaagattctttatttaaagtggtcttttaactaaatcagatctggaataaagtaaaaaaggactcaccaaagggagggagtctgagaatctgagagaagattcgccagggcagaaaaggaactcacgaaaatagagagtacaaaggactcagtcattgctgcattcaattccagaggtcaagatttgtctgaggtgagttcattttgaactcatttctaacactgtcttggtctgttgtgttgctgtaacagaatacctgagactgggtaatttacaagaaaacagacttatttagttcacagttctgcaggctggcttctgttgagagctttcatgttgtatcacaacatgacagagaaggtcaaacaggattctgatgcatgcaaagaaggaaccaaacaggaggaggaacctcactttatgacaacctgctctcatgggaattaatccagtcttttgagaatgaaaattctcttaatactccaagaatggcaccaaggtatttatgaggaatttgcccccatgacccaaacacctcccactaggccccactttccaacactgccacattggggatcaaatttcaacctgagttttggtggagaaaaatggaacacatccaaaccatagcaacaccattaaataacagaaagggagactctctaaaaagaaaaccaaataatgaactgggagactcttcaaaataaaatgatttcatatttaggaataggcattgtaatgggaataagtgggccatagtaaacaatatgcatattcaggaaggtgtaaaggaaggcaaaggttttaaaagacagaatgaggaggattacataattgtctttaagataattatctttggctacaaggatcaataacaaaggtggcaccagtctgaagttggacaggcagtttctgggcagatgtcctcacagaagtattttttgtgtatgtaaggtctttgtccgaggttttggtttttgcagtcttttgtaatagttctcattatcagatgtttttgcatgagaatcctccctttatagcctcctccagttctatttgtcatggtttttaacacaagcaactccattttgattctaacaactttcacaatagtgtttcctacaagctatgcctgagattaggatgcttgtgtaaatggtttattaagggagtgacctgaagaaaaacttgtaatgaagcaaaggaagcaggagaaggcaagataagaagctaagtaaggacatggcatcaggagaagcatagcctgatcccgtgggggccattaaaacacgaattacatcactgattgtcttgctcagtggtaaggaggatggacttttgtgctactgcatctgccatttattgatgaattgcttctgggatgagggacataaccttcctgacttatgaaggtgaggcagctcctatcagcttctgagaaggatgcagctgtgaatcattagaagccaaccctcagaaaacctggatgatgggtgcattggcccagaaaaaggggtatgagcagggtacaaacatcatctgctacaaccaacttacttgtgggaaatcaaaatcccctttggtttaaagtctgcctgtaagcatttaacagatacattcctaaagacagtagttaaatgtaatttaagtcaaatattaaagtgcctactgttagccaagctgcacaatgctaggtactgtggagaatattaagggaattgatcattatattcactcttgaaaagcttaacgtttggttggtgtgaagaataatatgtacataatattgtgaaatatcaacgataaggatgtaatcatatgttatagaaatggtacccaatggaatcagtggcagcatgcttaggtgatcagagatggacaactttgggctaggatacaaggatacaaagccctaggcaatctttaatattagtaaggatggtgagtctttatggtgggcaagtgtaaagaaaagcatcatggaggaaagtgggacttgagtttagccgataaggaatgatgaaggggaatgtgggaggtttatggtggagcaggaggttacaggatgaaaaacctgagtaaactttggagcattacacaatgcatgtgttgtgagggagcaatgaagagcatgacttagtttgtccagaggatttgtgttgcagggtagtggaaagagtatagccagtactgtaatcccagcactttgggaggccgaggcgggcggatcacgaggtcaggagatcgagaccatcctggctaacacggtgaaaccccgtctctactaaaaatacaaaacattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagtatagcagtataggatggtactggagtgtgtgaaaaaagtatagaaccaggcagaagaatatgaattcatgtcttagatagtgacaagctcctgaatgtttttgagcatgagaatgatctgatgaaatgatgctttaggaagggttgtctgggcaaaacaaagaagttgttggagctgtctttatgcacaacttttaaaatggattaattgactttaagatgtcagaaacttgtttatttaaatctttcatgttagtgacttgtatttggaatgcagttacttaactcaggtcttatgcttgactacattcagcttttcagaaacagctgtattaggtcatccagaaaccctgattttttttttaaaggtatcattaagtggtgagaaagaaaagactcattcaaaactttcaatttacctttcaaaccaaagcccagggataattattcataatcatttctaagtctgaaatgtgacattgttccatgagtcatcatctaggttttaaccacacatgcacaaaaaagcacaacataataccacacaggctatttgagaaagcattcagagaaatgttctgcctttttatgttgacttcctgtgtataaatctggaatcataaaagtccaaggacactcttcagtaggagtacattcagtaaacagcatgtgtggagcaacaactgtatgcagaactggagtagaagctggttacaagagaaagaatttttttttttttttgcctttggagatgctatagtagaaatagaatacaatgtttgaaaaatagaatgtttgaaaaatgtatgagaacatgtgtaaagcaatatctaaaaggggacacatgagatataaactgagaattaatgccaaagggctaggagaagtcacaaaagaggactcagacatgagggagtcacaaaactaattttctgacctgggccaatttttccttaaattggcgtggtttaccagaagaagagaacattgtgtttcccttcctggcaagtacttttggttgccgaagactatattatcagatggtgaaaatgttcattctattgatgtggttcctcagtggaaagtcatcacatctttctagaagagccaaaatcttttgtgaatgagctgtgttttatggcaagcttttataaatgattctagaattacagagtttctcatgccagaatatctatttgctctgggctagctagctaaaggactgacctctgccctggactatatagtaaatacctatcttcttaactcacaaatgaaggttcttagactaaagtttggacatgggtccagagaatatgacaggaatcaggattccagggcgatagatgaggcagcaaagtttggagctactgagtcagactcagctggagttggctactactaattcaaatgagctagggatcaagaacatggaatctaaaaggaaggaatggggtaagggaatggcaatctggaccagaatgggccagaagccaaggccaatatacagtgggaaaatggttattcaaactgggggaagctaggtcagtatagcaaaggtgaagccaaggctaaggacaacagtccagattcttcctagcaaagtgtctcacagaaatagagagcctgaatccttgagtatacaattaacagcacaggttttgaaatcagtctaaatacaaatctcaactctgccacctaccactatggtaccttgagtaaaagttccttaactgtgctaaggatctggatccgtttttttttttttttttactgtatctctctctgttgcccaggctagagtgcaatgacactgtagcctcgacctgctggacccaagcgatcctcctgcctcagccttccaaatagctggaactgcaggcatgcaccaccacacctggctaattttttatttttatttttagcacagaggacgtctcaccatgttgcccatgctgatctcaaactcctgggctcaagtgatcctcctgctttggcctcccaaagtgctgggattataggcatgagtaactgctgctggcctaagacctaattattgataatgaggacagtatagcatcttaccacataaatttgtggtgtgagttaaatgaggtaacacatgttaaatatctgatcaagtgccttccatgtagtaagcactcagcatggtaatgtaattagtgttagtattgctgctgcttctgttcctccaccacatcatcattcacacgattttggaatagcaaaacaacagtatgtggtattccaagaagactgaagcaaataatttgagaaatcttttttcttatggaaaagttctctaaggattgtgaaatatttgaaacagaaaatttcagttaccttgtattcaaatatttattatcttaaagcccaaagccttctaaatgctaaaactctactgtgtatcagatatgtcagcaagacaatattcacattaacaacaggaaaatgaatcgggacaaaatctgcagaagtgcacatgaaaaatggatgacagaaattagtttctaaccaaaagggaatggcttgatatgaaattggtaagaaattgttttccccatgaccttgaaaggtcatgaataattaaaatgccattaaaggtctacatttgttgtgaattcatgcatgtttagagcatatgtatacttaatcctggaacaatttcttatacctctttaactactcccactcctgccatacttagtaccagtgtcttatacataatgataatggacactcatacactgattgattcagcttatggagattggtagcttttattggcctttgcaaaacttaccttcaaaaactaaattaatatatgcattttgtagcttatcaagaataaaacattttaatagctttgattcatagataaaatttatagaggaaatgatttctgtaatatgcataaagacataatctgtgatttaatttattctaatcagaaagtgagatttcctaataaatctgcttttaactattctggttatttctaaacaattctgccaatttgttacctttgccctcaaactttactttctctgtttgaatgaagttggctgccttttatggtttacaaagcaattgaagacattcccacaatgccatattacttattagaatttttatgtgtgacaagccactctttcttcactttagcacttctcaaaacttacaggaataatattggttatcttatgggtcacagaacaaatacctattggactctggaggccagaacccctactttcaacttgactgctaagtatcttaatggtaagacaggcaggttgaggcttataggtttaggacataagatgttaaagctgcaggtggcagagtgttgagaaatgacattattctctttgtgtgtacatttatttgtcctttcttaatgctccaagggctgtagggtgaagcattgtaaagatgtaccagatcccagaaggttagcagttaaacatttttcagtttgcaaatgcaacaaaccatctcccatagtgtatttactatttcaaaaattgaccctctaaaaagaacatgcaatccctggaattcatggaaagactgggaccactttaatgagattcccataaagtgaaaactgtttattaaatgttgctaggatgttttcttgctggaaagtagtattgtgtgttcatattataaacattaaatttaagggccaagatggattgcctatggaagactcttgtagtctatcagcagtcctcaggtcacattttaagaactgagaataagtggagaatggctcacttgtacaacactattgcctgtgtagcacctctgaaagtcctcctactactcagattaatcagcgctgccatatggaatgtcattgccttcctttccctccaacctgttttttgtccctatagtacctgctgccaatagaatcatagattcatacatactaaaaaaaatcttcactttttaaagctaattgttagaatcctgcagttttaggggaaaatcaggtacactatatttagaataccctcaccttgatattgcaggaagcaaaattctcaattttttttcagtccgccagtactcagtcttccctcacttgggtcctaagactgaaagaggagaatctagattttaatacagttaataataatgataacaaggccatgtgttggtatgatgatgaaaatataaatcaaaatggtctttgatttaagtgataaatactacagtgtccaagatttgagattcctttgttccttgaagatagaaactattcattcttggtaccctaatatttagcagagagttttaaacatgatgactgctcagaggaagtttaaaaatgattgtaacttataggaattaaacattttatctacagtaaagagtttacaggattttcagaaatcagagaagggcttgacctcaaatgtaaacctgctattggtatgaacttcactaatttcctaattcagacccaaatgttaattttcttagagaatcataaaccacaccaaagttaaaaacaaacaaacttgtaaacaaattctaaacaaaatccaacttctttcattaaaactagtaattaaaggagaataaaattgatatgcatttactcaaagttttaggagcatttacctcttcaaaagaattcatggatcaactgaaacttaaacttttaaagattttaaaccactatctgtgtcacttgcttatctgtttggtcttggtttagtatgaaacatgtctctggtctgaaataaaagacgattgcatttcaaaaaagaccaatttataacaaaaaactcaaatcaggataatatgaatgaagtggtattacacataaagacaagagcagaagtcaagtttttccccaaaggatctgaaaatatcatcaagagtcaatgacctctcatttagcctttgaataagaagagtcattctttagctagacagctggctggaaataaataaaaatgggattgcaagtaagatcagatattaatctctttcccatattgctgagactctgaaacagtaatatggtactaaatttatacagataatggcttgattgacctaccctattcagctcttcttccattgaggttttgttcaaatagcttttaaatttatttctgatgaggctactagggtgtatgctatattgctaatatgttttttcaccaccttgaatactacatcaaccctaaagagttcattgttctagctgttctactcaaatatccatgggtctctctactcatggccatttatctacctatgaattttctgggtacaggaagaccaagagtaaaaggagacgatgaagatttttagtttgctgaaagggacataaaacaacctgaaaatgacacagaaacacctttaatagagtgctaaattgtgtgctaaagcaaggtcagagtggaacaacaaggtacagtgggaagagcaaaggctttgtaatcttaccgacttagttcacacccatgcccatcacataatgtctctgagtctcacagtctcctcatctgcagaaagcacttaatataatgagacttacctgacaggatttttgtgtatccaatgtgaaacatactaaagtacttagtacaatccctggatcccaattaatggtaggtgctatgattatcacagacagatatgagagaattggccatgaagctgtaatttagggaaaacataaattatttgatctgggtgagaaagtaattttttctaactggtataaatgtagccaccttttctataatgaacataatggacttcagaaaaccatatcctattacttgcctgtttggcacaacatatgtaatatagtttaatgactgtaacttcaggcatgaacctaaaactacttggaggtaatattgctttgcgttgcagtttcagtgaagtggacaggcagaatagagttcaattttacagtctgacctcttagtcattacttaaagccaccacagagccatttttaatctttgcattttcctctttgcaagtagtttctaagacagacagcgtgtcatactctaactaaatttcagattttaaaaaggcatttagctctgtaacttcagatgataaaaatccatttaatggagaatgttcttttgctgtctgcttggtcgataaattaaacagattaattaagtcaggctgtcaggaccaaggactgtcactaatgttagcctatggagctgacccatttatcagagactgaggctgaataaaggcagtctttgtcctgtaattctgtaatgaatacaaagaaatagcttatggagagaaaattctgtcacctgactgtatctcaaggcagagtagatgtggtgggaagaaaccctatcattgttattttcacttacttaattgatttgctttttccctatgtttctctgtatctacctttgtcctttgcatgtcataggaggctccttctcaatttgaaacataatcaataatgatttcctttgcttatctgaattggagctatgtgtgacacagtacacaccaaagatgtataaaacatcatccttaccttcgtagaacatgcacagaaataatacaggttaaagtatcccttatctgaagtgcttgaggtcagaagtgtagatttttttttattttggaatatttgtatatacataaccagttgagcatccctaattcaaaaatctaactccaaaatactccaatgagtatttccttttagactcatgtcagcactgaaaaaaatttttggaatttggagcattttagatttagaattttaggattagggatgctcaacttgtatatgactacgaaataaagaatcttggtggggaaccagaccagcaaagtggaaaaaagttaggttaaattggaatccaggattgtaataatgtgataccattaccaacttcatcaagcacttaagacttccaggtagtctttccagaggtcctgattcttggaccctagctatcttactccttttctttacccctcctttgactttgtccttggtgcatatgatctggcaaatatgaacttgacttctgcctagtattttccgccattactcccagagccttcctattaactgtattacctgaatttctaaatttagaaaaacttgctaaccactaccccttgatagaatgccaatgcagatcagatcagtggtctgtatgcccagcattctgactggaaaaggttccaaaaatgctttataaaaattgtttttgttgtcctttttagcatcagtctcataaggctaaggggtgaccctttaaaaagtctacttttctttaacaatccaattatttatctgcttactaacaaatgtttattaaatgcccactatgtggccaggcacatgcgagcactggggacattaaatatgtaaataaaatacattcagtgccctcaaagaactccctttatagtggaagacagacatactgaaaaataaaatatagactatcctcaacttatgagggttcaaattagtatttttcaactttatgatagtgtgaaagcaatacacgcctctacttatactcctctacttactatggagtcaagccataaccccattgtaaattgaggagtatctgtgtatatggtgtggtaggttctataaaacatatgtatagtcatcctttgatatccatgagggattgattgatttggtaccctcgagagtaccaaaatccaccgatgctcaggtcccttatgtaaaattgcatagtatttgcatataacccatgtatatctccctgtgtactttaagtcatcttgagattactttcaatacctaataaaatataaatgctatgtaaatggctgttatactgtgtttattcacgttttaaaattgttgtattgttattttttctaaatattttttatctgaggttgattgaatctgtggatgcagaatccacaaatacagagggtcaactgtaaaaggtaaagggtagtcagagaaaggttttaaaaagagaagtttgagctgggtctaaaggataaataggagtttgttaggcagacaaacggaagggggaggcattctaggcatagagcagcctacataaacacccagtagcatgaaatgacaaggtacaatttgaaagtagtttgatgaggctgaaaaggagtctaagaaggagaagtcttaggagaagtaaaagatgtccctgaaaaggctgacataggcttgaacatgggggtccttttatgtcacattaaagatctgaacttcattttgaagtatattgctgagctgcagtttatgagcttcttgccttaaataagtcattggttactgttatgtgctgaattgtgtcccatccccatcttcctccctcccctgccccccattcatatgttgaagtcctcatacccagtaactcagaatgtgactgtatttctagatcaagccttcaaagaagtgattaaggtaaaatgtggtcattagtgtgggccctaatctagttggcctggtgtccttataagaagagaagattaggacacaaacgcagaagaccatgtgaaaacataggaaaaagacttctaccaacaaaccaaaaaaagaagcccctagaagaaaccaatcctgtggacacactgatctcagatttctatcctccagagctatgagaaaataattttctgttgattaagccactcagttatcagtacttcgttatggtgaccctaacaaattagtacgattactaataatatagttccaaactttataaatgttaccttttaaaataaataaataaaaacattcaagtttattcctaaaataataacagggtgttcatttacttagagtttaatatgcttctttgagtataagagaaatcggtgatgccaccttaatattttggttaatgaagagacaagttcagatgtatgttaggaagattattctaggagcattgtggagggagtatcagaggacactgtgactagaaacaggaagaccagttaggaaagtgttgggggtctttatggggcttaataaatatcatagtgcccctcttctctgcctaagttctaaaccaattgagaaataaaacacaatgttggcagtttgagatggaaataacacctttaattctatgaaggctagacagttggaggatgtagctgagcatgaggaccaaatacacttattaattttctgtaccccagactggaacttggaacagcccagtcaagaaaaatttgaatctgagtatacttgctcagaccactgccatccactgggctgggtagagagggagaaagacactaaagcccagatccagccagttgataaatgtggatcatttaatcactcatacatttatgtaaaagcttttttctcttgtggcaggttggagagggatatagtcattcagatttattatagtaccccaaggtataacaaattccattatgttatatctgctatgtaacataagacctttcatatgaaaagctaaattaaaaagttgctactaccaatgccctttccctttttctccacctcagaagcttccaatgacagattatagaactaaattttgggaataagttaagaaccagggtaaattccttgcagacaacggtggccaagtgttctgtgaaattgtttcactgtctcaaacagctttgctgtagtcaaaagctcatggaacagctgttaattcctaaagtattcttctaagctgtaaagaatggttgacttttgccacctggcccagctaatcagaagctgatttcaaggactaagacatagcttctatcaccgtatttatgatgaaaatggtgtaagactaaatactatttcatgagctcctttggtccttcaatagtttaactcctcagttgaagagaagcacagttcatattttgagttgaatgatgatgtcacttcaattccaactctgaaatgtgaaatgattattgtcttcagccattttctcatcctgggaggcagagcttgtctaaatattgaaagccattgttcatgaatagtataagacttcctttagctttagggtccctaaaggctcccacacttgggggaagcttgttgtggaactgacactgagaactcttgtcataatacagagggcatgtgagccaaataaccaactttcttgaattctggatgttgccttgcaaactggcattcacttaacctataggctgtgttataaagagcccttggattcccacattgcatcttttcctttcaattttatagattgatcaacaaacttcagaggccaagcaaaaagtaaaagagcccctcaggctaaagatagtccttatttgggaacaattattaggtatcacattcattgtttctgagctctgaaaacttcaaggaaactcactatgtttctcgaacatatcctaagatagcaaggcaggaggaaagtggcagagaaactgtttaagttgggaaaagatacaaagtcaaaacattccaagtggcatatttgagcacttactcagagtacttctggactgtttactcagttggattcggaacatgtcgtgatggttaatattgagtgtcaacttgattggattgaaaactgcaaagtattgttcctgggtgtgtctgtgagggtgttgccaaaggagatttacatttgagttggtggactgggagaggcagatcctcccccaatctgggtgggcaccatctaaatcagttgccagcgtggctagaataaagcaggcagaagaaagtggaatgcaaagacttgctgagttttctggcatgcatctttctcccatccttccccaggaagacctctggccttttaccaggatagatgtgcagtggggaaaggagaatgatcagaccttttgtggactactggacactggctctgagctgacattgattccagagggacccagaatgtcactgtggtcctccagttaaagtaagggcttatggaggtcaggtaattaatttagctcaggtccgacttacagtgggcccaatggatgcctagactcatcctgtggtcatctccccagtgccagaatgcataattggcatagacatacttagcagcttaagacatacttacccccacattggctccctgactggtagggtgacagttattatggtgggaaaggccaaatagaagccattagagctgcctctacctagaaaaataggaaatcaaaaacaatatcgcatccctggagggactgcagaggttagtgccaccaacaaggacttgaaagatgcaagtcttgatacctttatcatatgacataagatttatttacttcagatcagcatttaagtgttattaactttatgtgatagcttttaggttaaagattagtgtgcttctggttgtgtgaaggatagctatattatgttaggcataattatgaccttattgttgttatttgaagattatgtatgattttgggagatgtgtatgggttcaagttgacaaggggtgaacttgggatggttaatattgagtgtcaacttaattggactaaaggatgcaaagtattgttcctgggtgtgtctgtgagggtgttgccaaaggagattaacatttgagtcagtggactggaagaagcagacacaccctcagtctgggtgggcaccatccaatcagctgccagcatggctggaataaagcaggcagaagaaaatggaatgagaagacttgctgagtgttccgcacttcatctttcttttgtgctggatgcttcctaccctcaaacatcaaactccaagttcttcagcttttggactcctggacttaacaccagtgatttgtcaggtgctctcaggccttcggccacagactgaaggctgcactgtcagcttccctactcttgaggttttgggactcagactggcttccttgctcctcttgcagatggcctattgtgggatttcaccttgtgatcctgtcagtcaattctcctaataaactccccttcatatatacatatatcctattagttctgtccctttagagaaccctgagtaatatacatgtactggcagttgctttccttctatagtgaccacacaatctgtctgttatttataatggtacctttccagtggctattgaatggattaattaattaagagatgagtattcaaatgctagttatgcaaatataaagtcacttctgacctatggttcagacaatgaataaaacagtgaaatccatgggaacactgttttgcaagttttgggtcacaactcatagtgtgttgtagagtcaattcagtaggttacaactagcatttaaaagagataggattgaaggaaatagaaagtattggagtacgttgctcatatgaaggataattttttctttgttaaattttaaaattctatacatgtaagtatatgctagatcaagagtaaagtactttttttatatgagccacagtcaaaatagtttgagattggcaaactctggcccacaagtcaaatttggcataccacctctttttgtaaataaagttttattgaaacatatttatgctcatttattcaagtattcctagggcttcttttgaaatacagtggcaaaggagagtagttgccacaggaccttacagtctggaaagcctaaaatattttctctctgacttttcatgggaaaagtttgtggatgccggtattagaaaatactggagacctttaggcatagagagactagttttggtgatttagaaacaaatgaaagtgaatataatcgatttctatgtagttgggagttcatcttatttcttttggctcatagcaagcattgttagggttttaacacttcaaaatgcatttgaattgagctaatgacagataatttaaaaattggggccaaaaatgaatgtgtgtttcttgaacacagtcatgttcttaagtagtgggttgaggctatctatcctagtatatagcaaagattcctcactttttgtaaactttgtaaacactacccaagaagattctagaagccaacatgactggcttaaaacctttatatatgctttcaaaattgtatagccatgcatcctggctaacatggtgaaaccccgtctttactaaaaatacaaaaaaaattagccgggcacagtggtgggcgcctgtagtcccagctactcgggaggctgaggcaggagaatggcatgaacccgggaggcggagcttgcagtgagccgagatagcaccactgcagtctggcctgggcaaaagagcaagtctctgtctcaaaaaaaaaaaaaaaaaaaaaaaattgtatagccatgtaacaacaacaacaaaaacaaagacaggattggggaactaaaaatggtatcacaaggcggtagatacgatgcaagctatgtacaagaaataaagcagaatgagtagcatctaattgcctcttctctttccctactaaatattggctgcttaagttacttaccagcaagaaggattgcttcttatactcatctgcattagtttaaaccatgcttattgagccatacatacaagaactgcgacggatgctgatgactgtaacaatccacatggctacagagggtatgtggatgtgacagtgaggggttgagtctggagatattggtaatgcccaaatactgtgtgagagggaccctctgaaccaagctaaagagaaactggcctttatcctgaaggaaatggggagccatgggaggtttttaaccagggaggtagataatcaactatgtgtttcagatacactctttgcagtatgactgatggattggagggagtagaaactggaggaaggaaaaccaggtagaagattattttagcaatccaattgagaaataatgagggcctgcagtgagtgcagtgacctgtggactgtttccatgggtatagatgtgaaatgtgtttaggaataagaagcacaaaatttgtggagaggaatgttaacagattaatctggaagttaagtagggacctcttaatggaaggccttttacaccatatcaagggattcagtctttattgtaaaggcactaggtagggggtactgatggaaaatcactttgctgcagtgtaaaaaatggattgaaaatagacaagctcagaggtagagagatctcttaggagactatttccagaagacttgcttggaaagtagttttaagtgagactatgagcatattaagttcctcctattgcctctcagacacaagtagaacaatggaacaatgcagtcacaaaagtatacaatttagctatattgcaagattgagaatatattcttgatatgctagtagcaagatattggactgctccctcatgcaaagctctgaagttctatatgtagacatgtgtttgtgagatattaactcttctgatgggataggttattctttagggccactctccctctttagggtattaaattacctgtatctgctctgaaaaataccgacgaaaacaacggacccattccttcgttttcatttttgtttgaaatccagtgccaaggatatttgcaacaacagtagatgactgcagaaaagaacttgataacttgtccccaatggggcgtctgacatcatgacatcatctcacatatgtaattgttatttatttgatccccaaagaaacataagtgctgcttctgtggcagtagaaatttgcataaatccaagatctcctgtgaagctgtacccttccaattaatctttgcaaggggaagggattatagtcttctgtgaattacactgctaattaatttctacacaaatcaattttattttgccaaatacacaagtcaaccttgcacagctctgaatactacatatatccatcgtcttaaaaagactccagtcaaatcatcattccattctttctcaggaaggaaagcaaacacactggattgagacattttcttcccctttcgtgttaactttgatgtttgaaggtgccttgaataatcgtttctttttttctgagcatatgttaatgtcaaatattcatttgttttaatatcaatgattctgccttgtaaaacactgttgcctgggatgaaaatgtcaacttttcttgggcctcggtataactttctggccaattcttgaagttcttttaatgcaagttttttgtttttgtaaggggaaaagtatcttgtgtatccttagtgttattcactcaaggctctgagaaactgctgtaaataccttttacttttattttttattttttattattttaatggacaaattatacttgtatacatttatagtatacaatgtgatgtttgatatatgtatacaatgtagaatgattaagtcaagctagtgataacatatccatcaccttacttatcattttttgtagtgaaatatttgacttactcccatagctattttgacatataaaatgtattattgttaactatagtcatcttcctgtcttaatatatattttaataaaaacttcttccttttaaaataattttttccccaaaattcatatgccacttcatggttccctgtataattctttttttgctttgtctcttcctagagtgggaaagactatttcttttttttcattattatactttaagttttagggcacatgtgcacaacgtgcaggtttgttacatatgtatgcatatgccatgttggtgtgctgtacccattaactcatcatttaacattaggtatatctcctatttctaacagaactatatccatgaacagttttatccagaaggagctatagccaagctgtattacaaaagctataagaatgtcagtcacatgcagatattcaaacatagaaaaggggagaggctgtgtttgtgaggcccagttcccactcttctgatttcatttcttctttaggatcttttcaccaccaccaccacgctggtgcacatttctggtaattgttggaaaaacatctgggtggatgtagtgtgactactattttttatttatctctgtttagatggaattattccaaaagatctcttatatgtatcccctggagaccccatgctaacacatgcctctgggatgttgtggtttttccactatcactacaataaaaatattaccattgcaaccattttacaatagcttatctgaagaacattacaaattaaatgagcttagagacagaagtcagtgctatgtataagaatagtagctatttatttagtgcttacagtgtgccaggttctgggctaagcaaaatctatgtattttctcattttatcctcacaacaactctatgaggagattactaagaaagcttgctgtgttgaaaaacataataagcttgtgattactcttgcttttgaagaaaagtggtagtagggtcactctattgctttgaaacatattcctatatttaactatgaatagcagtaatgactaacatgtattgagtgcttactatgtgccaggcactatactaagcactttatctggattgctccaaagtagatactaggaatttatggatgaggcaaccaagaatcagagatgttaagtaactggctcaaatccgcagcataaatcaggcaagtgggatctaattcaggttttgggtgactctgaagtttgtgttctcaactcatacctcctattactagttgtcctatttgtctccccaccataccctgcattctttgtaactttctcttacactattatggaaaattgtcagggtggcattatattttctatctccgtgatttttctcaggataccttgtcttactggctcttctggaactgttctattctgtcctcctaaaagaaaattgtcttcaggaaaacataagtttcttttattttgttttttgttatttctaaattgttagttgtgagtaagggagctatttgtatatcttatggaatgctttctgtctgtcacttatctcttattggtaagtgacaccagggtcctgagttctctgtgaaaatgttctaactgtaaaaattaccccaattatgtaaccagcttctttgtaaactttcccctgagactctgaaagcattttcagatctccccaaaagacaaacatataaagaaaaagtcaaattaaataacgacttatataagttcttaaatgtctataatggaaataaatatgattttttaaagttccagagtatgaaaagatcccctgaaaaagtatgtttctattcatataaatctcaccaaatcggactaattggtcaaaaagtcagtttgtttaaaaatattttatattcgagttgtctactaaaggaaattttcttttataataaagtttcctttacaactgttttaaaatgtagaaagaaacctgcagaaagcctttccattgttccaaatgacatatttttctattgtcacatgataatacaaatctgggacaccacagtagaaatatagaacaaggtgctgctattgaatctccctggtccttaatttattcatttatccaataaaggaattatcttgttgatgtttaagttcctttccaactctgacattgtttttttccttaccatgggttctgaattacctttccattgttctaaaattctaagaaatgatagttatcctgtattttttttctgaattcttttcataccttgtagtaatgtaatgtacctaattctaaaatcccctgggtaagagggacaggaagatcttggaaggattcaaatatgacacacaaaggggattagaatgcaaactgagatatcttcaatattaacaaaatattgatgtggatgattccttctctcctaattaatccccattatacatcaaaacttcctgaacacttatgaaaatcagcatcttgaaggaacactttcatacatttgattaaattattttaaaagtggaggttagatttataatctcaattaagttataagttccttaagtgcagagatcatggttttgtcttactatccacagtgcctagcatcctaaaggactcatggtagtcattcagatttattgttaaattgtatctgttgttgagaagccttgtatagtgttgtgtataaattctggccaagatgatggacaaagcagaagggaaatattataccacaacagatgcataaaatgctaaagaaaataaattttaacatgcatagccaagcctgaaagtatgaaaggggtatctccagatgttggaaatgaagaagaaaataatagctaaagtggcggataataattgaagctttacaaaatgtgaaggacctggactctaaacacaacttatcttaggtgatgaggatctaatgcctcgtatgttgggagcatgagcagtttcaacctttctgggacctgaaagtcatacaatttggaaagctctccttaaaaattatcttacttttcaatttcactaaaacccatgaacatgtgcacacatatgtagggccattccttgggccatgaagggagcccatggacatgaggccctgaaacctaagcttcattagctacatggtaaatctgcctctgacttttgtcaaggtcacaagcttggtaaaaaccaaggagcttgacttaggttacctatgtggaagccagaaccagaaaagcaatgcatcatgtttgaatagctaccagaaaacctctgctagctggcttagggtcttgtaggtaattcactgctggacccaggctttaggtcacctgagagtgactagaacctttgagttgtagaaactacagccaattaatagatataaaatctagtttgaatatggtgactcgtctaatattcaggcaaaggcatctgtgaaaccactccagaggaggccatcacaacccatgacctatttatatcttctacagaaaatattctcatatatccatggaagatgaacccataaataaaaagtataaaatacatgagaaaccttaacaccaagaaatatacttcacagaacctagagatgagagaattcacatccaagcaaccagagatagcagagcaataaaaggtgacttcaaattaagaaatttataattgcgtatgtgtatatagacacacacacatagaagtgcatatatgatttttaataaagtctcattcctttgtattagtcagtttgggctgctttaacaaagtaccatagatagggcagtttataaataacagaaatccaagatcagtgtactggcatagttgggttctggtgagggctctcttctgggttgcagaaaagtgcaagagagctctgtgaggtaactattattaatacaatggcatttatctcatttttgaggactccacattcgtcactgagttacctccaaaaaagccctaccacaaaatactgtcacattgggattagaatttcaacataagaatttttgagggacacaaacattcagtccattgtaatcttcaagtgtatatatcattttgcttcatgtaagttatattagctttggttaagttatgttgcagtaataaacaaccccatgatctcaccggcttaccaatagaaggttgatttctcacttttgttaggagttttctggaggttgactgcagctctgctccatgttttcttcactaacagggaagcctctatctgggaccttgacactttcaattcagaggaggaagagcaaggcggtaaatcactcgatggctcttaaaagttctaggaagcagcacatatcacttccacccatgttgcattggtcaaggcaagtcacatatccagacatgatgaaaaagaggtagaagtatataatcctcctgtaggaagggacagtgaatattttgaacaaaggatacaaaatttgatttgacaaataagaaatatttgatattagcaaatgagtccttctgatatgtatatagaggcttgaaaatcattattttatgtattaatagtttttccttgtaattctacaggctcttagcaattcttcattgatatgataaggattatcataatctgatattcattaaccttgctatgaatgccagaacaggttagttccaatggcaacactcatcttctacccacaaatcacgtccacttcttggactgatctttgatgctgccaggatacaggaaagtgaatagccgtgttaatcttgacactcatatgataaggattatcatcattatcatatcactttcaaattagctggatccaaatatacagacatgaatgtttttcccccaactctgcttctaaatcaaagttctttcccaatctttatcttgtctatttacagacctctaaagtatgatttgattatttttaactgtctgtattcctctctctctctctctctctctctctctctctctctctgaaacttaggatatgcatagataggatcatgggcagggtagatggggtggaacatgtttttctttcctcaccagggaaatttgatattcactaaccttgctatgaatggcagaagagattagttccaatggcaatgctcgtcctctacccacaatcaggtctacttcttggactgattattgatgctgccaggatacaggaaagtgaataaaaagaaaagccatgttaatttcaagctccatttagaaacacactagaaaaatcaatggctggtaagtagaaatcggcaaaattggcaggaagaatttttacattcaagcatagaaggggctggaatataaatctgcacactgaccagataataaccagataaaatgatgatgatactagaaaggcacttgacaaggctttttcctaatgttttagtgcactgaggaatgttcacctcttagattcactgaaccaagattctgtcatttaaaatttggggattaaagtttgtcattagttttctcaagccttactgatttcacagaactgaagtaggcagatactggctcctggaaggagtgattaaccagcaactttagtgctaaaggaatttaggaaatctggattttagtggggtatacttatgggaggccctcttcttcaggtttaaagatcattttctatggtgaatttaatctcactcagtgttacatctgaaaaatgggatattattctgagatcttcctcacttattataaaagaagaggttttctaactttgtgatgctgagagaattacttctctcatccccatgtttaccaattctcagcaccaacctgaagtacatttttctccatgaagcctgccctggcaattccagccttcacttctttttgtttcttcttgtgaacttctagggaaatgtatggcttagagacactacaatcctatggtcttcagtattgttccttaaattgactcatacttattggtttattgagtatctattctgttgggtattgtacttaacactgaggataccaaaaatagatatggcccctacctcaagatgcttacagtctagtgggaagaagagagagaagtaactgggataattaaaatacaatatgaaaaagaaaccatgtgaaaagcaccaagacataagcacagggtgctgtgggagtgctcagttgtgtatgttgttgttctatccaaccagagattaagtttctctaggacaagatccacatcttccacttttctcccattccccgtagtgcctgacttatactatccttggtctggaactcttttccccccacagatatatgcattccttgatcactgtattcttttaagtctttgctcaaagatcaacttctcagagacagttgagctatgttattcaaaattgtttctctctcccatccaccttacacacatacagtcacattctagaagcacatattttcttctttccttgctttatttttctacttagcacatatcaccatctgacataccatatcatctacctatttaattttgtttattatctatcttgcctgctagaatataagctctatgagaacagggattatatctgtcttgttactatttttttttttctctagagaggcctgtaacagtacataacagttacttacagtaactttaaagatattggcttaagttatggatgggtggtaacagtgcaagttggctcgcaattagtaattctttagtgggttgaatgatttctcttttaatcatttaatagagaaactaccactactgcctctactactacctctacttttaatttggcttgataatgaagggcctgttctgcaattcttagaccctgagaagttgctcttctggatacatgtcagatcccccataactatgtagcaacagtcacacttgctgccttaagcctctttcaccctctgaaggcatttagcacatggaccatgctttgagaattacagacacagttcatgaaatctctcttcttaaatttatatttaacagttaccatatgttcatgaccatgataattttgccccatacatttgtttttatttggggtcttgcatggtaggaagactttaagaagtcaaagattattttttcgtcttttcccacttaacaaaatcaaaatgtttcttaatgctgacgtagttactaaaacctatctatacaaaatagtttgctacttctaaggtaaagattgaaaaaatagtgtcaatttctgtttagaagatttctattattgttcctagtggaggtacaaaaactggttcacacacacaaccaaatcactgttatatagctttctttttttttttttttttcaagggacatgctgaattttattttatttttttctctgtaacaatttcttttattattattattattattattattatactttaagttttagggtacatgtgcacaatgtgcaggttagttacatatgtatacatgtgccatgctggtgcgctgcacccactaactcgtcatctagcattaggtatatctcccaatgctatccctccccgctccgcccaccccacaacagtccccagagtgtaatgttccccttcctgtgtccatgtgttctcattgttcaattcccaccgatgagtgagaacatccagtgtttggttttttgttcttgcgatagtttgctgagaatgatggtttccagtttcatacatgtccctacaaaggacatgaactcatcattttttatggctgcacagtattccatggtgtatatgtgccacattttcttaatccagtctatcattgttggacatttgggttggttccaagtctttgctattgtgaataatgctgcaataaacatacgggtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctaccattccttctgaaactattccaatcaatagaaaaagagggaatcctccctaactcattttatgaggccagcatcatcctgataccaaagccgggcagagacacaatcaaaaaagagaattttatatctttcttttgctttttatagcatctaacttcaggtaaagtttttgttaagatttttgcatgtcactttttggaaaacatttaaaatcagcattagtgtagaacttacacatgtaactattcaagagaatgcaagatgaatttaggaataatttctgagtcagatttacaatgcaaacatcaaacatgagcaatagagctattaaccttgaatcaattgagctgtctgtacatacagggcattttttttttcttgagacatacccaggggtaaaggagataacgtaaactcagtctgtgaataaacaatattgtttactggaagagatggcaaacaagctcatagagaagtaatggacatgcagaagatctggaaaaactgaagtaaggcttcaaataaatttgggaaagatttagtaaaaatctaagcctccacacagtagcacattattggctagtgttggagatggcttataggaatctttatggactaagattcttctggcttttattccacagatatctctctgccaagtggctttatacttcccttactgatacttcacatatctttgtgtacattgttagactgcatggactaagtgtggtaccttgcgtctgtaccatgataccagttagcatggaccccggcacattggatcattcagaaatgtagtttcaccacactctgtgccaggtcataatgatcttccctttgatctggctttccactaatattataccatccctgatgtgacaattcaatggttatctgaatttcttatatatgagtaaaataataataacaatgatgatttgtcaagcactttatatccagcaggcactgtgctctgtgctttatatattactgtctgttttaatcctcacaacaacccaataaggtatgtattcttattctacacatttcaaagatacagaaactgaggcacaggaaagttaaatagattgctcaacctcacttatgcatttgtctactctattagctttgctgtgatttccacaaaggtagatatcagaaggtgtgaattctcttttgaagttggttctaaacacagtgttatgtatatttagatggctaatcatagttaaacttataagtgtgtcaagtaattttagggcctcctgggaggtctctttgttctcccagatatctttcctactgaattgctgatgcctaaaatcttgcaattcagaaataccttatgttggcttgaagcttcttgttccctgtttaaagggcagatatttctggaaggataattctaaaaaatattactgggcattcatgtaagtatattttattagcttcctttttttttgaatgaacaaattttgatgggagcaagtttcgaaaacgtgaggacccaggatacctgaagttggcaagaaaaatatagtatcaagggaaatatggaagaggaagacattaaaggtacaaaaagttcaacttcatcttgatttccaaccgagccaacctcagttaataaacagttttcaatgactcttttggtaggaattattacaaagttatataaaatattttatcatagggaaagaatcggattctttgtaaatcaggctctggtttgattttagacttttatatttttattaatttgtgcatatttaatgtaaatgactaaataattatgtagcgatccattgctagttgaaatttagaatggggcattgccctaaggcaatatctccagatcagtgaaaattctccttagtcctaacctttctttttatgtttttaattgcaaaactaaaaagcaagcaaacaaacaaaaaacccaaacacgttaatttgtaaaagagaccaagcaaaactagtaaaaaaaaaaaaaaaaaaagagtgcagaaaacatagccttgctctatgaaattgacagcactttggtgtctgcattttcttgcaatattaatgagaaagtcaagcatcatgtttgtgccaaatggcaacttgtttgacacacaacagtttcattttcaagtgtaatatgttgattctttattggattatttcaggttttctttttgagtaaactttatatttcctttgctgtagtatatacaacattaaattcttgccctaaaccaattccttccagatatgtcaagctctccaagtctggtgcaaattatcacagtagtttctgctggaattttatgttgtattttgtaaatgtagcaaattgacttcatcctctacataggtatgaggttagctatcatgagttgtttcaggacaggatctcatattttctggttcacagtcatatgatttgtttgggtccttttcagtgagatgggaggaaagtggagacttacagtgagaagtactctaaattacaagagattatcaagacagactaagtctggactgaggattgattttcaggtagccaagtaggatggccaacttgacaattaattagggtaatgtgaaaagtgggggagtgtgtagagtgagttgattgcttggtaatcaaatgatagtacttctcattttctcctgctgagtacgctaaatctgttttgcaatttttttttatctgctactctttacttctcctttaagtaattgcagtaagtcacaattacgctagtcatctcctctgacaattatcaagtttcacctcaaagaatgcctggaacaaattatgaaggaaaaatcttagaattggggacatatggccttagcagagtaagctagtaaaattctcccatggcaaactactgagtaaagcttctataagacagccctgccagagattggcacccttcctaacccccaagatgttagtagaggatagtacttcttcagagaaaaagcgtacagtagtcccataagcatatagcctctgcagtggtctaccataccatagaccttccaggaatcagataacatttatttttccactaacttttcacaagaacatagaatacattttcttgtagaagatttagacaagtaaggctgtttcttacatccattattttccaggaggatggcctgtcccccagatccttacttgtttatttccatcatccaagttcatcacttagaaccctctcctaagcaaggacacagcttcatgattcattttgcatataataaactaattaacaagtacatcacaaaaatcaaaatttgctacagttcaaataggtctatgtgattcttatcacgcaaactgttcgaagtaatgcattttgatagaattgtagtatcttacaaattaaaatttctgtcacaaaactatacctttctgttttccaaaatcaaaggtgcaatagaataagcaatccttcaacacgccatcaacttttgagtcccatgattgatttttgtaggctattaatgatttatgtttcacagcattaggtgacatagattgattttgagtcctaaatgtttcaataacgacctcattttgcggagtggttattaatgtggtagtatagtttaacagcactacacccttttaaaagcagtttaatatttttttaagcaaaactaagattttacacaaggtcattctaggctctcaaactttattttacataacgtaaaatttttataaaaatgtaagattatcatctcattttaagatggcattttattaattaagagtgaaaatgttaattttgtagatatttttcatgcacctagagaatattttaaacacataaaaaatgagatatacctttctttacaattacgttctttgctagtgaacatgggagtcttcatttcccttcttacaaatattgctgaatttaattcagtaaaagtggtcatttttcatatttatctgtaaattgcactgaattttgttgtagtcacattaggaagtaatgatttatatgctttctaattatttatctgcttatataagcatagtctcattttagaaatgttattgaattaatgttgtaatacctggaacaaagaaaaataatttccatagactaagctctgcttttcagaaatctgatcttgttttgcatgctgtactctgtaatataggtaaatgcaggtgccaatcaggcaatttattataaaatttaaatagacgctgggaaaagtgcatagaaaatgcttatctactgaaaagtggctgttttcctgaatataaactctaagaggctgaaaccaaatagttaaagtatctgtcctattgcagaactagggacacaatacaacctgaggagttactggttgctctcttttattcccatgtgaggatattggaatgagaaggtgcatggcagttgtatgttctggaaagcttgtaatatagacaagagaaggtggtgagaattttttgagaacttttccctaagtcttctgttaaactgaagcttagagtaactcacaaataagtgaactaaaaaaaggagataaaataaatgtttagtttttaaaaatgctacttttatgaaaaatccaagcttaccactaaagaaaaaatattctaccatgttcaaagtcatatttggtcaacaggcatatatgcttctctttatggaatacttgtttcctgaaacaacatgaaaatctcattttataatagactggaaattattgtttacaacatgtaaatatgcttacagaaatgtgcagatatgatatacaaatgctgaaaaaacacggaagaataacaaaaagttggggcctggcttcaggtatatttttaaagccttttaagaagaattcaaatgatggaaggggcataagttggtgtggggactatgagcaaaagaaattcatgaggtgatatttttctttctaaataagtacccattttcaatgattaatgtagaaaattagttgccttgttggaagctgttatttattgctgaataacataccatcccaaagcctatgccttttaacaataactttcaacatccatggtaatgagaggtgaagccggctgggcttctgggtcgggtggggacttggagaacttttctgtctagctaaaggattgtaaacacaccaatcagtgctctgtctagctaaaggtttgtaaatgcaccaatcagcactctgtaaaatggaccaatcagcactctgtaaaagtggaccaatcagcactctgtaaaatggaccaatcagcaggacgtggatggggccaaataagggaataaaagctggccacccaagccagcagtggcaacctgcttgggtccccttccatgctgtagaagctttgttctttcgctcttctcagtaaatcttgctgctgctcactctttgggtccgcactacctttatgagctgtaacactcactgagaaggtctgtggcttcactcctgaagtcagcaagaccacaaacccactgggaggaacaaacaactccggacgccccacctttaaaagctgtaacacacactgcgaaggtctgcggcttcactcctggtcaagcgagatcaagaacccactggaaggaagaaactccagacacatctgaagatctgaaggaacaaactccggacacaccatctttaagaactgtaacactcactgtgagggtccgcggcttcattcttgaagtcagcgagaccaagaacccaccagaaggaaccaattccagacacattttggtgaccacaaagggactatcacctatcgccaagcggtgagtaccattggaccccttttgcttgctattctgtcctatttttccttagaattcgggagctaaatactgggcacctgtcggccagttaaaagcgactagtgcggccaccagactaaagacacgggtgtcaggctttctgggaaagggctctctaacaacccccgactcttcggagttgggagcgttggtttgcctggaacaagcttctgcttttcctgtacttctgggctgagtcaaggtcaacagagaggaaagccattcagctccagggtcccgacaacaagttggttgaccctgtgaccatgagcggaactctcgaagtcatgttgcccaagcgagactcgcccatctattctatctatcttgacccttgcctcttgggtcctaatgcctgccagacaaacttcctcttgcctcttctttgaggctagtcccacttctaaaaaccactccctatctctggtgcttttctagtttctcctataagaatgatttctagtgtaaactccaggactctgttaccttctttaggcacccaggctcaccaatcagaaagacataatttttacccaaagccccatcacaggggggactgcctggaattttaggatccctcctcagactagcaggcctaacaaaagctattcctgaagctaggatatggggaacctcagaaattgtatccttcctattcatataagtgaggacaaaaaacatcactcttccaactctggagatccctcccctccctcagggtatggccctccacttcatttttggggcataacatctttataggacaggggtaaagtcccaatactaataggagaatgcttaggactctaacagattttcgagaatgcatcagtaagggccgctaaatccgatttttctcagtcctctttgtggtctaggaggacaggcaagggtgcaggtttttgagaatgcattggtaagggccactaaatctgatttttctcggtcctctttgtggtctaggaggacaggcaagggtgcaagtttttgagaatgcatcagtaagggccactaaatcagaccttcctcagtcctccttgtggtctaggaggaaaactagtgtttctgctgctgcgttgatgagtgcaactattccaatcagcagggtccagggaccgttgcgggttcttgggcaagaggtgtttctgctgctgcgtcagtgagtgcaactattctgatcagcagggtccagggactgttgcaggttcttgggcaggggaagaaacaaacaaagcaaaaccatgggcaattttgtctttcagatggaaaacactcaggcatcaacaggctcacctttgaaatgcatcctaagccattgggaccaatttgacccgcaaaccctgaaaaagaggtggctcatttttttctgcactatggcctggccccaatattctctctctgatggggaaaaatggccacctaagggaagtataaattacaatactgtcctgcagcttgaccttttctgtaagagctaaggcaaatggagtgaaataccttatatccaagctttcttttcattgaaggagaatacacaactatgcaaagcttgcaatttacatcccacaggaggacatctcagcttacccccatatcctagcctccctatagctccccttcctattaatgataagcctcctctaatctcccctgcccagaaggaaataagcaaagaaatctccaaaggaccacaaaaacccccaggctatcggttatgtccccttcaagctgtagggggaatggaatttggcccaacccaagtagatgtccccttctccctctctgatttaaagcagatcaaggagacctggggaagttttcagatgatcctgataggtacatagatgtcctacagggtctagggcaaaccttcaacctcacttggagagatgtcatgctattgtaagatcaaaccctggcctttaatgaaaagaatgtagcttcagctgcagcctgagagtttggagatacctggtatcttagtcaagtaaatgatagaatgacagccgaagaaagggacaaattccctactggtcagcaagccatccccagtatggatccccactgggaccttgactcagatcatggggactggagtcgtaaacatctattgacctgtgttctagaaggactaagaagaattaggaaaaagcccatgaattattcaatgatgtccaccataactcagggaaaggaagaaaatccttctgccttcctcgagtggctatgggaggccttaagaaaatatactcccctgtcacccaactcactagagggtcaactgattctaaaagaaaagtttattacccaatcagccgcagatatcaggagaaagctccaaaagcaagccctgggtcctgaacaaaatctggaggcattattaaacctggcaacctcggtgttctataatagggaccaagaggaacaggcccaaaaggaaaaagctagatcagagaaaggccatagccttagtcatggccctcagacaaacaaaccttggtggctcagagaggacagaaaatggagcaggccaatcacctggtagggcttgttatcaatgtggtttataaggacactttaaaaaagattgtccaatgagaaacaagccaccctctcatccatgtctgctatgctgaggcaatcactggaaggtgcactgccccagagtgcaatggttctctgggctggaagcccccaaccagatgatccaacaacaggaccgagggtgcccgggcaagcgccagctcatgtcatcaccctcactgaggcctgggtatgtttaaccattgagggccaggaaattgacttcctcctggacactggcacagccttctcagtgttaatctcctgtcccagatgactgtcctcaaggtctgttaccatctgaataatgctgggacagcctgtaaccaggtatttctcccacctcctcagttgtaattgggagactttgctcttttcacatgccttttttgttatgcctgaaagtcccacacccttattagggagggatatattagccaaagctggagctattatctacgtgaatatggggaacaagttacccatttgttgtcccctacttgaggagggaatcaaacctgaagtctgggcattggaaggacaatttggaagggcaaaaaatgcctgcccagtccaaatcaggctaaaagaccccaccacttttccttatcaaaagaaatatcccttaaggcctgaagctgataaaggattacaggatattgttaaacatttaaaagccttaggcttagtaaggaaatgcagcagtccctgcaacaccccaattctaggagtacaaaaactaaatggtcagtggagactagtgcaagatcttagactcatcagtgaggcagtaattcctgtatatccagttgtacccaacccctatactctgctctctcaaataccagaggaagcagaatggttcactgttctggacctcaaggatgccttcttctgtattcccctgcactctgactcccagtttctctttgcctttgaggatcccacagaccacacatcccaacttatgtggacggtcttgccccaaaggtttagggatagccctcatccgtttggtcaggcactggcccaggatctaggccacttctcaagtccaggcactctggcccttcagtatgtggatgaattacttttggctaccagtttggaaacctcatgcaagcaggctactctagatctgctgaactttctagctaatcaagggtacaaggtgtctaggttgaaggcccagcttttcctacagcaggtcaaatatctaggcctaatcttagccagagagaccagggccctcagcaaggaatgaatacagccataatggcttatccttgccctaagacattaaaacagttgtgggggttccttggaatcaccggcttttgccaactatggatccccagatatagtgagatgactagaccactctacactctaatcaaggagacccagagggcaaatactcatctagtagaatgggaaccagggacagaaacagccttcaaaaccttaaagcaggccttagtacaagctccagctttaagccttcccacacggcaaaacttctctttatacgtcacagagagagcagagatagctcttggagtccttacttagactcgtgggacaaccccacaaccagtggcatacctaagtagggaaattgatgtagtagcaaaaagctggcctcactgtttaagagtagttgcagcagtggccatcttagtgtcagaggctatcaaaataatacaaggaaaggatctcactgtctggactactcatgacgtaaatggcatactaggtgccaaagaaagtttatggctatcagacaccacctacttagataccaggcactactccttgagggaccagtgcttcaaatacatacttgtgtggccctcaaccctgccacttttctcccagaggatggggaaccaatcgagcatgactgccacaaattatagtccagacttatgctgcccaaaatgatttcttcaaagtccccttagctaatcctgaccttaacctatataccgatggaagttcatttgtggagaatgggatattaagggcaggttatgccatagttagtgatgtaaccatacttgaaaataagcctcttcccccagggaccagcgcccagttagcagaactagtggcacttacccgagccttagaactgcgaaagggaaaaagaataaatgtgtatacaaatagcaagtatgcttatctaatcctacatgcccatgctgcaatatggaaataaagggagttcctaacctctaggagaaagcccattaaataccacaaggaaattatggagttattgcactcagtgaaaaaacccaaggaggtggcagtcttacaccgccaaagccatcaaaaaggggaagcagaagggagaacagcagcataagtggttggcagaggcaaggaaagaccagaagaaagaaaagagagaaagagacagaaagtcagagagagagagagagagagagaggaagagacagagacaaggaaggagagagagaggagaagagacagagacaaagagggagtcagagagagagagagagagagagaaagtcagagaaaggaagagacagacaaaaagggagtcagaaagagagagacgaagaagtcaaagagaaagaaagaccttctttctatcttccttctttctgacagcaatttactcctacctttaattcagcctggataaaatgatctcatcttccagagcaccagttttaccttcctatttactctttgcctatctatccttcctgcttccttggatacctcatacaatcacccctcaccttccactagctcctaattacctctacaagactctcaacctaacccacgctctgttaaaccagtccaatccttccctggcaaatgactgttggctttgtatctctctatcaacttctgcttacgttgccactcccattcctgcaaaaaaactgggtctttaccaacttaacctactaccctagttatgaaggaaaagaccctttccaacttctaaatatgcaatcattagccaaattccccatttctgataggaccaagaataccctaacaggacatgcaatccaacttttacattcttacatttcccacctcacctattacacaagcaatgaaaagcccatacacggcactgtaactatgaataccatcttaactttctaagttcctttatgcatccagtgcaacctgttatcaggcctgcctctggggcacctactaccccatcagcgtaattacaccccacaacttcaagccccaactgatcatagtaacttccgagtcacccaaacagctccattcagatggcttgtccgcttctcagggcccccaaaagtcatcatctcctccctacttaacaaacagtccaggttctgtaatggcaaacatactccctgcatgaccattcacccctggactccctgcagcagtgcccccaccactagtgaatgcctgctcatcccctctttcaaccactctctcaaaaggttcctagtcgatacaaaacggtgttttctccaatgggaaaatagaacacagggagccactcagtttgatcccaacacccttccacccgctcaccagagctaccttggcaagtagtctaggagtatgggaaaatgaaaacaacaaactcacacacctttttaacatacacaaacagttctgtctacccagccaaggtatattcttatgtggaacatcgacctatatctgcattcctactaactggacaggcacctgcaccttagtctttctaagtcccaacattaacattgccccaggaaatcagacattatcagtacccctcaaagttaagtctgtcagcacagagccatacaactaatacccctattaatagggttaggaatggctactgctacaggaaccggaatagccagtttatctacttcattatcctactaccacacactctcaaaggatttctcagacagtttgcaataaataatgaaatctatctttattttacaatcccaaatagacttttttttattgtactttaagttctagggtacatgtgcacaaagtgcaggtttgttacataggtatacatgtgtcatgttggtgtgctgcacctattaagtcgtcatttacattaggtgtatctcctaatgctatccctcccccctacccccaacccaagacaggtcctggtgtgtgatgttccccttcctgtgtccaagtgttctcaatgttcaattcccacctatgagtgagaacatgcagtgtttggttttttgtccttgcgatagtttgctgagaatgatggtttccagcttcatccatgtccctacaaaggacatgaactcatcttttttatggctgcatagtatactgtggtgtatatgtcccacattttcttaatccagtctatcattgttggacacttgggttggtccaagtttttgctatcgtgaatagtgccgcaataaacatacgtgtgcatgtatctttatagcagcatgatttatagtcctttgggtatatacccagtaatgggatggctgggtcaaatggtatttctagttctagctctttgaggaattgccacactgtcttccacaatgatagaactagtttacagtcccaccaacagtgtaaaagtgttcctatttctccacatcctctccagcacctgttgtttcctgactttttaatagttgccattctaactggtgtgagatggtatctcattgtggttttgatttgcatttctctgatggccagtgatgatgagcatgttttcatgggtctgttggatgcataaatgtcttcttttgagaaatatctgttcatatgctttgtctgctttttgatgggattgtctgtttttttcttgtaaatttgtttgagttctttgtaaattctggatattagccctttgtcagatgagtagattgcaaaaattttattccattctataggttgcctgttcactctgatggtagtttcttttgccgtgcagaagctctttagtttaattagatcccatttgtcaattttgtcttttgttgccattgcttctggtgttttagacatgaagtccttgcccatgcctatgtcctgaatggtattgcctaagttttcttctagggtttttatggttttaggtctaacatttaattctttactccctcttgaattaatttttgtataaggtgtaaggaagggatccagtttcagctttctacatatggctaaccagttttcccagcaccgtttgttaaatagggaatcctttccccatttcttgtttttgtcaggtttgtcaaagatcagatggttgtatatgtgtggtattatttctgagggctctgttctgttccacttctctatatctctgttttggtaccagtaccatgctgttttggttactgtagacttgcagtatagtttgaagtcaggcagcatgatgcctccagctttgttcttttggcttgggattgtcttggaaatgcgggttcttttttggttccatatgaactttaaagtagttttttccaattttgtgaagaaagtcattggtagtttgatggggatcgcattgaatctataaattaccttgggcagtattgccattttcacaatattgattcttcctatccatgagcatggaatgttcttccatttgtgtcctcttttatttcactgagcagtggtttgtagctctccttgaagaggtccttcacatcccttgtaaattggattcctaggtactttattctctttgaagcaattgtaaatgggagttaactcatgatttggctcctgtttgtccattattgatgtataagaatgcttgtgatttttgcacattgattttgtatcctgagactttgctgaagttgcttatcagcttatggagattttgggctgaaatgatggagttttctaaatatacaatcatatcatctgcaaacaagaacaacttgacttcctcttttcctaattgaataccctttatttctttctcctgcctgattgtcctggccagaacttccaacactatgttgaataggagtggtgagagagggcatccctgtcttgtgcccgttttcaaagggaatgcttccagtttttgcccattcagtatgatattggctgtgggtttgtcataaatagctcttattattttgagatatatcccatcaatacctaatttattgatagtctttagtatgaagggctgttgaattttgtgacaggccttttctgcatctattgagataatcatgtggttttcgtctttggttctgtttatatggtggactacatttattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgtcaggctttggtatcaggatgatactggcctcataaaatgagttagggaagattccctctttttctattgattggaatcatttcagaaggaatggtaccagctcctccttgtacctctagtagaattcggctgtgaatctgtctgctcctggactttttttggttggtagtctattattacctcaatttcagagactgttattggtctattcagggattcaacttcttcctggtttagtctttggagggtgtatgtgcacaggaatttatccatttcttctagattttctagtttatttgtgttagaggtgtttatagtattctctgatggtagtttgtatttctgtgggatgggttgtgatatcccctttatcattttttattgcatctatctgattcttctcccttttcttctttattagtcttgctagcggtctatcagttttgttgatcttttcaaaaaaccagctcctggattcattgattttttgaagggttttttgtatctctatctccttcagttctgctcttatcttagttatttcttgccttctgctagcttttgaatgtgtttgctcttgcttctctagttctcttaattgtgatgttaggttgtcaattttagatcttttctgctttctcttgtgggcatttagtgctataaatttccctctacatactgctttaaatgtgtcccagagattctggtatgttgtgtcttttttctcattggtttcaaataactttatttctgcctccatttcgttacgtacccagtagtcattcaggagcaggttgttcagtttccatgtagttgagtggttttgagtgagtttcttaatcctgagttctagtttgattgcactgtggtctgagagacagtttgttataatttctgttcttttacattttgctgaggagtgctttagttccaactatttggtcaattttagaataagtgtggtgtggtgctgagaataatgtgtattctgttgatttggggtggagagttctgtagatgtctattaggtccacttggtgcagagctgggttcaatttctggatatcctcattaactttctgtctcattgatctaatattgacagtggggtgttaaagtctcccattattattgtgtgggagtctaagtctctttgtaggtcactcaggacttgctttatgaatctgggtgctcctgtattaggtgcatatatatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttatgttgagtctatgtgtgtttctgcacatgagatgggtctctgaatgcagcacactgatgggtcttgactctttatccaatttgccagtctgtgtcttttaatgggagcatttagcccatttacgtttaaggttaatattgttatgtgtgaatttgatcctgtcattatgatgttagctggttattttgctcattaattgatgcagtttcttcctagcctggatggtctttaaaatttggcatgtttttgcagtggctggtaccggttgttcctttccatgtttagtccctccttcaggagctcttttagggcaggtctagtggttataaaatctctcagcatttgcttgtctgtaaagtattttatttctccttcacttatgaagcttggtttggctggatatgaaattctgggttggaaattcttttcttaagtatgttggatattggccaccactctcttctggcttatagtttctgccgagacatccgctattagtttgatgggcttccctttgtgggtaacccgacctttctctctggctgcccttaacattttttccttcatttcaactttggtgaatctgacaattttgtgtcttggagttgctcttctcgaggagcatctttgtggcattctctgtatttcctgaatttgaatgttggcctgccttgctaggttggggaacttctcctggataatatcctgcggagtatttttcaacttggttccattctccttgtcactttctggtacaccaatcagatgtagatttggtcttttcacgtagtcccatatttcttggaggctttattttgtttctttttactctttttttctctaaacttctcttctcacttcatttcattcatttgatcttccatcactgatatcttttcttccagttgatcgaatcggctactgaatcttgtgcattcatcatgtagttcttgtgccatgtttttcagctccatcaggtcatttaaggacttctctacattggttattctagttagccattcatctaatcttttttccaggtttttagcttctttgcaatggtttcaaacttcctcctttagctttgagaagtttgatcatctgaagccttcttgtctcaactcatcaaagtcattctccatccagctttgttccattgctggcaaggaactgtgttcctttggagggggagaggcactctgatttttagtattttcagcttttctgctccgttttttccccatctttgtggttttatctacctttggtctttgatgatggtgatgttcagatggggattctgtgtggatgtcctttctgtttgttagttttctttctaacagtcaggaccctcagctgcaggtctgttggagttttctggaggtccactccagactgtgttttcctgggtatcagcagcggaggctgcagaacagcgaatattgctgaacagcaaatgttgctgcctgatcgttcctctggaagcttcatctcagaggggtacctggccatggaggtatcagtctgcccctactggggggtgcctcccagttagactactcgggggtcagggacccacttgaggaggcagtctgtccgttctcagttctcaaactctgtgctgggagaaccactactcactttaaagctgtcagacagggatatttaagtctgcagaggtttctgttgccttttgttcggctatgccctgcccccagaaggggagtctacagaggcaggcaggactcctttagctgtggtgggctccacccagttcaagcttcctggccactttgtttacctactcaagcctcagcaatggcgggcgccactctcccagcctcgctgctgccttgcagatcaatctcagactgctgtgctagcaatgagtgaggcttcgtgggcatgggaccctctgagccaggcatgggatataatgtccttgtgtgccatttgctaagactgttggaatagcacagtattagggtgggagtggcccgattttccaggtgctgtctgtcaccgcttcccttggctaggaaagagaattccctgaccccttgttcttcccaggtaaggcagtgcctcaccctgcttcagctcacactcaggtgactgcacccactgtcctgcccccactgtcggacaagccccagtgagatgaacctggtacctcagttggaaatgcagaaatcacctgtcttctgcgtcactcacactgggagctgtagactggagctgttcctatttggccatcttggaaccatctcccaaatagactctttggcagcagtgactctccaaaaccaccaaggcctagacctcctcattgctgagaaaggaggactctgcaccttcttaggggaggagtgttgtttttatactgaccagtcagggatggtacgagatgccacccgatgtttacaggaaaaggcttctgaaatcacacaacacctttcaaactcttataccaacctctggagttgggcaacatggcttctcccctttctcggtcccattgcagccatcttgctattactcgccttcaggctgtgtatttttaacctccttgtcaaatttgtttcctctagaattgaggccgtcaagctacagatggtcttacaaatgggaccccaaatgagctcaactaacaacttctgccaaggacccctggaccaacctgctggccctttcactggccttaagagttcccctctggagggcactacaactgcagggccccttctttgcccctatccagcaggaagtagctagagcagtcatcacccaattcccaacagcagttggggtgtcctgtttagaggggagattgagagttcaaggcagctgggcttctgggttgggtggagacttggagagcttttctgtctagctaaaggattttaaacacaccaatcagtgctctatctagctaaaggtttgtaaatgcaccaagcagcactctgtaaaatggaccaatcagcaggatgtgggtggggccagataagggaataaaagctggccacctgagccagcagcagcaacccactttggtcaccttccatgctgtggaagctttgttcttttgctcttcacaataaatcttgctgctcctcactctttgggtccacactacctttatgagctgtaacactcactgcgaaggtctgcagcttcactcctgaagtcagtgagaccacaaacccactgagaggaataaacaactccggatgccccacctttaagagctgtaacacaccctgcgaaagtctgcggcttcactcctgaaatcaagagataccatgaacccaccagaaggaagaaactggacacatctgaacatctgaaggaatgaactctggacacaccatctttaagaactgtaacactcaccatgagagtccacagcttcgttctcgaagtcagcgagaccaagaacccactggaaggaacgaattctggacacagtaatatagatgactaggctcagctggtcacttatcaggatcacaggcagttattatcagatggctgtggctagaatcatctgaaggctcaagagagctggatgtcaagatagattcttcacacatgctcctggagcctaaaataggaggaatggctggggaatagctggacatttctcttttaatgtggcctttctacatggtgacatggtctttgtcgtatcatgatggtctaagggtagactttgaagttacatgataattatttcctttagagccattgttcccagagacagaaagtgaaagctgtgatttttaaaaatttctgggctcataatctgataaagagtcacttcatattctactggtcaaaatgctcacagagtctgccaaaattcaaggagagaggatatgaaccccacctctctgtgggaaaattatcaaacaatttgtgaccatcattaatctactataaaagttatgcaggatagattagcaggatgcttcttatgtttttgttgttgaaataacagggacaaggaataaaaacctgtgcagaaatcagaagatctacttttgcatatacaaagtgaagagttgcttgtaaagcaacaccaggcattatagtgcctgtgaccttgatattagaatcaccttgccctccaaaagtgccatggacatcacttttataagtcagattctatttatatgctctagagttgctggctacttaaaggagaaccttttgtaaagtgaagaaaagtttaaaggcattgaacacacaggaggtgcaatgataaatgttactttaccctctctcattccattagtgttttcttaaaggaatattgggtcctactcaagacttaactgagatggctgatcttaagtgttgaatataagcccccgttcttggtcttggaatgtgaacattattgggtatcattgacggagagattggcaaaggaaatcctgcaagagataggagacctaaattttcaataagtgttctacttggtttccatggaaactgggttaggtagtgaatctcacttgatgtgcacttctgtgccttcttgaacagatctttaggagtcggtaaaacaatagtgggatagcattaataaaatctggaaagacaagtacaggtctggtggaacaaaaggaattgtttggggacactggtgttgattttatgctactggaagtactttgagctgcatacaactcatgtagcatgctcaatgagagacaactaagtataggtatattagtattcacagttgcaagtgacaccaagctaaattgaatttaaaataatataaaatatctaagttttctaatccttatttcaaataagaatcagaaaaacaaaaggctggggttaacctttttctgcatttctgcattgcatggctgtcctgcctaacatcagccttcactgatatctccttaacttaactcttagcaaaccagacatgtagccagaactcttattccctgccaattttgtataatgacactgtagaaatgaaaacttaaaatagccattttttcccatgaaagcttttaatagccatccacaaaacttttcttggattctttgttttaatctctgagctgaacattttcttttgtttcttttatttttcccaacaagtcctccattgatgataatcttaggaaatacagttaagaaaatgatactcttccattagcactgtagtcaaaaaatcattttgcttctatttctgctgtcaattccttttttgttgagttgtttttgtatgataaaagattaataataagaatatactttttactgcaaatattttttttccctccagtgggagtataggtataaataccaagcaatttgaattaaacagattaagtcgtagtattgctattccaattgcttgtcattacacaggaggttatggttacagctgactatacagcactacctgagccatacattttacatttgcaatcggcctattatagatgaactgtgaaaattggagagagctttttatgataattggaagatgttttccttgaagtatgtaaagcccttgagagaacttgaattacttgcttgtaattttgttataagctttaatcctatttatttaacttgaagtttattgctcctgaatatattttcctatgtctttctattgagtgacatacatgctatattttcaatatttttatttgaatatcattacaaattttattttgctttttgttttcaaactcaaaaagttgttttcccttgggcatgattcatagataaatgaagttacttctgggttttaaattaggaatatcaatggaaatacaaagacagcctctctttgattgtacttggttctttctgtgttctgagtaaacctgacctaacatttcagataccaactgggaatctgtaggtgatgtgtgcaacattttatgccacacataattgtgtgctcttttctttttctttcttccccttaacaatctttctctggtttgactggtctcttccctgtttctgaatacctcatgctcattcctactttttgatccccataaaccatttctgtgcctagaatgccctctctcctcttcagaaccatccaagtcttctcatctctccccctgacaagatactccaacttatgttttactgtgttcaagaatatttaatataactactacagcctaaattaatctatcatctatgtgctcgtagcacttatttgctagaccattatgttggtacccaaccatatgtaatgacaccttgcttctctagagatgagaagtgtgagaaagcccacctgaaatgatgatcacagagctgctgcattatgggtacagattttactaacagccataatacacaatttaattttaattattagcgaacttcattatctgttttataaatcctcaagtgataagacacagccaattcccattttcctcatctgctaggtgatatctcatcacatctaagatcccattgattgtaagacacatcactcttttacgtaccacaaagaaaagacactgcccgtaaaactgtttcacaagagtttgctatcactttgaatttgtattttgtacatatcaaaagagctctttgtcatttaaacatattgttttgtttatcacatcaatctttaatttacctggcatacgggatcagatacattaatgcatgtttaaatagtttttttaatctctggaatttcttctttaaaacattctagaccagaggttcttaacatacagtacacagattcttgaaggcggagagtctctgaatagatatagtggtcaactattactgcaacaatgctacattaaaaaccaacccccaaactcactggcttaaaacaacaattatttattttcatctgtacatttgtaggtcagctggaggttagctgacctaggctgggctctaagctggaggttgagctcaggtctaccatgcatgtctctcatctttcttggaataaaaggctacgtggagcattgttttttctcatggtgatggcaacattgcaagaagaatgagcagaaacatacaatgcctcttaaagactagagttagaaattgcattatatcacttatattggaaaaagcaaattaggtggccaaagccagcatcagtggagcaaggaaatattctctgcctctggtgggaggagctacaaagacctatggcaaaggtcatgaatttagggagagacgaaggaatgggaacaatggtgcagcctactaaaatcagtttcaaggagaccaaaaagcctctaaaattctttgctaaaatgttgtatcataaagggatatttttctagagaacatgttcttactattcaccagattctcaaggagtgaatgggattccaaccatttccaagtgagaaccacttactttaggtccttctattattcctttgtttgttcattcaatattaatatacctcagttaatgacccaggattgatttctgtgaacattttaaaattttcaggtgattgaggagttggttgctttcttttgcttctttttttttttttttttttttttttttttgagacggactctcgctctgttgctcaggctggagtgcagtggtgtgatctccgctcactgcaagctccgcctcccgggttcacaccattctcctgcctcagcctcgcgagtagctgggactacaggcgcctgccaccacgcctggctaatttttttgtatttttagtagagacggggtttcaccgtgttagccaggatggtctggatctcctgacctcgtgatccgcccgcctcagcctcccagagtgctgggattacaggggtgagccaccgcaccctaccgagttggttgctttctaccaggtcatgtattttaagagcctggcaggctctaaaatttgatttggcagggctctatcagcaccaggtaacctttctgtgcttgaagcttagctggtacccactcccatagtgatgtgttagtgaatcccatatggaagaaacatagaggggggacattgaaacaagaaagacctggtttcaaattcctgccctgccgtttactacctgtgtcatctcaggcaagtaaataaacctctatgcacctcagtttccttttctgtaaaatgagagtgacagttcttatgctacaaggtcatcgtcattgtgaggattaaatgagacaatgtgtgtatagtatttgtcacatgttaggtgctcaacaaatgctagtccctctcattcccattattgtttacattatgctgacaattttatcctcattctgtaatataaatagtatgtccctatcctgtgaaatattaatgaagaaatttctgaatgctattcctttttattttttgtttttaaaaacagttattagctgtttgtttctatcagcagattctagacccagaataaaatcatatttacacttgggcgtttctatgagctctctttagcctttctctcctggtatgaacgttatggaagtaaagtagcttctttttccctcaaaggggactgccaaggccaaaaggaaattgaactttgtcttcctagtcacctctgatctttgacataacagagactgaggaggtgaaagctaattcttaccaagtactttttgacacagtagattgagcaataatggaaaaagttctgagatgttgtttttcacaaaattaccactgttaacctccaaattacatcaaccgaaacaattttttgttctttgaactctgacacagattgaacgagccctcatcaagagtaagaaaaaaaatttctctaggttagtaggaattggcctattttgaattctattccagccagtaaacatgctgttaactttgaaaattctgtgtagatttaaaaagaaatactctaatagctaggtattttattaccttttaaaattatttcagcctcaagcctaacagattatttagtaatgagtgacatttccgttgcagaatagcaggtggataattaatgaataatgtgttctattttcctgtctatatgtatatattctagaaatataactagtgttataggtaacagttcccagcttgatcaatgtaaataaatataaggcccagttttaaaaacataaacattttaaatctgcaatgcttttatatttcattcatcaaattctagtgagaaaggcattaggcatgtaaaaaataaaagaaaaaaattataaattgtggtgttctgggggagataagctgatgataaaggatatatactatccaaaaaggctgaaaagactactctttaaaagagtatcttcaatgcattttaaaattgatgtacattaatttagctaaattaacaatgggaaattaaatactgttcagcaagcttattgtcctattagaactgtagcttttttggctgcagagggggcattaaatgttgatgatattcaatacaatagccaaaacctttttattccactatggatttgctactaacgtgaatctttaaaagggagaaagcaagctattttgagggttctaatttagacaaggctaatgaattgtgaaaaaaatacattttcatcaaatgtcatcagctgaataagcaaatgcattaagttatcattttatatatgttggtcagatattattctctctcttcttcccaacaattctggtttcacagatgagaaattattttaaaagaaaaaaactttctaaggagaatcttcattaggctttcaatagagattcaccctggacacatctagaaatgtaaacaccatagtaaaaaaaaaaatgtaaagaataaactctcttgggagctgtttgagctggcttataacaaagggaaaagaatgggtgtccattggagtttctggaccctttgaggtcagttgtagtattgctattttatttatttatttttatttttttggagacagagtctgactctgttgcccaggctggagtgcagtggcatgatcttgtctcactgcaacctctgcctcccaggttcaagtgattctcctgcctcagcctcccgagtagctgggactacaggcacgcatcaccatgcctggctaattttttgtatttttagtagaagcgggattttgccgtgttgcccaggctggtcatgaactcctgacctcaggcaatccgccagcctcagcctcccaaagtgctaggattacagatgtgagctaccacacccagcctaatattgttattttatagataacgatgataaattacagaagggataagtagtgttctgttccaggtcatacaactagcaaatgtcaaagcaggattaaaactcagatcattctggttctaaactttcacctgtagtttggattgttgagtccaaggagaggaagatttttgggtcagaagattctgcaaaactgcctgcatatgcttgccttctattcacaaatatccctctctccttatttgtatattgtagtatcaccaactaatggccatttctgatggtcactgggtaagttgttcctctcttgatagctctgctctaacatggaaagtacttatcttcttttatatatatatatatatatgcatacacacacacacatacacatatatacatatgtagttttctttttaaattattctttttttctcattattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcaattcccatctatgagtgagaatatgcggtgtttggttttttgttcttgtgatagtttactgagaatgatgctttccaatttcatccatgtccctacaaaggacatgaactcatccttttttatggctgcatagtattccatggtgtatatgtgccacattttctcaatccagtctatcattgttggacatttgggttggttccaagtctttgctattgtgaataatgctgcaataaacatacatgtgcatgtgtctttatagcagcatgatttatagtcctttgggtatatacccagtaatgggatggctgtgtcaaatggtatttctagttctagatccctgaggaatcgccacactgacttccacaatggttgaactagtttacactcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcccccactttttgatggggttgtttgtttttttcttgtaaatttgttggagttcattgtagattctggatattagtcctttgtcagatgagtaggttgcgaaaattttctcccattttgtaggtttcctgttcactctaatggtagtttcttttgctgtgcagaagctctttagtttaattagatcccatttgtcaattttggcttttgttgtcattgcttttggtgttttagacatgaagtccttgcccatgtctatgtcctgaatggtaatgcctaggttttcttctagggtttttatggttttaggtctaacatttaagtctttaatccatcttgagttgatttttgtataaggtgtaaagaagggatccagtttcagctttctacatatggctagccaattttcccagcactatttattaaatagggaatcctttccccattgcttgtttttctcaggtttgtcaaagatcagatagttgtagatatgtggtgttatttctgagggctctgttctgttccactgatctatatctctgttttggtaccagtaccatgctgttttggttactgtagccttgtagtatagtttgaagtcaggtagtgtgatgcctccagctttgttcttttggcttaggattgacttggcgatctgggctcttttttggttccctatgaactttaaagtagttttttccaattctgtgaagaaagtcattggtagcttgatggggatggcattgaatctataaattaccttgggcagtatggccattttcatgatattgattcttcctacccgtgaacatggaatattcttccatttgtttgtatcctcttttatttccttgagcagtggtttgtagttctccttgaagaggtccttcacatcccttgtaaattggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacaatggggttttgtagatatacaatcatgtcatctgcaaacggggacaatttgacttcctcttttcctaattgaataccctttatttccttctcctgcctaattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgaaataacgtcccatcaatacctaatttcttgagagtttttagcatgaagggttgttgaattttgtcaaaggccttttctgcatctattgagataatcatgtggtttttgtctttggctctgtttatatgctggattacatttactgatttgcatatactgaaccagccttgcatcccagggatgaagcccacttgatcatggtggataagctttttgatgtgctgctggattcgttttgccagtatgttattgaagatttttgcatcaatgttcatcaaggatattggtctaaaattgtcttttttggttgtgtctctgcctggctttggtatcagaatgatgctggcctcataaaatgagttagggaggattccctctttttctattgattggaatagtttcagaaggaaactagttcctccttgtacctctcatagaattcggctgtgaatccttctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatatcccctttatcattttttattgcatctatttgattcttctctctctttttctttattagtcttgctaacagtctatctattttgttgatcctttcaaaaaaccagctcctggattcattaattttttgaagggttttttgtgtctctatttccttcagttctgctttgatttcagttatttcttgccttctgctagcttttgaatgtgtttgctcttgcttttctagttcttttaattgtgatgttagggtgtcaattttggatctttcctgctttctcttgtgggcatttagtgctataaatttccctctacacactgccttgaatgtgtcccagagattctggtatgttgtgtctttgttctcgttggtttcaaagaacacctttatttctgccttcatttcgttatgtacccagtcgtcattcaggagcaggttgttcagtttccatgtagttgagtggttttgagtgagattcttaatcctgagttctagtttgtttgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatttctgttatgtctgcttggtgcagagctgacttcaattcctgggtatccttgttgactttctgtctcgttgatctgtctaatgttgacagtggggtgttaaagtctcccattattaatgtgtgggagtctaagtctctttgtaggtcactcaggacttgctttatgaatttgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttatgttttccatttgcttggtagattttcctccatccttttattttgagcctatgtgtgtctctgcacgtgagatgggtttcctgaatacagcacactgatagatcttgactctttatccaatttgtcagtccgtgtcttttaattggagcatttagtccatttacatttaaagttaatattgttatgtgtgaatttgatcctgtcattatgatgttagctggttattttgctcgttagttgatgcagtttcttcctagtctctatggtctttacattttggcgtgattttgcagtggctggtaccggttgttcctttccatgtttagcacttccttcaggagctcttttagggcaggcctggtggtgacaaaatctctcagcatttgctcgtctgtaaagtattttatttctccttcacttatgaagcttagtttggctggatatgaaattctgggttgaaaattcttttctttaagaatgttgaatattggcccccactgtcttctggcttgtagggtttctgctgagagatccgctgttagtctgatgggcttccctttgagggtaacccgacctttctctctggctgcccttaacattttttccttcatttcaactttggtgaatctgacaattttgtgtcttggagttgctcttctcgaggagtatctttgtggcgttcactgtatttcctgaatctgaatgttggcctgccttgctagattggggaagttctcctgaaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcgtcttccatcactgataccctttcttccagttgatcgcattggctcctgaggcttctgcattattctcgtagttctcgagccttggttttcagctccatcagctcctttaagcacttctctgtattgtttattctagttatacattcttctaaatttttttcaaagttttcaacatctttgcctttggtttgaatgtcctcccgtagctcagagtaatttgatcgtctgaagccttcttctctcagctcgtcaaagtcattctctgtccagctttgttccgttgctggtgaggaattgcgttcctttggaggaggagaggtgctctgctttttagagtttccagtttttctgttctgttttttccccatctttgtggttttatctacttttggtcttctatgatggtgatgtacagatgggtttttggtgtggatgtcctttctgtttgttagttttccttctaacagacaggaccctcagctgcaggtctgttggagtccccttgccgtgtgaggtgtcagtgtgctcctgttggggggtgcctcccagttaggctgctcgggggtcaggggtcaggcacccacttgaggaggcagtctgccccttctcagatctccagctgcttactgggagaaccactgctctcttcaaagctgtcagacagggacatttaagtctgcagaggttactgctgtctttttgtttgtctgtgccctgcccctagaggtggagcctacagaggcaggcaggcaggcaggcctccttgagctgtggtgggctccacccagttcgagcttcctggctgctttgtttacctaagcaagcctgggtaatggtgggcgcccctccgccagcctcgctgacgccttgcagtttgatctcagactgctgtgctagcaatcagcgagactccgtggttgtaggaccctccgagccaggtggggaatataatctcatgctgcaccattttttaagcctgtcggaaaagcgcagtattcggttgggagtggcctgattttccaggtgccgtccgtcacccctgtctttgactaggaaagggaactccctgaccccttgcgcttcccgagtgaggcaatgcctcgccatgcttcggctcgctcacggtgcgcgcacccactgacctgcgcccactgtctggcactctcttgtgagacgaacccggtgcctaggatggaaatgcagaaatcacctgtcttctgcgttgctcgtgctgggaactgtagactggagctgttcctattcgtccatcttggctcctctctaaattattctttaagttctgtggtacatgtgcagaatgtgcaggtttattacataggtatacacatggcatggtggcttgctgcacccatcaacctatcatctacattaggtatttcttctaatgctatccctcccctagccccctgtcccctgacaggcaccagtgtgtgatgttcccctccctgtgtccatgtgttctcttcctaatgtattttaaatacctgagtttcctttttgtgtatggtcagtacagcaaacttgaatttctagaacctgatatagtggtgtcttgaggtttttgtttctcttttgttcctaatagtttttaaaaattttgtagctctcttcactcccacagcactctacatattcacgtgcacacctaattcatgagctctctatacagaaagaaataatgggaatgactgggaacatgctattaaatggatatattttcagatcttccttaaatcattttctttgcagccttctacttctaagaccgtatcatgaggcttattgacacaagggagaaaaagacacatgcaagtaatattaggaatgaaaaggtaatatgatagatataacagagatttgaataaatcagaagagattaatatgaagcaaccaactttatgccaataaaatagaaaacaaatgatatggacatattaatagaatgtataattgatcaacattatctcaagaaaaattagaaaaccttcataaaccaataagcttaagcatattgaattggtaataaaaattatcaacctcccatctcccgcccaaagactccaggcttatgtgattagatgattttattggaaaattttctctaactgtcaagaattaaatgttccaaattacattaacaatttcagaaaagggaaaaaagctacttaatttactttatgagactagcataaccatcataaaaccaggaaaaggcagaatctgaaaagtataggccaatcctatttataacataggtgaaaatgtctgaaacaagaaccattagacaattattactcaggtacaagccccaagagtcatctttctttcctgttttcctgcttatactcaatatctagtgagtgaggtcctgttgactctgcctcttaaacatatctcaaatctgttcaatcttctttgtcttcactaccaccataggcaagtgaacaaatatctcttcctgcagtggtctctgttcactctccactcttgctcttactgcagtacttttaaaatgtaaatcagatgatgtcgttcctgcatcaaaattctctaaatattttccatgatgtatagaatagaatccaaacctctcaccctggtctacaagtccctgcactatctgacatacagcttcatcaccatctcttgctactctgctccttgctcactgcactgtagacatactgatcttcttcctgttatttgaagagaccaagcttgttgccacctcagagaatttatattttctgttccttctgtctgaattactctcctgtaagtgtttgcaaataaatcttctccgtattcaggccttcactcaaatatcgctttctcagagaggccttccctagtacatctccctgtttcttcatttactcttcttcctaccttttactctgtatcccattaaccttcttattttgcttcatagtgcttatcagtatcctccaataatcattttcagatattttagaaatgcattgtccttctatcttttatcagctgcaggtggacagggatttttttttttctttttttcctttgttttgttttgttttgttttgttttgttttgctgtatttctaacacctagaaggctggggaggcactaaatatatattgcatgaataaatctaatgtaaacttccttaagtcacagatgagaaaactgaagcccagggaaggaatgtgacttgatcaagattacttgcccacctgggaatagaatcctttctcctgagttacagtatggtgccctttctgctataccacatgtttttatgtgcctctagccccataattctagtttcaaaaggcaatcccatcctctccctggtggactagtataagtattaatttatagagatgtttatgaagcatactgcaggcaaatcaatatgataatgagagttagatattgatactatattattttgtagctttccaatagtgactgtttcatttcaggattgctttcctttcagaggtaggaaaaatacttatttttaatgtgtgtgtctatcagcaaatatggtaaagcatgttaaggccaagcatgctgagctgatgacattaacttatcctaaataagtctcacatgagccaactggttcagattaaagccccttattcaccatgatgcaaagtacttttacaataaaacaaaaacaaaacaagagatcacatagcaagggtgtgtgtgcatacatgcctatgtgctgcaagttaataagtacattgtgtaagtaccatgagactgtgactgtgccagtggagatacaaaagaagtagcaggcataatccttatcatcaaggatcttacaaaatatagtcttgaaattactagaaaatagttctgatgcattatataagcaaggcaggatagtaagagtaagactgtatctaccagggccagtgagatacagaataagagaaaaatcactatgaggtagagttaatctgaacaaacaacacagagactatgcaatcaaaactatgggtggcctgcctttttactttttgtggcaagactcagtatatattgatatatcattaaaaatcattcattttgtttgtatgcaggctgttaccatcgaccacaggagacagagttttctaagactttaaaataattcttggaaggtaataaggtctggtagttgctttcgattttctaagcagaaacacagtgttcaagtaccctttgtctacattcagaattgggagtagggatgtttcctgacactgtggaatatttcacaaggtttcatcaaaatttcaaaatatcagtttcttcatggtatatcacttcaggtccctgagcaaactggaaggggtatgttctgttttgtttgctctgggtagcctatatctctggaatgtctgtttcctgtcaactgccactagagggaggctgattaagtgcatttcatttgtgaatggaattttaagcaacagtaaaggattctcaccaaacacacacagccctttcaggcctaatcctacaaacccaattaaaggtaatggacactctatttgatgaggcagttcagctaagccagcactctctgatggtagctagagaggttattcagaattttgcaaatgccatccatgtctgcaggaatttatgcctttatatcagctgcatagtagagccttctatttgcaacatgcaaaacagtaaccacatttcttctttaaaaatgtattagggaagaaattatgtactagaatattaggtttcttataataagagctatagggactttaaaaataggttttggttgctgggagtagaaatttggttgggagtgataaattttctgcatttatttatttctgaacatttccttaagcagtgtgtgcaggtaaatgaaaatattatcaaatttattttaaaataggacataagaaccagagcagcgtttctctaaatagggactgcctgcaataagatcactttgtagggggagttgtttaaaaattcagatccctagcttcacactagacctgctgaatcactctctgaagttagggcctgtggatctttactaaaaacaaacaaacaaacaaaactgaccaggtgtttctgatatactctaaggtttgacaacattggaaatcgaaattgtggagtaattacttaggagcaggtttggttagaaagggttacgcagaagggtaatgtgggtttggagtgctggtcaaatttctgacagctttttacctcatttgcatctcaatgttgtttctaaaaaaggaaatgctaaaaaaggaaagtgtctcataaaagagaagactaaaacattgtggcatacccacataatactatacaaccatttaaaataattttataaaatgatatataaatgcatctggaaagatattcttctattgttaattgagaaaagcaagtcacaaaacacacatgttgtgattgctttctttttttattattattatattttaagttttagggtacatgtgcacaatgtgcaggttagttacatatgtatacatgtgccatgctggtgtgctgcacccattaagtcgtcatttagcattaggtatatctcctaaagctatccctcccccatcccccaccccacaacagtccccagagtgtgatgttccccttcctgtgtccatgtgttctcatcgttcaattcccatctatgagtgagaacatgcggtgtttggttttttgtccttgccgtagttaactgagaatgatgatttccaatttcatccatgtccctacaaaggacatgaactcatccttttttatggctgcatagtattccatggtgtatatgtgccacattttcttaatccagtctatcatagttggacatttgggttggttccaagtctttgctattgtgaatagtgccgcgataaacatacatgtgcatgtgtctttatagtagcatgatttatagtcctttgggtatatacccagtaatgggatggctgtgtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgttggagttcattgtagattctagatattagccctttgtcagatgagtagattgcaaaaattttttttcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctcacgtttaagtgtttaatccatcttgagttaatttttgtataaggtgtaaggaagggatccagtttcagctttctacatatggctagcccgttttcccagcaccatttattaaatagggaatccttcccccattgcttgtttttctcaggtttgtcaaagatcagatagttgtagatatgtggcattatttctgagggctctgttctgttccattgatctatatctctgttttcttaccagtaccatgctcttttggttactgtagccttgtagtatagtttgaagtcaggtagcgtgatgcctccagctttgttcttttggcttaggattgacttggccatgtgggctcttttttgtttccatatgaactttaaagtagttttttccaattctgtgaagaaagtcattggtagcttgatggggatggcattgaatctataaattaccttgggcagtgaggccattttcacgatattgattcttcctacccatgagcatggaatattcttccatttgtttgtatcctcttttatttcattgagcagtggtttgtagttctccttgaagaggtccttcccatcccttgtaagttggattcctagatattttattctctttgaagcaattgtgaatgggagttcactcatgatttggctctctgtttgtctgttattggtgtataagaatgcttgtgatttttgtacattgattttgtatcctgagatttgctgaagttgcttatcagcttgaggagattttgggctgagacgatggggttttctagatatacaatcatgtcatctgcaaacagggacaatttgacttcctcttttcctaattgaataccctttatttccttctcctgcctgattgccctggccagaccttccaacactatgttgaattggagtggtgagagagggcatccctgtcttgtgcctgttttcaaagggaatgcttccagtttttgcccattcagtatgatattggctgtgggtttgtcacagatagctcttattatgttgagttatgtcccatcagtacgtaatttcttgagagtttttagcatgaagggttgttgaattttgtcaaaggccttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcattgatgttcatcaaagatattggtctaaaattctcttttttggttgtgtctctaccaggttttggtatcaggatgatgctggcctcataaaatgagttagggaggattccctctttttctattgattggaatagtttcagaaggaatggtaccagctcctctttgtacctctggtagagttcggctgtgaatccatctggtcctggactttttttggttggtaagctattgattattgcctcaatttcagagcctgttagtagttgttttctagtttattgaaagtgaaagaaaagaatctgaaaggctcaaagtctctcacattcttcagatggcagagaaaacaattcctcattagatttctgatgttataatgttcaaaaagagcaaactaactttgcaaaagaagattccttaggtcaaatgtggtcctgggtacaaatgaaactaggagtttctctatttgatttttatccacagatttgatttaaaaaaaaccttggggaagctcccaaattgattgtgggttctaaagggagggctttgccaaataaagtcactaacatgcaggaatggaattcttcaccaaatggaccaggcaaaaacaacctctgccctaattcccaaacctagaatgggttatcttattggccctggtagaaatgcctaattgccctttggagtagtctaaccctattttccaggtaagaatttaaacaccagggtttataaatgagtgttcccagctgaggtgagccatcagctgaaaagtgcttgagtggaaaactggcttaaaacgttgcctagaaacaattaatagaaacctggatattaagagtttcggactgaattctatacaagatgaagctgcttctcatgccagaagagacagaaaagacatggctctttggaaagtctcttctctttctataatctgtgctgatctgcagtagtggtgacttgtgattttactttaccagatatactaattactgccctaggtaataataccagagaagattttaggactccaaaaaaaatttatgtaacgtttgttaaaagtccaataattaggaaattagcaagttaggcattaactatagaattttccatggtctgtcgctaccagtgtttctcaactgaacgtttgcaattatctaacacatgctaactctgtcaatattttaccttttatttctggttggtaaccttaggaaaatagagcatgttcttaatcaaaccagagttccaggtttggtttcctactatagtaaccttggctctgtctcatgaccagagatcacaccctagccacatataaaggccataaggggaactgaaagactatgtgtatactttaggtatcctcattcatcaacaagtgatcatgtacttgtcataatcatggcatgttaactggaaaaaaaacaaaaaagtagaggaggagctgaaaaactatattctggttatgatggaccaatggggttacattaacacactatatttaatacatttatttaacatttggagaggtgcagggcaaagggggtttgcatctattccatgccttagcattttacttccacaacctatggtcttaacttctgttgctaacttagttatcactattcaaaatgtaagaaagagaacttgtttgctgatacctcagggatcataagattgtggattctgactagtaattctcaatatgaaataaaattaatagaggacaaaatggagtaaaattaacggaggcaaaatcttagttgagtatcctgttgtgttacaaagctcattggaccatggtctggaagcccgtatactattcttgatggtattaatttttattgtttctcaaatttatttttaaagccttgatgtcctttgaacaagatagcctatggagctcctctgtggtccctaagccacctttacaaaactttagggatttaatgaatatggtttgaaaagaaccaaactactggaaagaagctcaatggccatccataggaaaattcatagatgataatctcttcataagaggacgaacattaagaattaactagatctacgtatgtaacatgaatatgtttcaagcatgacatttaatgaaaaaataagttacaaaggatacacagcataggatactacattagacaactcttatgctacacttcaggtcctcttggcctcacaagactctggggactcttgggcactttttctttcttttttttttttttttttaagatggtgtttcgctgttgtcgcccaggctggagtgcaatggcgtgatctcggctcactgcaacctctgcctactgggttcaagcgattctcctgcctcagcctctcaagtagctgggattacaggcatgtgcgaccacacctggctaattttgtatttttagtagagacagggtttcaccatgttggtcaggctggtctcaaactcctgacctcaggtgatctgcctgccttggcctcccaaagtgctgggattacaggtgtaagccaccacgcctggcttttttttttttttcttttttctgagacagagtctcttactctgtcgcccaggctagagtgcagtggtgcgatcttggctcactgcaacctccccctcctgggttcaagtgattctcctgcccttagcctcccgagtagctgggatcacagacatctgcaaccacacccacttttttttttttttttttgtatttttagtagagatggggtttcattgtgttggccaggctggtctcaaactcctgacctcaagcgatccaccttcctcgacctcccaatgtgctgggattacagatgtgagccactgcgcccagcccaggtgctttttctgcccaagccaattttgtagggactaattctgtttgggctcagactgactttacaagggtacaatcttgcttcatgtctgttttgtgtgacttgtatgtcctgcatggaggcctctctattgccactgaggcataagaggccattggactggctcagcacccttgtctacacaactcagaagtgtgagggatgtaatgctccatggggagactctgaccaatggagactattgctggcagatcatttcttctcctcctcttccccaatatttactttactgagttatagtagtaaatacagtctcgaagcaactggtccctagaaatcaagcaatcaattgtgcttgataccaagcaatggccaactcaggatcatactttcctattaacactttttcccctgattcaccttttctttccccttacttctacaacactgggattacactaccaaatagtagtagcaacacataagattttgcctcaggctgtgctttttttaatgtcccctctaataaatctcatgttgaattatgatccccagtgttagaggtggggcctggtgggaggtgatcatgtcataggggcagatcctgtatcacttggtgatgtccttgtgatactgagtgagttatcgtgagatatggttatttaaaagtgtgtggcccctcccctcccctcccctctcttgctcctgctttcatcatgtgacgtgcctgcttctgcttggccttccaccatgagtaaaagctcccaaaggcctccctagatgcctagcagatgccagtgccatgcttgtacaccctgcggaaccatgagccaattaaaactcttttctttaaaaattacccagtcttaggtattcctttatagcaatgtaagaatggcctaacatgctagattaagacagagtccatttacatacattttaaaaacactaaaaaaggagagattaaagatgctgattagatacagctgggaggtgccttttctgtggaaaagaaccaaaatattgagtatacctgcacactctgaccagatcttttgagacaaaacactgaaattcaatagagaagtgacagaagacaccctggttgaagagggatgaagtgaggctgcctgcttggtattgtgagataccaggactggcccccagaccggtgccattcccaaggaagtgttgagggaagaaaccccgggacaccatattcccactgtggatctctgagttcctagctacaggaattcctccagactccttcagacctttggactggcagagggagctgcctggagataacacagacacattgcttgaaccctagtagagcccaaaagtcttcagtgtgctaggcagcgacagcaaaagctgactctgagctcccccacccccaccccagagctttgcatcctgccctaagttgttacaggtcctgctgtctgctaggcttggagagaacagggccagggaatgctcacatgcccaagacaggtcccactgccattgccatggggctgaggtacagccaaagcatgaaatcccacatctgctaaaccctcctaagactgccggtctggccattcccacaggggaggggccaacaacatagcctccattgtcccgcctaggtggtttgttgatggcctaggtgcagttcacccccctgtcacatgtggtccttgaccttgaggggccagtgaacaaatccgctggccttgtcccagtttcccaggacttgagcacaccatccaggtggatgaaaatgagattcgtagcctgatctctagcaggggaggagccctcactgtcagaataagagaagagcacagctcgggttcatgtaatggcatgggaactcccttcaggagaccgggccaggaagggtgtggcctgatagccatggtttctgcctcagggagtatcatgaatgcctggaatggcttggcaatctgggtacagattgcttgggactagtctagtcagttgggcctgttgccagcattgaatactggagggagatctcccaagtccagggtgcagcagctgggtggggtcccatggctgcctgctgggctgataacccctggcatccttcttaccctgagcgtgctctgtggcacaggagaggcgccgccaccccccactggagggttgtcccagtagcccgagagcagcccctagacccctgcgaaggtaagtgtttacgactgccttggagagcctggctgtgggcttgcccaacccagccctgcccagttttgccccctccagccaccttggtggtagagtgtggagcaggacccctgggagccccataccctgcccatttcaggaacaccctagtacttcccccatcaacaaaggccaagtaaaaagtccactgccatcagcgcaaatgctgtcctcggcaatcgccatctactggctgggacagcaaactgcatgacccatcacaactgcaaatatcactgtacagtgctcagctggttcttgcctgctatcgccacctactggccactagggtgaactgcgtaatctaatgtaatcgctgctgaaagaagcacacagtgctgggaaatgagataagcttcccaaggcctccacctctccatctctgttggtgtggcacagcacaccactacaacaacctacaaacaactagcatcttagaaaaccactacagtaaggctatctataatcaatgaattaatacagagtgttggtgccctaaaagcacaaagaagcaaagccgaaggactctacccaacatacacaacagtaacacactcaagcggggaagaaaaaaatcccaccgaaatgaaagtaagtttaaaaatagaaagtgacagcttctacacatgaaaagggaccagtacaagaactccagcaacatgaaaaaacataacgttttgacacccctaaaggaccacactagctatctagcaatggatcctaaccaaaatgaaaacttggaaatgccagataaagaattcaaggtatggattttaaggaagctcagtgaaatacaaaggaaagtggagaaccaacacaaagaaatcagaaaaataattgaggagataaaagattagatacatatatttaaagaaaacaaacagaacttctgaaaatgaaaaactcactgaagaaattttaaaacacagttggaggctctaacaatagactaaaccaagcagaagaaagaatttcaagcttgaagcccagtcttttgaattaacccagtcaaaaacaaaggaaaaagaatttttaaaaatgaacaaagccttcgagaaaagtatgattatgtaaagtgaccaaacctacaacttataggcattcctgaagtagaagaagaaaataataagaagtttggaaaacgtattttagggaataattcaggaaaaattccctgatcttcctagagatgcaaacacccagatttaagaaattcatagaacacctgacagacactatacaagagaaacattgccaaggcatatagtcaacagactatccaacatcaatgtgaaagaacaaatcttaaaagcagctaaagagaaatacaaatcacctataaaggaaatcccatcagactaacagtggacttatcagcagaaaccttacaagccagaagcgatcaggggcctattattagcctccttaaatgaaaaatatgccagataagaattttaaatcctgccaaactaaggttcataaatgaaggagaaagtattttccagacaagcaaatgctaagggaatttgtcaccactagactggtcctacaagaaatgctcaaaggtgtgataaacatggaaacaaaaggatgatacttaccgtcataaaagcacatgtaagtagaaagctcacagatcctataaagcagttacacagttgagacttaaggtaactaggaaacaaaaccatgacaggtacaaaacttcgcatgtcaatattaactttgaacataaatggcctaaatgtaccaattaaaagatatagacgggcaagttggatttaaaaaaaaaaataagatccaaccacctgctacctataagagacccaccaaatgtctaaagacacctacatgctcaaagtaaagagatggaaaaaatatatattatgcaaatggaaaacaaatgagagaaggggtagccattcttatatctgattaaaacacactataacaatagtaaaaaaaaaaaagacaaagaagggcattaaataatgataaagggttcaatacagcaagaagatgtaagtatcctaaaaatatgtgcacccaacactagagtatcgagactcacaaaactaatactactagacccaaagaaaaaacactgataacaatacaataatagtgggagacttgaacattccagtgacaacacaagacaagccatcaaggtagttggttttctgccttgatgacctgtctagcattgtcaggaaagtcaacaaagaaactctggacttaaactggactcttgaccaaatggacctaacagacatttacagaacattctacccaacaactgcaggatatacatttttctcacctgtgcatggaacactctcgaaaattgaccatatgcttggccataaagtaagtctcaataaatcaaaaacattgcaaccatatcaagtatcatcttggacaacagtagaataaaattagaaattattaccaagcataactctcaaagctacacaagtacatggaaactaaataatttgcttctgaataacttttgggtaaacaacaaatgaagggagaaataaaaaattttgggaaatgaataaaaatcgaaacaaaacataccaaatctctggaatacaataaaaacagtgctaagaggaaagtttatagtattaaatgcctacgtcaaaaaggtagaaagatctcaaattaagaacctaatgtcacacttcaaggaactagaaaagcaggaacaaaccaaacccaaagctagcagaagcaaataaataacaaagatcagagcagaactaaatgagattgagaccaattaaatgatacaaggaatcaacaaaattaaaagttggttttttaaaagaaaaaacaaaattgatccaccactagctagtttaaccaagattcaaacaagcacaatcagaaatgataaaggtgacatttaatgttaaaggtgtagttctgatatcacagaactacaaggaatcatcagatatcactatgaatatctctatgtgcacaaactagaaaacctagaggaaatcaataaattcctgaaaaaaagacaaccctccaagaatgaaccagtgagaaataaaaatcctaaacataccaatgagtaatgaaattgaatcagtaataaaatgtctcccaccaaaaaaaaaaaaaaaaagcccaggaccagatagattcacagccaaattctaccaaatatacaggtaagagtcagtaccatctctactgaaactattccaaaaaaatcgaggagggaatccttcccaactcattctatgaggccagcatcattctgataccaagacctggcagagacacacacaagaaaactttaggccaatatccttaatgaacatcaatgcaaaaatccttaatgaaataccagcaaaccaaatccagcaacacatcaaaaaagctaatccaccacgatcaactaggctttatccctggaatgcaatgttggttcaacatatgaaatcaataaatgtgattcatcacataaacagaactaaagacaaaaatcacatgattatctcaataggtgcaaaaaagtctttcaataaaattcaacatcctttcatgttaaaaactctcaataaactaggtattgaaggaacataccttaatataacagcaacctatgacaaacccatagccaacatcctactgaatgggcaaaagctggaaacattccccttgaaaatcagcacaaggcaaggatgccctctgtcaccactcctattcagcataatattgacattcgtggccagagaaatcaggcagcagaaagaaataaagagcatgcaaataggaagaaaggaagtcaaactatccctttttgcagataacatgattctgtatctagaaaaatagcttcagcccaaaaactcctttagctgataaataacttcagcagtttcgagatacaaaatcaaagtacaaaaatcactagcattcctatacaccaacaacagcaaagctgagggtgatcattatcaatcctctgaaaacaaatgagcaacaaatattttctggcagtgtacttagctccatcaaaggagtgctgggtgaaataaaaatgttatgctctggtcactaccctgatagaaatctttagaatcctgttagaaaatcatttccaatgtctgaagcaaacctgcaaacattacaagaattaattgctgaactgcttgagatgtactagatatgttattcaaatttaggtgtatttcgtggcacatttctgacatgggtatttctaaattttcaaaatatatcgagagaaagagattaactctctgaaaatgtctttttgttcatgatttcctagacaaaaatcctttcttgtcattgcttttgaaaaacataatctaggcccctatttgtatcatcacggttatcaaactttaatgcagtgtcagtgtttgatgtgaagattagattgtcctgaatttggccagtctgggccatatgtgggaggcattataatttgattctgttcacttaagaagtatatcttttaaaatcatttgagtgcaacactatattgaaatgattgttagtgttctctcttgcatcacagttgatgtatcccatcatataaggatgttttcagacctgtaagccctcatattaatagtaaatctttgctcatctttgaactctggattgacacactgttctctcatttccttttgaattgttccactgctcagggttctttgtggcaagtaagcaccactgtttagaactaacaaataccaatcaactcaggcttagggattcaacttgattaaggaccagtgagatttgtatatctgtgtctttagagtctacctgtttaccaagctgtactggaccgggagtcagctttagctttacattgaactagctgtgtgactttgggaaaattactctctggatctatttgggaaaataatttatctggatcttggtttccttatctataaatgaaaacatttacactaggttgtcttaactttaagattctgtaactccaatgcaaagtaaacaaagaccaggtgaaaccatttggcaaacttaatgcaagctaatttctcctattgaagataagactaaactatcaccattccgaagcccactcctcttcctacctctcttacaatttaaatctaacctacctttgaaagtcaactacatctccatcacttccatgaagtctttcctgataacacaacaacctccagtggtatctttttttcaattataggattaattatcatcactacacttagtcttctctatcaccttgtattgttgtttaattttagtgcttttgaggtcaggaatgatgagttatgaacatttatattgcccaaagcacattgtccagtatttcatatgcataataggttctagatttgttgaattaatgttgaaggaatgaatggagtttaaaaatcattctgaaccattttcccaaattcacaatgcaaaagtgattgaatttttcccacctttctttcccaaaaaagatgcataattttgacaatattatacgaaatctaaagtacactttggaatttaccttaaatataaatccctttccttctagtctcctaattttcctctttaaaaagattgagaatacttcctttttagagtggcctgccgtagaaacatttgtattttccttctatattccttagaatacaatgcattttgatcagccagtgtatgaatggcgttttgttttctattacctttttaggaaacatgacaaatggcattgttactcctcaagggagtgtttggttacttgcgctcaccagagccagttctctaggatttgatggaaacagatgctagcattcccatcacaaggtgtatctccagtgtataagtgttgacagaagcaaagtcaaacaatattcaggtcaacatttaatttttttatttttaattattgtaggttcatagcaggtatatgtatttatggggtatgtgagatgttttgatacaggcatgcaatgcatattaatcacatcatggagaatggggtatccatcccctcaagcatttatcctttgtgttacaaacaatccagtgtaactggattgtttagttattttaaaatatacaattaagttattgactatagtatctctgttgtgctatcaaattgtagatcttattaattttttctatttgttttgtatcaggtcaacatttgattagattcattatagatattagtccagcttattccggttccttgagaatttgccaccgagtgtcttatcagtccctcattatccttcttagtctgcattgagaatgtgttagaacaagtgcttagcaactcaaaattcatctagcctgggagacttggaagaaacattttagctttggcctcatgctgtgggagccatgttgtttctctgtcaggttgaggctgtgccgcacttacggaaattagcccaaaaaaattgttttctctctccttttctgtaccagaatgagactccagggtataagcaaaattgatgttgcttgaagaaatttcaaaggttcccaactcccagagctcaagtagccacggaaataagcactggccaaaaaatgtacttagacttgatggtaattgggaaccatttgagggaagggaactaaacatgtactacgtgatgttacttcgtagaataagaaaggcttgtgttgaattggtattttaaagaataatggggaaaaattgggcttctttgtgtgggtttgtaaggtggtgtgagggcagcgtgttggcaatacctaggcaggattgaaggtgataatataaattgaatatatttctggtaaaggatttttgaaaataaaataaactaatgttttcttagattcactcctactttattttcttaaagaaatagtaacccttcctattggtatgtcaggaaaagataatttgttcttaaaattttactagaaagaaaagtatatcatgttcccaagttgacttgtatgcaaaatcaaggttatactttccaaaattaatgcaccttgttcctctgaccccttaggcataattaggggttttgtgctcttacaaatggacttagcaaatgtggcactgacataatcatggaattcatggtatttttcccttgtgattataacaatttggaccccatcaagaaactccttattcagcctttcgtttgttcataagctgacttcttttgacttaagagaagtcagcttatattagtgctaagcccaaaagaaccttctgcaatcacactgcgggggaccactttctatgccctctgctcacatttgtgttccaaatcatcagtgttcactggcccaattaggccctctctagcaacattagccctcagagctttgcttgccaatgtcaacatacattctcagttccagaattccactgtcttacctcaagtgtcacttgagcagcccaggctttcttattatagtgtttatttctgtcactgattcatcattttttatttgtctgactcaaatccaggtagttttgctcaatcgatggcaggctgttaaacagcatgtgtgtttagggcagcaattcattcatccattttgacatgcacacctgacatcttcattaatgcccagcacaaatttctcagattccagatctgcttggtatctccatattccttctgcatccacctctttgccacaaaagacacttcatgtaaatgtcacttttttcaagtttttcacatgttccacagtggaaccatatgcttatagaaatgatgcccttttaggtctgtatccaaacatagcttgtcaatgactgctcacaaattctaagtcagcttataagcttttacactttttctgaaatgttttctttagggcttgtaaacttcttcccatgttattgcttacttgttgtacccctgtgttctttttcgacattaactccaaccaccttaccacctttttattgccctttcaattcatcacattcagctgaactgctgcctcaggcaagtgcttcctctctatgtctgtttattgagtttggggcaatctctgtaacagaaattctgctacaatggtctttcttctatcctatgaccatttgctaagctcttgaaacatcagtcatgttcagttcttagaaaacctacattgaagaaaaaatagtactgataattttatggaattaatttaatatttatagtcagatagtatgagttgcttacctgaagatgtgcagggaacctctggagagccatactgacaagtaagttgtggcttagtctgtatgacttgagagctattggtttttcttgttcacatagttgtcaccattattgcaatattataaacatttcctgagtgctcactatgtgataggcactgtgtcaagaactttacatgaagtaactattcaatactcacagtagcccttcaaagtaggttgtattattatctctgttttacagacgaggaagcagagaaaatcaggagggtaaatgacttatttagggacatacaacaaataagtgttagaataggcatttgaatttaggcagtataacctcagagttcacaaaactcttacccttcgtattatactgtcttcttataatgatagataacatttattgagaacttacgatgagccagtcacttatgatgagctagtatagttagccatattgcattcattaacttattaaatcatttcttcagcccttgaagacaggtgacattatttttcttttacagatgaagaaactgagtgaggcttagagaaaataaacagtctttaaagtgattaaagtgattcccctagtaagtagtagagacaggattttaactcctatcctcaaccattatgccatactgtaccaataaaggactaaaaaccgacaaacagaaaagttgatccatgggttcctacagccacaagcaaaaatcatacctttattcctgctgcttgcaggacctattagctggaagatgttgggctgtatcatcaatatccataatttatgtatacttattcctgggattaaaaatggtgggaattcctaagaagcagggaagcaatactttttttcaagagagttggtttacccaaaaatgacagactatcttgccagaagtagcactaagatagggtggaatagaagctggtataccccaacgaaaagtgaatataaataaatatgtattacagtggaaacagaaacatggcaaaagaaaatgtgaagcacgggattgcactgttataatgccacttctcccccacctcccctaaaaaaaaaaaaaaaagccagtgaactgctaagatctagctgtacctgtctatttataatggagagattggtgcattgaaaaaacaagatttttgattggagaaggttagaaagatgatttaggaatatgagctgctacccaagcaagacaggccaggttggatttccacagtgggaggcatgaagaccctgggtagtagcgaaagctgtggtattatttgtgagaaggccaatgaaaagatagaaaaatactctgagacatattttatctacttctgaaatttaattatgactgactttaatttcaggcattatttatttctacttttgaaaatgtttaaattattgaaaataaattaaaagaacttttttattattggtagaactttattaaaataatatagacatgctttcattggtctagcagtcctatgctaaattaaaataaggatcaagaagctttaactttacttaaacagtggcatgctgctctcagtgactttgttaatactgtgaaaagactttaaaatctcaaatacacacagactcacagatatgtgggaaactatgagtgtgtgtgtgtgtgtgtgtgtgtgtgtttgtatatatatatatatatatttttttttttttgagacagagtttcactcttgtcacccagctggagtgcaatggcgtgatctcggctcactgcaacccctgcctcccaggttcaagtggttctcctccctcagcctccctagtagctgggattacaggcacctgtcacctgtcaccacgcccagctaatttttctctttttagtagagatggcttttcaccatgttggccaggctggtctcgaactgctgacctcaggagatccatccccctcagcctcccaaagtgctgggattacaggcgtgagccaccgcgctcggccactatgagtatatattaaatgtaaattgatattaaatcccaggaggatagggtcagaaacctatgctgtagggtggcatcaaatactacaattttacaggtaaaaaatcacacatacacacacacacacatgatgaaagatctttcaagttcattatttgaagcagtcatgtggatattacttgctgccaaatcaatctataattccagtttctctagaaaagtgggttttctattatataaaagactacaacaatggaaatagtctgattcattcacagtctcacacacacacacaatcatttatgggctgaggatgtacatgtaccatggccttcacatgcccttcaggagaaaatgaattttgggggagaaacagatgttttctattaagtcaagttctgtatggtcggagtttaaggcaaagagttaagctgaatatggaaattaaagccaatttatcaaagcatattttaaaagactttcttgttaatactagagtttgggctgggaaatttctgcttcttaacataccgatgttagtagggatttaaagtttgctgccaggcttctcttggaatattcttccattggcacagccctagagatgctaactctgaaaaacgggatttggctggtagcacctgacacagccaatcttgaatttccactaaagtatctatgaagacatagaaaaatgatgagagctcacaacaatgctgataatttggattgacagtcaaattattgccagaaccagagagaaatttccactagctaaaaatcaggaagaagtagattgaaaagtacaatcagcgaaccactcataccatgctgctagaaatttggtaagccaatatatcttaatgtaaatgacgagttgatgggtacagcaaaccaacatggcacatgtatacctatgtaacaaacctgcatgttgtgcgcatgtaccctagaacttaaaatataataagaaaaagaagaaaaaaaggaataggtccaaaaaaatctcatctttccccccatgcagtctaaatcctggttccaaaacacacattctatacccagcaaaacaaggagtacttgtcttattgcatggaaagtacttttttagatagctagaaggctggacaccaaaccctaaaatattgcttttttctctatatatgcttgagcactactacttccagcaaataattagaggagaagacatgaatgtggatttgggatttctaatatgaagtagtggtaaattatcttcaaggtccattccccagaaacataatgctataagtgggagcaaagaaccttggtaggaaggtattctgggtattctagtttttcatgtattccatcagttctgattatcaataaatcagtcagttgggtcaggagaggatccaatcttagtccaaagaaggtgtattaatgaaatcaagttagacaccaagaacagacagttgaaaatatgagatatatacatcaacctattgtcccgttgcatactcgagaaggggatttatctaaaacccagtttgagcttaacctaggacaattgttgtctcctaagtattggcaagcatgggatcaagatagattggaactcctttgaaaataagcaatgaaagaaaaaacaatgtggaacatatggaaaatttgcaaatgggctaaaggcaaattattttggagatttcaagaaagaacacatttataaaaatgggtttttaaaggaatcagaaaaaatattagaaattgatgattttagctaaaatgcaagataacatagctcttatgaaaaagcagactgtaaaatgtaggtgttcacaatcttttgttaggtcatgtgacacttataaaattttcttttttgaggaaattctggactctttcctcatataaaacaaatttgtaaatacactcacaactttttttttttttgcattccgtttctggggttttacatatcctctgaagcctatgaacttcagtttaaaacatctgccatcaaggaacaaatcaagacacaatgaagataatcaaggaactaataaaaattaggcaacaaaatgagactattaaaaatgtgagataatcaagataaggaaaaattacaagaaattaaaactcaaccacagatgattattatcagtggaggctgcagagaacagaattgacaatgctgaaaatcagatcagtgagaatgtcaaatatacttgaaaaatcatctcagaaagcagtgaaaaagacgaagatatgactcatgagggagaagatgataaatctgaagaatggatatccagtttaataattttaagtattcctaagaaagaaataaaaacaactaaagccataatgaagcatatatttaaaaaaacaaagtttcctgagttgtcaaacagcttgaataggctcatcgtagtctaggtaaaattagtgaaaagggagaagaaagccacatgctctaaagtttcttttaaagtcatagatgctactgcaaatggcatcttcatgcataatcacatatttgtttggcatacaaatatagatagccaacagggattgtaaataatacgaaataacagcagaaaaatatatagtgcctaaaaccttgtgctgcggagtcaggccagttttaccacttagtagttgtgtggatttcaatgagatcagtaactcttctgaatctgtttccacagctacctcatagggccctttgaaaattaaatgaggtagtttatataaaatgcttaataaaaggtctagcacttaggggacactgtgcctaataatattgttgctattatattcaacaatccacaattgtgatatacctagattgttcataattttttgttatgtttgatgctccaacaaatataccagtctcagcagtctctcagtaacattattttacattcaattctgtattaatttcattagtaaaaattccagttgttttaaattccattactttgcacatcaatttgaacatttatttcaaatatttattggggccaattgtagttctttctctatgaattgcccatgtgtgacttttgacattttttttggttttataatctcagtcatttcattaagacttggaaaatcctatataatctaaaggtatttgcatattaaaaacaaaaggaaaactttgttataaagtgtgccaaagtttacaatatttttggccagtgaaaccagagagcataatttttatggcagcaagaaaattgaaagaaagcttcatagaacaatatatgtattcctcttgggagaatttgtgacttctagccgaggctttccttcaaacatgtgaaaattaacatatcatctgctttatccataaatatactcttcggtgatcattttcacttgtaaagtgtgccatacttgcagagccaaaatgtttttttcatttattctgttctactttcttagtaggcacagagtggactggatactttccaagactgaaattcagtatgatcttacaggatctcagttcttggaaactttgttaatgtgcatgtaactattgtgacagggcaagaatgcagtctactaagagcagaaaattctaaatttaggtgtccttggctctgttttctcaagttttgtcaacatcttccatgcatatattcagaactaaaacctctgtcattgctcttactggggcaacgtgtatctgttcttctacagatgagctgccttaacctctgtggtttctaccgagctcaaacttgtccattgaaagcatattctacaccgggcatagctaatgttgtgttgtacattcattgatactatgcttttccctcccctttcaaaagcaccattacctgtcttctcccatttcattccctgtcaaatttatttcccttctcctgttccaaaagacaaagccatataccaggcagtagcgtccatccaagagtatttttcaaactgtggattatgacccattcctggattatgaactcaatttagtgttttgcaaccagcactttaaaaatgacacagaatatatcagggtgtatcacatataggaaggcaagtacgttttcatgaaacaaacataggagtgtactgggtccaacctaaagtgtattttgttctatgggttaaggtcaaaaatgcttgagaaacagtgctataaagcacacttcaggatgcaagacatagatttagagctaatttaagggacctgtcagctgggcagctgccctgggtaccaatctatagaagcaaaaatatttcacaggtactaaaatatcactggagatataagcagatggagaaaattgcatttaccagactctttttttttttttttttttgagatggagtctcgctcagttgcccaggctagagtgcaatggcgcgatctcggctcactgcaagctctgcctctcaggttcacgctattctcctacctcagcctacaggcacccgccaccacggtggctaattttttttgtatttttagtagagatggggtttcaccgtgttagccagaatggtctcgatctcctgacctcgtgatccacccgcctcggcctcccaaagtgctgggattacaggcatgagccaccgcacccaaccttaccagactcttaagtaggaaagtagtacatgtgataaggtagatgaattggtagatagagttgtattgcttagagcagagagactgggctctgcctccagtgatctttcttttctccatgtgctttctccatctccacacagggctcagcctgcttcttcaatagatgttgaacaaatacttttaaacatttggtttgaagagctaccaaattattagcctgctgagtttgctcatatgtcttgactcaagtctgtatagacctttaattgagaggggaaaatgctattgtaagaaatgtatttattaggatagtaatagctgctgtaacaagtaaatcctcaaatttcagtgactttgcacaatacaagattacttcttattcaagtaatggtccattatccattacaggtgtcagcaagtaagtgagtagctttcctccaaaagatgattcaggaagctagatatcttccacgctgtgaccttcccacagagctttcagagtcttctgtatctagcccaaggatggaaaaggagagagtggagaagacatacccagttactacaaactcccatttgaaagtgatacccatcacttctgttcacattccattggcaagaattgtttacttggccacacctggatccaaggattggctgggaattgcagtatctgactaggcaactgccttccagcaacatcactacattaaggcatggggagtgggtggcaggcatgaatttttgatgaacatctggctgttgcagtcacaataagttataataccaatcaaggtgtctctagaaattgtcaacacagaatttggaaacatattgctcctcccattaccatctttaagctcttttgcagtgtgacagggttatgttgatcattaatgcatttatacatttttgtataaaagtaagccatttcattttctatcttactaaagtagtgatttggacatctttacatttagctgcatattgcttttagtttaaaatgaatgtagttggcaagcatgaagtgtataagatagtaaatcctaaattacaggcagccacctcatttattcagctgctgatttccatttggttgtccagacagagcactttgcattatttgatttgtgatatctggatgcaaatggctttaagttttgattaaacacaaagcttgaaaaggtttaaacagtaagccagtaatattgaaaacattacaatctggtttagataaacaatcatctgaatgaattggatataaacatatttattttgggcaggaagcacttgttcagaaatttctcttatgatgtgacttatttaagcttctggacatcaaaatagttcataattatggatgaaaattgttggcaaagacgttactgctttattagaattcttgtccaatatcaatatggtgctattatttgattattgctttatcttttattctctgataatcaggacaaaatattgaaatttggaatattctaatagcaattagagttttcttcaagatacctgtcaacagtgtgtgacaatggaaccctgtgttgcctgtgtctgaaatgcaatgtacaaatatcttcaatattatgaatgcagatttgttaaattacgggtgataaaaatgactttgcttcagtgaaatgattctaattctaaatttatataatgaattattcactcttctttcccttttgttttctgctctagtttagtgagcaggttcattaagtgctaatattaaattcactagagtatacaaaaaaaaaaaacccagtaatagcatccacatggttgattaaatggcaaggtaggaggctggccgtggcgtttaattggaggcatgggagctgttggtttctttgtgtaatctgaccctctgaatgttgattcttctaacaagtgaccaaggaaaaaaggaaagtggtgtcatgggaaaatagcatttgcacatttcacaaataattgataaataaccattatgaatgtagtcattactttacatcagtgtttgcaatgtgtaattcattgaaatatttgtcttgtacaacactccacaagaaagggttctagaagcaaataagttagggaaatgctggattgtctctcagagataatcaacaatgcatgctagcttttttttttttttttttttttttgagatggagtcttactctgttgcccaggctggagcgcagtggtgcgatcttggctcattgcaaactctgcctcctggattcaagcaatcctcctgcctcagcctcccaaatagctgggactccaggcatgcaccaccatgcccagctaatttttgtatggttagtagagacggggtttcgccatgttggccagggtggtctcgaactcctgacctcagatgatccacccacctcagcctcccaaagtgctgggattacaggcatgagccaccacgctgggccacatgttagcattttatgggatttcataaatcctttagttgggaagcctatttgacttttttaaacctagagatctcgatttattttaagcagccttttttttggttgtttagtaaatattaaacctaatccctgaatctgcccaactttttattttcttataagaaagaggtgaaaaataatgcttataatttttaaagggcagaaatatttttgttttgaaaaccaaagttgaggtatataccaaaaataattcaaaacaggttttgaaacaaaaaattccatgggaatgttcatggtggcactattcacagtaatcaaaaggtggaaacaatccaagtgtctatcaacagatgaatggataaagaaaatatggtaggtctgtataatggaatattattggtccattcaaagcaataaagttgtgatacatgctacaacatgaatgaaccttaaaaacatgttaagtaaaagaagccagtaacctacaccgtatattatctgatttcattggtatgaaaagtctggaatagacaaacctatagagaaaggaagtaaattcatagtcttttaggtctggggaggtgggagggtagggctatgacagctaaagggtaaaggatatatcttttttgtgatgaaaattttggaaaattggctgtagtgatagttgcatgtatctgtgaatatactaaaaacattgaattgcatgtttaaaatgtattagttgtatagtatgtatagtatgtgaattatatctcaataaagctgataaaaatgataatcaccatttggttaatacacaaatatccgtaagttcctcttcttaaatatgaagcatatttttaaaaggcagggattatcctgttaaagcttctcagtattttatgatttttcagtttaaatcatcaatagcaatattgtacacctcaaaattggtacatcatataataatatgggctatatgtggatggatatttgttcatatgtagatatacatattttcaagtgacctgttttggagaaatatgtaaaggtatttaaaattatattaccagcatactttcaaaaagttctaggggaaatataaagcaatattagtattatccctgacttgtggcaattaaagtaaatgccccactagaagatacttgggagaagttaggtctcaagattttgttgtgaatgttaaggaaatgcagactaatttcttatttgggggtttattgtggctctcgtctcactggacctttaatcttggtttccttctctagttcgtatacttttcttggatctctgaacattggagtgcttcagggctagttgttggacccattctcacttctttttttttttacattgattttttattttattttattttattatactttaagttctagggtatatgtgcacaacgtgcaggtttcttatgtatgtatacatgtgccatgttggtgtgctgcacccattaactcatcatttacattaggtatatctcctaatgctatccctccccctccccccaccccacaacatgccctggtgtgtgacgttccccaccctgtgtccaagtgttctcattgttcaattcccacctatgagtgagaacatgtggtgtttggttttctgtccttgcaatagtttgctccatgtccctacaaaggacatgaacttatccttttttatggctgcatagtaatccatggtgtatatgtgccacattttcttaatccagtctatcattgatggacatttgggttggttccaagtctttgctattgtgaatagtgccgcaataaacatatgtgtgcacgtgtctttatagcagcatgatttataatcctttgggtatatacccagtaatggaatggctgggtcaaatggtatttctagttctagatccttggggaatcgccacactgtcttccacaatggttgaactagtttacagtgccaccaacagtataaaagtgttcctatttctccacatcctctccagcacctgttttttcctgactttttaatgatcgccattctaactgatgtgagaaggtatctcattgtggttttgatttgtatttctctgatggtcagtgatgaggagcattttttcatgtgtctgttggctgcataaatgtcttttgagaagtgtctgttcatgcccttcgcccactttttgatgggttttttgattttttcttgtaaatttgtttaagttctttgtagattctggatattagccctttgtcagacgggtagattgtaaaaattttctcccattctgtagatcgcctgttcactctgatggtggtttcttttcctgtgcagaagctctttagtttaattagatcccatttgtcaattttgacttttgttgccattgcttttggtgttttagtcaagaagtccttgcccatgcccatgtcctgaatggtattgcctaggttttcttctagggtttttatggttttaggtctaacatttaagtctttaatccatcttgaattaattgttgtataaggcataaggaagggatccagattcagctttctacatatggctagccagttttcccagcaccatttattaaatagggaatcctttccccatttcttgtttttgtcaggtttgtcaaagatcagatggttgtagatgtgtggtattatttctgaggtctctgttctgttccattggtctgtatctttgttttggtaccagtaccatgctgttttggttactgtagccttgtagtatagtttgaagtcaggtagcatgatgcctccagctttgttcttttggcttaggatcatcttggaaatgcgggttcttttttggttccatatgaactttaaagtagttttttccaattctgtgaagaaagtcattggtagcttgatggggatggcattgaatctgtaaattagcttaggcattattgccattttcacaatattgattcttcctatccatgagcatggaatgttcttccatttgtttgtgtcctcttttatttccttgatcagtggtttgtagttcttcttgaagaggtccttcacatcctttgtaagttggattcctaggtattttattctctttgaagcaattgtgaatgggagttcactcatgatttggctctctgtctgttattggtgtataggaatgcttgtgatttttgcacattgattttttatcctgagactgctgaagttgcttatcagcttcaggagattttgggcttaaatgatggggttttctaaatatacaatcatgtcgtctgcaaaaagggacaatttgacttcctcttttcctaattgaataccctttatttccttctcctgcctgattgccctggccagaacttccaacactatgttgaataggagtggtgagaaagggcatccctgtcttgtggcagttttcaaagggaatgcttccagtttgtgcctattcagtatgatattggctgtgggtttgtcataaatagctcttattattttgagatacgtcccatcaatacctagtttattgagagtttttagcatgaagggtgttgaattttatcgaaggccttttctgcatctattgagataatcatgtggtttttgtctttggttctgtttatatggtggattacatttattgatttgcgtatattgaaccagccttgcatcccagggatgaagccaacttgttcgtggtggataagctttttgatgtgctgctggattcggtttgccagtattttattgaggatttttcatcgatgttcatcagggatattggtctcaaattctctttttttaattgtgtctctgccaggctttggtaacaggatgatgctggcctcataccattctcatttctatctgcagattccctttgtgatcttacccagtttcatggttttaagcatgtttatgttgatgactccataatttgtgtctctagaccagacttctctccagagctccagacttgtataaccaacttgactacaccttgtttccatttggatgtctaatagatatctcaacagttaatgtttcccaaactaaacttatcttgcttccaaattctgatttatcccatcttttcttctcagttaatgactaatctgtcttttctgtttctccagttgaaatctttgagtcaccttgattaatcttctttcatatttcaggcatgctaaccccgttagggcttttatattgtttcccctacctggaatgttcatcccctgatatgcatatgattgcccccacctcctccttctagtctttgttcataagtcttcttccttcttagtgacagccacatcaaccacaccacttaaaattgcaactactcagaaccacagatctcctgcctactcttttgtttctgtaaaaccactagctaacatactataaaatttacttacctatcatgttcattttaaactgtctttccccattataatgcaagtttcatgagggcagagatttctgactagtttgttctctttatgtattcactgtgccggaaattaagaccagcacatagcacaggattagcactcaataaatatttgttcaataaacaaataatactatgtcaggaaatagtttctattatttttggtgaccctaaaagtggctcctcatgtgtggaagtagctgatgtggatttaccaaaacaaacaaacgaaacacatccttttataggatgtgtggtgtgtgttttctgactagactaatgtacaatttatgacaatcaccaagtagctgttctttaacaatatgcccgctatccacaaacatttccaactctaaataccaaggagtactctttatcactttctaaaaacattttgaatatttatacctcctctagtagaaaagcaaggactttcatttccggatttttctcttctttcttttctaaacatctcctctagagtaaaatcaaggacattttatatgaaagtttggattatgataacatttaattatcactcatatttcacagagtgtatttttaaaaatttcttatgactttgttctcttctcaggattaacttgtctctgaaaatagatcttttacagcctagcaaagaaagcaaaataatatatgtgcacaattagcacaaattgatcttgctatgtgaactttaatttcagaatttgagatttaaatgactcttctatttaaattgtcaacctcagagtctcattagtctaaattttacatttaatttatgaggacaatgctgcctccttagaactggcacttatactctaagttatatgatgtctagtgggaaacgctggtttaggatttcttttcctaggccttattttcagctatttcattaacttattatatgatcttagactaattatttaatttctgtgcctcgggattttttaatctaataattcagagaaatattcctcttctgtatatatcttagaggagacattaatgtgtgctggacgaagcacaggtttctgggtcataaagacctgggttgaaattctgctcagctactaactaactttgtggctttagggaagtcagtgtcactgatccttatttctgttaactgtaaaatggtgataagacctactttaaaagttgtaaggaatagataaataatttgaaaagtaattagcatatggccagaaccaatcttggtcctctgcctgctctttctcttccacctgcctctatcctggctgtaaaatgtgtttggagcattacattttacatatgcataaagtgcctgtcatttagtgggtgcttaataaatgctagttcaattggctgtgacataaggtaattgaggttactaaataaggaagggtgaatagtataatggtgggaaagaaaatgaggaaaatgacaaaataaagtttaaagaaaaacataagaacttagtaaatataataaatattactatttaacataataatgtactgttggtttgagagtgttcacgttcacaaatgcctaaaatatttagtaaagtctctacaccatggataagactattatcctactgagccctacatttttgcaaaggtttcataagatagaataatatatactcataactaagaaaatgtttaaatgatcaaatccagtactttgcccaacaggtttagcaatcaccgcattatctgctgctaattagaatcaagtgtatgatatacagggctcattaatttctttggaaataagaatcatagggcaatgcgtgtctttacaaatgggtaccagttaattttaataacttaatgtatgccttcttttacatgcacccaaagtgaaatgtatagtgtatacgaataatataaatgtttgttaatgctcagcaagacaaaattttagaatacgccaatgagcagtttcattaattactgtcctattgcaataagtacatattattaacacatctttctttgatgtgattcagtattagtcatgggtgagtgttaatgtgctccaaactatatagaccttttttgaacttcatacaacccactttctttttttttgttgttgccttaggttggaatcagatggatacatgatttttttttctttttcaggattataaaagtagtcccatttttaaagaaaaaatcataaatatggtttcataagatggatggtgatttaatatttttttacaaagtccaaattatcatttattatttttttatattccatgcttgtgcatcttcacaacgattttttttaatgtaaaaacttttttcccagcactttgggaggccgaggcgggtggatcatgaggtcaggagatcgagaccatcctggctaacaaggtgaaaccccgtctctactaaaaatacaaaaaaattagccaggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcaagactccgtctcaaaaaaaaaaaaaaaaaaaaaaaaaaaaaactttttaaaaaaattattattatactttaagttttagggtacatgtgcacaatgtgcaggttagttacatatgtatacatatgccatgctggtgtgctgcacccactaactcatcatctagcattaagtatatctcccaatgctatccctcccccctccccccaccccacaacagtccccagagtgtgatggtccccttcctgtgtccatgtgttctcattgttcaattcccacctatgagtgagaatatgcggtgtttggtttttagttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttcttgtttcctgactttttaatgatcaccattctaactggtgtgagatggtatctcattgtggttttgatttgtatttctctgatggccagtgatgatgagcatgttttcatgtgttttttggctgcataaaggtcttcttttgagaagtgtctgttcctgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagcctgttttcccagcaccatttattaaatagggaatcctttccccatttcttgtttttgtcaggtttgtcaaagatcagacagttgtagatatgcggtgttatttctcagggttctgttctgttccattggtctatatctctgttttgataccagtaccatgctgttttggttactgtagccttgtagtatagtttgaagtcaggtagtgtgatgcctccggctttcttcttttggcttaggatttacttggtgatgtgggctcttttttggttccatatgaactttaaagtagttttttccaattctgtgaagaaagtcattggtagcttgatggggatggcattgaatctataaattaccttgggcagtatggcaattttcacaatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttatatactgagactttgctgaatttgcttatcagcttgaggagattttgggctgagacaatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagcattgttgaattttgtcaaaggccttttctgcatctattgagataatcatgtggtttttgtctttggttctgtttatatgctggattacgtttattgatttgtgtatgttgaaccagccttgcatcccagggatgaagcccacttgagcatggtggataagctttttgatgtgctgctggattcggtttgccagtattttattgaggatttttgcatcaatgttcatcaaggatattggtctcaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctcgtcctggactctttttggttggtaagctattgattattgccacaatttcagctcctgttattggtctattcagagattcatcttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatgtctttgattcttctctctctttttctttattagtcttgctagcagtctatctattttgttgatcctttcaaaaaaccagctcctggattcactcattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtagccagtagtcattcaggagcaggttgttcagtttccatgtagttgagcagttttgagtgactttcttaatcctgagttctagtttgattgcactgtggtctgagagacagtttgttataatttctgttcttttacatttgctgaggagagctttacttccaagtatgtggtcagttttggaataggtgtggtgtggtgctgaaaaaaatgtatattctgtttttttggggtggagagttctgtagatgtctattaggtctgcttggtgcagagctgagttcaattcctgggtatccttgttgactttctgtctcgttgatctgtctaatgttgacagtggggtgttaacgtctccctttattaatgtgtgggagtctaagtctctttgtaggtcactcaaggacttgctttatgaatctgggtgctcctgtattgggtgcgtatatatttaggatagttagctcttcttgttgaattgatccctttaccattatgtaatggccttctttgtctcttttgatctttgttggtttaaagtctgttttatcagagactaggattgcaacccctgcctttttttgttttccatttccttggtagatcttcctccatcctcagggacccacttgaggaggcagtctgcccgttctcagatctccagctgcgtgctgggagaaccactgctctcttcaaagctgtcagacagggacgtttaagtctacagaggttactgctgtctttttgtttgtctgtgccctgcccctagaggtggagcctacagaggcaggcaggcaggcctccttgagctgtggtgggctccacccatttcgagcttcggggctgctttgtttacctaagcaagcctgggcagtgacgggcgcccctcccccagcctggctgccgccttgcagtttgatctcagactgctgtgctagcaatgagcgatactccgtgggcgtaggaccctccgagctaggtgcaggatgtaatctcctggtgagctgttttttgtttgtttgtttgtttgtttttgtttttgtttttttttttgagacggagtctcgctgtcgcccaggctggagtgcagtggcacaatctcggctcactgcaggctccgccccctggggttcacgtcattctcctgcctcagcctcccgagtagctgggactacaggcgcccgccacctcgcccggctaattctggtgcgctgttttttaagcccgtttgaaaagcgcagtatttgggtgggagtgacctgattttccaggtgccgtctgtcacccctttctttgactaggaaagggaactccctgaccccttgcgcttcccgagtgaggcaatgcctcgccctgcttcggctcgctcagggtgcgtgcacccactgacctgcgcccactgtctggcactccctagtgagatgaacccgggacctcagatggaaatgcagaaatcacccgtcttctgcgtcactcacgctgggagctgtagaccggagctgttcctatttggccatcttggctcctcaaccaatatttttaactaaatttaaaattacaataaacagttatataacatttgctacagttccagatctgagattcaggagatctctatttgtgaaaataaattgatatgacatgtgataaagccccattaccaaaagggaaatgaataggcaagaaaatagctaaacctaatagtcaggaaatgtaagacctaaaattttgagattctattttttcttttgtaaattgaatgcacaactcacttaaagtaaatgtaaaatcattcatattcaactttctgagctgacgttaccaaaaaagtgaaagttaaaaatacttggcttctattgtaaaattgcaaataaaacccatttcatgaaagtggctttaatattttgatgtttggcttaacagttcaattcaacaaacatttactctgggcaatctaccatggtgtttaagagcattggctttgcaatggaatagacatgggtttggtttcccataccacaatttactgtctttgagtgaattactcaacaactaattgtcttaatttcttcaactgcgtagttgggctttcagagcctactttgcaaggatgtagtaaggattcaataggaaagtgcatgtgcctggctatggtaagcactcagtaaatggtaactgctaatgtcaactatgtgccagactctatatgctggttatacaaagatttaaaaaagacgttatctggcattgatctttgagtgagctacaaaaaggctatgtattgagacaggactgtaatgcagctgccttgacaacatgttccaatcagccacattactgagttgtctgtattgcacatataaaaatatataatatcaaattaatgctaaatgaactctgtatgtgtaaatgttgaagaatgtatgagttttccagccctgatgcaaaattattggtggggcatatattggctgtggtttttcagcacaaaatacccttataaaatgtattttgaggaaattcattataccattaacatttttagagtgagatcaacattttttaaaaagtaaactttgctttactctgaagtgactcactttaaaataaagttggcattttggaaaataggcacaatttttgttgctcatgagctttgcatgaaaaacttgcacgaggccaaaatagcatgcctcaagcatctataggtttattgggcagtctctgtgtatttcttgatagataaaagagagagccctccagaatgcagtcaaatgtgtaatgaatcacaagaacacaacatgatttattttaatgcaaagagtgaatttactttaacaaaagaaacattaacacacaaaataatgttgttatcttattaagagttatgtattatttcccagaagagaagaacttttggggtacaccctaggccctaatcagttaaaggatattacctatatactagattatatggtagatgggcaaaagataggtgtttttcatatcatctgatcccctcatgcattcatcagctgataaagctacaaaaataccattaaaaagaaagatgctaagtccttcttatgcacaacttacaaaatttagttttccaattaatttagcattttattcagaaagagctgtcaactagcaatatatgcttaccaaattctgttcagaactcataatggtgtctcccaaggcttagcagtgttcttctgaatcagaaattcatttatgtctagtgtcatgtttaagtgtggactatgttttgatctgttctttgccaatttgtcattcttggatagtgtattaggtgtgattatcaataatgcatttgttcttcttgggtagcttgtaaagggattctgaaggaaattgcaaaaggaaagttttttttttcttttagtcttcaacaactccaacattgcaggaacatgtgcttacctcccatggctaccacgttgaaaggttactttcatcatttactttgttcatggcagagaggttacagaattgaggaagtcttagccctctcctcaaggatgttgtagtctatttgagaagattaacaagtcaagaagtacatatttacagtgtgctgagtactcttatagaagaaaacacagttgctgtggaaactcagaggaaaataacataactaagttagagaatcctttataaatttggattctctataaacatatatttggatagataagttctgagacatacatgccacatatcctacagtatctatgtttacaagtcatattttggcatcctcttgagtggattaacccttaactaaacattccagatgttaaaacaatatgaaattgttttgtttattccaagaaattcatgcacccaggctcagaaagaaggttgagcaactttatttggcttctctcttataattccctgaagccaagctaactggcttagtatacaatgaacaatgaatcaagaaaataggggtaagtttctagatggaacaaaggtattcattattatgagtataaatattttttctcttatcaactattatcaacataatacatgttctaatatgttcctgatttttctggtgatgtgaatcataaatttagtcaccctaatcaacaagcctggcaacttggacactggcacatctaatatatatttttgtagcaaaactcaaaatcccactttctttttccttagccatttctcttttttgcactttctttgggatgactattcttcttggacagtgaattgaacagtagtgaggaggatagaagttagactgtgttccagactcacaaaattaggctatagaaatcaaaagtgtccagggacagttatgctgaagacagattgaagggatattctttctttctgccctgggccaataggtccaatggaattaattcagctggccagctattttaaaaaatgtcatgtaagtaaaatggttgcaaagaaaaactgcgttaccttgaaagcactccatagataaagcatatgttttacagagcagacattgactctagagaagaggaaaaccacagtgatttttaatcattaattgtaatgactcttcaaataatacataagcaacatggggaagtaatttttcccttcttgccatcattacctaaaaaaccatagctgttttgaattatatgatcaattcaattcattacaagtttcttgaaggtctgttgggtgctatgtgctagaaatatagtgacacacaagacagacatagtttctctcctcatggagcttcaagtctgatgggcaagacagatattacactaatagttagagatttccctcttttcttttattttctttttcctttctttcttttctttttttcttttttctttttggagacagggtctagctctgtagcccaggctggagtgcagtggtgcagtcatagcttactgcagtcttgaggggctcaaatgatcctcctgcttcagcctcgcaagtagctaggactacaggcactgaccgccacacctgagtaatttcaggtttggtgactgctagagtatgaaagtgtaagacgggtggcctaatttaaccttggagcaagtagatgtggccatattgcaaggcaggcaaccccctaaattggggcctagccccagaagttttttggcttcacttaggaaagaattcaaaaatgagcctgtggtggaagaaaacagttttattgaggcagcagtgttacagctcagtgactgctcctgcagagcggggctaccccataggcagtatgttgagaatagtagctcaggggcagttctgcagtcatatttacagccagttttaattatatgcaaattagagggcagggtttactcagaaattcctagaaaaagggtggtaacttctgggtgttgccatggtaatggtaaactgtcatggtattggtaggcatgtcttgtagagaggtgctttctgtgcctctttcctgttgtagccaatcttcaatctggtctggagtggagtcctgcctcttagccagagattcacttaagttgtggcttagagatgggaaaggcagaggagagaatagccagcctctattcttagtaattgttagtatagctgaaatattcctcaaggtcactgggacactttcttcaggggatataagggaagaacagtccctagctgtttaacatgctttctatgtagatagtcctttctaagctgcagagtctgctgttctttacacccctctgtccggacaacagaaatttatttcagctcaccattatatatgttatactcccagatatatatatatatattatactcccatatatatgtattatactcccatatatatattatactcatatatatatattatactcatatatatatttatataaaatactccccattctcagtatccttttctagaatcgtttaactttctaaaaggattagcccttacttattacttgtgaactcttttattatgttctccaagaattctatagcattctcagacccagtacaatgtcttcatccttcttccatttggttttaaaagcttctgtcccagcaggaaacacaaagagttaaacttggattcaaccgcttctatagctcatccactgagagtcttccatgccaaacagcgcatcatcaataggagttagatttccctattagttaaaaatgaccagagaacatgaaaataatttggggaaaaaaataggggttggaactgtgaaatcaacagtatttgttttgaaatgtacccaaaatgatccaatgttgctttctggggtgaagggaagtgtataacaaagagtgggagatcagtacttttttatttgctccacaagtattctgtagaaaacatggtaaactgtctctcaggatacatttgagtgcttgccacaattcaaaagagcctgatctcttctgttgtggcccagctaaagggtgtagaggagagtcctccttttccttcactcacagctttcactgacttggcagataaagggcatccctggaatatgctgaattgaggagggagatctggcttctaacagtcccagcagcactactgactgacactaatcctggttaactcacttcccttctctgggcctcaatttcaccatctgtaaaaacaagaggggccaggtgtggtggctcaggcctgtaatcccagcactttgggaggccaaggcaggtggatcacttgaggtcaggagtttgagaccagcctggccaacatggcaaaaccctgtctctactaagtgtgtgtgtgtgtgtgtgtgtgtgtgtgtgtgttatgccgggcgtggtggcgcatatctcagctactggagaggctgagtcaagagaattgcttgaacctgcgaggtggagattgcagtgaaccgagatgctccactgcactccagcctgggcgacagagtgagactccatctcgaaaagaaaaacaaaacaaaacaaaacaaacccaagagggttcaactgtaattctgtggctttcttcatagcagtaggcattctatggaggcaccattaggagaaattctggtggccaagggtttgccactgacgtacatactctgtccttttttctcactaagagcagttctggttttctctgcttttgttttcaccttcacatacaatatcatttgaccaaagaggttcatatcttaaaaaaaattgtaaaccattgtattggatgatttttaagaactatgactcttttgctggctttaggtatcctactctaaggggctcctatgctgctggatagttgagaatatcagttaataggggtggaggtggcttagctagaaggtgctaaaaacatccctgaagccctaaagggttataatttccccttcttgcatgtatatttgctgctgctgagttaagatatgacaatagtaaaaactggacagtccttttgggtatacccagaggggtttccccatgaatgaagtgggcagagctaacagtctaagcctgaaatggtgtatgctaaagagtagaggcaccaagggtgtcaaacactggtgctgtccacttctgcagtgagcttggaaatcctcaggccaggtgttcttcagaatgcaaagtccctggaattaaaggaggaaacagccttggaaagctttgagtttgcaggggagttgccctcttgtctttggatgggatcagggcagggacacccatgctgaagaactatcaaggaaggatagcacctgagggccaaaggattaagaggccagctgggggttcagagggagggaggcagataatgcctttatgaacccattccacctgattatagtgtaattggattttgagggacttcaagatccatggaaacatcccacttgcttttatttgggattttgactatcagaaactggcaatttgggaacttgactttatattagttttatcattgcaacattttctttggtttcctcttcattttgctaaagtttattttgaaaatgtcatatcctttgttattttccaagggatatgaatttctttaggaatatccaaggcaggtctatcgtcattggtgtgtggcctgtgttattggttggtttaaatactcttctgggctgggcacagtggctcatgcctataattcgagcactttgggaggccaagggaggaggagaggatctcttgagctcaagagttagagacagcctgggcaacacagcgagacctcatctctactaaaaataaaaattaaaaattatctgggtgtgctggtgcatgcctgtagtctcatctactcaggaggctgagactggaagatcgcttgagtccagaaggttaaggctgcagtgagctatgattgcatcactgcatcccagcctgaggtgacagagtgggaccctgtctcaaagtaaataaatgaatgaatgaatgctcttctgtcactatcttgaaattcttaataagttttgaagaaaggatcttggcttttcatttttgtaccaggctccacaaattatatagccagtccttgcccttggtatccattttatcctaattttactaggttatatggttcatgagtggtactagggagaataatagacagaaagggagagatgtgttttgttctaggccccaggtatccagagtgtcattgaacctgactaccaggtcagactgcctggaaattgatagtcctggtgttcaggactgggggtggaatattaagctccagaggcctaggtatagtcatttctgggttgctgcttaggtaattcatgtatatcacgtgtgaattatttttaaggtgcctcatgtgatctcttttgtaaacctgaccacagaagcagggcagatagagtgctggctaaagaggatctattgctgcaactagataagaaaaaagaacccctctagtagcttcctaccactctggaatgctacacacagtacaggttggtaagtgaatgctgccatgtgccttggattccttcttaggagaggtactaatgcattatcaaaattatttaatttttattatttataggcttcttatcaagccttcaggatgaggactaatatgatttcagtgctgtgggtttcagagagaagaaatctatcttaggcttagcaacctgggggtaagtgccaagctgataagcatggcagattaaaagcccattttacctagacatactgacaccaatagtgttgttagtaattgactcatcatcactacgatacatatcctgaggtgttcaccatgagaaatattgtgtctcctttcttttcacagggtctccgtggaattagtaacaggggatgctggttttatgggggcagtctgtggatgtagggagttttaagagaaattagcttgctagtcaataaccagggctttgcttgtacctctcctgatcagatgaagaatcatcttttttttttcttgctctgttaaaaaaaattgcaaagaaagcatgaacaccttaacttctctcatgctagggaaaaagccttaagaagggtagtacatcagactagtgatgcccattcgtgttagcctttgttatttgcagcttacatggcctcatctggaaatgggctatcaggtgtcgtcttatttctaagctggctgttacatttaatacaagtggagtttgtgtgtaggtctactgcacgtattcttggtgctcagggacttatagtggtcccttacagtttccgaaatcaatcttgctctgagatgggggcaccaagtttgcagcatctccctcctacagtcatttagagttattgatttgcattgaaagaaatgaaagttggaacactttttttaaaaatagactttttttctaagggctgtcaggaagatatgcctcttttccaatattatgtgtgcttgtttgacttagtacgtaattattgaggttctctctggcatttgagggtaccaattggggatcacatcccatgaacacagttgaccacatgtgtgccttcagttggtgaccatccacagcaaagggccttacccctctaccttaagatttcattcactctagcttgacaaaacattgggcaatcccatattataccttcccttcgcttccattgctctccccagaatgcctttctctgctttctttctttgtccaaacccatctttcaagcctctctcacatgccactatctccatgaagtcctctctaaggatttcatctcaaactatcatcctatccttgaaatgttgtatgatcattaagctcttaccataatattttacatttagttatcctgtatcttaaagttctttttctcattattattttaagtctttgtagccatatagctcctactggaaatacacttatttattttttatcctgcagagtacctgcaccacttaataaatacacatttgattattaagtcagtgaaagggttcaatcactgatggcttcattattaatgtaaatgttatatgagaagagcagcatttatatcttcactcaaattagcttgtgaggttaactctagaacagaaagctggggaagtctattgaagaatacaaggaaaggaaaactacctaaggttttgtttagaataatcatccaaaaaatgatcatccttgttttaagatgagaaaacagacatagagaggttaactgatttgtccagattgcacacctagtaaataacagaatgaaaacttgaacccaaatcctttgactaaatgctatgctctttcctattgtgagtcatggcatcctggcaaccttgggtgtgtaggtatgggctctttactttttctgtgtcattcttaaaatgtagcacccaggagagtatggggaaggggagcagggagaaaaaagaaataggtatgcattcacatagaaattcaaatactggctaattgcaatatgtgaatcacaacagtaatgttaagatctcctcatttcccccctcattcttacaactcctcccctttccccattttatttcttctcttcacattccaccttccccctcctccctccaagtatctaattatagttttgcaagaaaaattacagactacatactgcaataattcacacctggaatttacattgattttatggcatcaagctctgagtgccactttgcgttgcattcccatagcaacaccaaatcgtagactaggagaaagaaaaatctgagaactcagcatctgcagctcctgaatctcttatatttatgacttggctcttccttgacaagttgcctatttttctaactttgtttttagaaagcatacacaaattaaaatgatcccacttcatattttgattgctttgaatttgaaaaatgcttgaaagggtgttgctctacagtaacagattaaaaaaaaagataattggatgacagacagaagagtaggtgtgaaaaagtttgtaaaagcatcctgagaactcttgtctctcacacctactatagtaaaaatcaaagcaatcccggggcctctggcacatccttctgcctacagtggccctccacttgctgacctgtagactcagaagaaagaagcagccagaggtcaaacattgctgccttgaagtaggatcacatttgtgcatttcagttgaccttctggatcctgagccctttccttattttttgtgtcttgtttgaccagagatctgaattagcttttcagatttgtctgagttgctggatcctttgtttccatccactctgtgaaatgatatctgtttttctgccagccatgtcctgatactaaacgctggtactgttagcatgacttgactctccttactatgggtaatatttttcaaggttccttccaggagtcttagttcaattgtcacctcattttagagttcttccctgaccgatttatataaagtagttccctctaccccattcctccaagaactctcaattcaactactttgtttcattttccatagaatatatgattatattatacattaactgagattccctaatgtgtttactgtttcagtgtctgatcttccccactggaatgtaagagcagcagcctagtctgtcttatattcgacactttattttcagttcttagcacaatgcctggcccagaataggcactcaaaaaagtatttgttagatgaatgaatgaatgaatgagtgaatgaattccgcaagtgcttattgaatacctattatgtgcttaccgcatgattacccattttggaaaatagacaccactggcctcctggagagtttaccagcagaaataccagatattaaaagtctaatgtgtaccatctgtttcgttgctttctgtcactgtggccttcacagcagtaggaactcaggaacagtttcaggccttcacaggctaaaatgtttccaaggtgctcttcagagctggagggcttagtttgcctcacttctatgtttctacacaccttgctttctcctaattcactattgggcaatcaagttataaaaacattgacatagttaagtctgtttcctagtgtaggctcaaaatgattttgaaggtaagtaaatatacttgggaaattgacagccaagatttctgccatgtgcaaccaaaggaaaggttattaatacagtgaagctaggtatatctcttcatggtgactaagctattttagtaattttctttaggtttattgacttctttattataagaaacaatgaaaatcttaaggagagtcactcactggcaagagaaaaaaaaatcatttgccctaagtgcggagaatagaaaactaaatcatccactattactaatgacaaccactacaaaggccatttagtgcgtagcctatgctacacactaaatgtgcgtagctaaaggtgcaatgcactaaaggtgcaatgctaaatatacttactctaaggaaaaggaggacactttaaggctgaaactgggagaattttattctttatgtatgtcattaggaatttcctttcctgggagaagacacatcaacacctcagtgtagggacattggaaggtgcctttaaaaaagacattagttgtgccttttaaattgcttctctccacaattccagggtgattcttcaatctctgcctttctcttcataattcactcaccttctctgggcctctgcttcccctatttggacaatgaggctgatgctatatgctctgtctaataggagcgttggatggctgttatctcatttttttctgtctggttaatagttacacaaatgctaggcattattttggttattgttagtggtcgtcaatatttacctgggtttcttcatccctgagaggggctaatagtaaccagttcgtcccattacatgcctccgcctgacagaattaaagaactcatagtccttgggatctcagcagtcagatatcaaatagtttccctaatcaagtagtattttattagtggtaaccatggtatttcagaagtgagatctggatttaattgagctatgatagagttttccaggttttagtagggatagattgagctttccttttaaacattataaaaatatattgtctccacattattttaattaggaaaaatttgaatagtcttaaggtagtacttaatacttacatttgatcttccaaccaaggaggtttcatcataaatgtagttattcatatgtaatcacatctcacatagtaatgatatttacataacaagaaataattttcttcaggaaagttgagtatgtcctgcacacatcagtatggcattatggaaaacattctgacatctaggcatttctcattgacattaatagggtcaatatcctcacctgtcaccacaaattagaagtcacccctggatcttgttgtgccctgagggtagtaaatagatttccatgccccagacccaaataaaatatcaccagtatcttttctcttccttggctcaggtagtatacgtcctgaaacagatgacaactttaagtttggaataccaattgggtcagaagataaacaaagtgcctcattttttgactcatccatgcttcctccacctccatacaagtatttttgacaccaagtttcttttaatccttctttaagagattcttcctataagattaaaaaaataagcagagtacctttccaaataacaaaacataaaggtaagtatcttgcaagtacataggattcattttctgaatatagtataacttaataataggatgtgcgtgtgtgtgtgtgtgtgagagagagagagagagagagagagggagatagattatgcaatcagatatgaccctttatggatctatgattggtttacaggtacttttcatgacctatgagatctgatggtgagcacatgttactcaaaattcattgatcaattcaggaagcatttgaaaattgcccaataactgcttttcagaactaatatccatttatattcatttatttcaaccaattcctaaacaaaagcttcagagaaaaaaatctcctttgtctttgcctgaaaaatatgtgtaattgttgacttgtcattttatattgtgttacctgcctttatcatggtactacattgtgccagggatttatttatttatttatttatttatttatttatttattttatttattttgagatggagtctcgctctattgctcaggctggagtgcagtggtgtgatctcggctcactgcaagctccacctcctgggttcacgccattctcctgcctcagcctcccgagtagctgggactacaggcgcccgccaccacacctggctaattttttgtatttttagtagagacggggtttcaccgtgttagccaggatggtctcgatctcctgaccttgtgatccacccgcctcagcctcccaaagtgctgggattacaggcatgagccaccgtgcccagccgatttatttcttatgtacccaagaaaaataagaaatagctctctgcccctctctctatccgaattaacatcaaagacaaacagatatgatttacagatactagttggtttagacaatatggtgtactagatgtcctagaaacccttatgataaaatgcctagaaatactgggaaacatataaaaaagtttttttttctttttttttaaatcagagaaagggtcttgctctactgttgcccaggctggagtacagtggtgtaatcatagctcactgcaaccttgacttcctaggctcaagtgatcctcctgcatcagcctcccatagcactggtattacaggtgtgagtcatcatgcccagtcaagaaacattttacaaaatgcatacctgctttcataagaaattcagggaaaacagccagaggcacaccaaaagaaggatctgcaaactgaagtactaaggtaacagtaaacttgcagttgccctgggaatatttttctatctcagttatctaccaccttggattttagtgggctcataaggaacaggagatgaagccttgtttctatacatggtgttgatttgggatcgtgattgccagttgaatctcctatccacatagaaatagtggactaaaaggtatatatatggccaagaataaagagaaactagaagtatattagtttgtcttggcctgggctctgtgaggtaaaaattgtgaaatgtgaaaatgtatatatgtagtctgccttcatgtaaataaggatcttaaatctgcaacatctcatgtgatcctggaaactttgagcaaagaaattaacttaaagtaattccagatttgtatcaccacaggactcttgtatgatgcaaaagtcaactctttctgaaggattttatcctaacaggtcttgtaggattcttaaacatagagcccccatgaacataaattcacaatccaaagttataaaactgacactgaagtagtgtcagaagaaactacagaacagcgtatttgacctttaagaacttcagatactgaaattatcaaatattagatttaacatttatatttaaagtatataaataagaatcagaaacatgaatgaaggagaagatacaataaaatggtgagatatatttgcagaaatatcaaatgtattttacagaaatgaaaaattcagtagatggattaaacagaagattaggcataaagaaagaatgagctataagaaaaatctggagaaactgtcaaggtgcagttcagagaaacaaactcatgaaatatataggaagcatggaaaataaaatgaaaagatttatcatatacctagagtttcaaatgtaaagaaaaagtaagattaggagagaggtgagatccaatgagaaaatgactgagaatattctagaattaatgaaagacatagcttcagagtcaggatgcataatgtatataatgcaggaaaaataaatcatcacctaggtacagaataataaaaccacagaacagcaaaagcaagaaagaatataaatttaaataaatagcaactcaacctccatctccaaatgaagtgaaggagaagaaactaaatatagaaaaagtttggtaagtggaaaacaccaagtaaattggtgaaaaatatcagtaatcacagtaatataaatggactaatgtgacaaattgaaaaagtaattgttagattagacttttaaaacatgctacttatcagacttttctaaaatataggggcagtagaaaaattgaaagtaaaaggatggataaatatttgtcaggcaaatactaatgcaaacgttacatattttcatagctatattatatttcagataaaattgaccttaaggttaaaaaagaagcatactaggaaaaaaagaagtcttacataatgactgagaattcaattcactaggaagttctaacagttctgaatttgtatttacttaacaatacagtctcaaaatacatgaagtaaaaactgactgaataacaggaagaaacacacaaatccacaatcatgagggcagattttaatccactagtcaaagtaatggataaatttaaaagacaaaaattgttggtgagattatggaatagagatcaacacacatttacaaattttagacattgtggaccatatgatttgcagaatctcttacagctactcagttgtgccagtgtagtgtaaaatcagtcttaagacaaaacttaaatgaatgaacatatctttttccaataaaacttcatttatggacactgaaatgtgaatgtcatgtctttttcaagtgtcacaaaatctacttttgctaattttcaaccttttaaaaataagagctcttttttatctcacatgccaaaaacaggcagtaggccagtcttggcccataggctgcagtttgccaatgcctaatatccaagatttgtacaacagaattaataagtttaacttagtgaaaaatcttgcgtgtagtaattagaaaatacatattattctcaagaacatatgggatatttactaaaattgtcacgtattatgccgtaaagcaactaccaatacatttaaagaaatccatataatacagaccatgttctcttaactcaataccatcaacttaaaaataaataacaaggggattatttttaaaacacacttttagaaaaatttaaaatatacatttgaataaatattcacaagagaaaatgttcatattggacattagaaaatatttggagcaagtgaaagatgaaaaaaagtacatgtaaaaacttgtgaaattaacaaactgatatagagaaagaagttagtagcattaactatattaaaaaataaaaggttataaattaatgagctaagtttcagttctaaaagttagcaaaagaacaaaataaacacaaaaaatagaaaaaaagaaaataagaggaggacagaaattaacaaaacagaaaagacaaaccttgtagaatcaacaaagctaaaggttcgttctctgaaaagactaataaaatagacaaacccttggcaatagtaggacgtgtacatacatgagaagaagaaagagaacaccaatgatgaacaatattaggaattaaaaaggagagatatgactagatatgaagtaacaaataagaaaataccaaaagacaactttataccaatatacatgagaacttagacaaaatgcatgctttttaaaagaaaaacataacttccctagacaaactacagaagaaatagaaaaccttagtagacttataatcattaaagaaattaaatctgcaggaaaaaaaagaacaaaaaaaggaccttaagaaaaacactgaaaccacaggaaaattcaactaaacattcaaggaacagatcatttcaagttcatataaactctccccaaaagataaaaacatatattccaaatttcttttctaagaataatctttattccaaaagtagataaagacaataggaaaaatgaaaagtgtaagtaaaacttattatgaacatagatgaaaattctaattcaagtattagtagactgaatcaagcaatgtataaaactgttaataaagtagaccaagttcagtttcactggagtctaaggtttgctgaacattagagaaaatgttaatgtaaatcatcacattaatggaaagtaataaaattatatcaccatctcaatatatacagtaaaaacatttgctaaaaaccagtgcctgttcatgaaacaaaccaaagcaaacacacagttattaacaaagtaggaatagaagcaactgataaattgtgtctacaaaataatctgttgcaatcatcatgttcaatggtgaaatgttaggtaaattcctcttgaaaatcaagaacaggagaaaattgcataacattatcattcctactcaacagtgtaccagaggtcctaatcagtgcagtaagacaagaataaaaggtaattattaaaatgttaaaaatgcaatgttgtcacagtgtatagactttcatgatttgcctacatagaaaacctgagataatctataaagccttagagttaatgatagtttaacaaaaattaaatgtattcctatatgtcagaaacaaacatttggaaaactaattttaggaaaaaaaccgcgtataattgcaagaaaaacaataagatacctagaaataaatctaacaaatgtttaagaccttaatggagaaaatataagattttattgagagatagtagacttaaataaaggcagatataaagcatgttcatggaagactcactatgataaagatgacagttctctccacttaatctatatattcaatgcaattccaatcaaaatcccaacagggttttgttttttgccttttgctgtgtgtgtgtgtgtgtgtgtgtgtgtgtgtgtgtgtgtgtgtgtaagtaaaaatataagctgattccaaaataaatacagaaggaaaaagacctcaggatagccaagaaaatttttatgaagggacatggcttatcagctatcaaggcttattagtaaagctagaataaataagctaattctcttacataaaaactaggccaatagaattcaatataatatagatccaggagaaagtcctttccatatataaaaacttagtatgagtcgacattgaagattagctgggaaagaacaggctgttcaataaatggcactggaatcactggttaatacacgtttaaaagggggttatcttgacgtcacaccatagacaaatataagttccaaacatttaaaagatctaaatgtaaaaagaaaacctttaaaatgtttagaacaatataaaagagactaactttatgacagagtagaaaaatagttctttgaaaggttttataacataaaacataaaggaaaatattaattcattttactataatagaagtaaaatattctgatcatcaaaagcaccacttaaaagtaaaaaagataatgaaaaacctggggaaagatatttgcaaggcataaaattaataattagaatccattctaaaaatgttttactactaatctacaagagaaaacaactcaagagaaaattaggcaaaggttatgagcaggtgtaacctttcataacctctcacaggagaggaaacatgaatggccaataaacacaggaaaagttgtttaatttgacatgtaattagagacatctaagttacatctaaaatgatatgaaatttctccaccctccagattaatagaaatttaatgtctggctactccaagcttttgtgaaattgtgtaggaatggacactctcatacactagttttttttttctttttttccttaaagatttttcccttattatacactagttgttggtgggagtttaaattggtgcatttactgttgaaggcaatttgtcaatatctagtaaaattgaagatggaaatatcctacaaatgagcaattccactactaggtatatttcctagagaaattcttgtacatttacaccaaaatatctgtaagatatatagaactatatcctggtttgtgagaaaaaaggcaaaatttaaacaatgtacctatcattgataggggaatggataaataaattatagtgtagtcataaaatgaaacactaaatagtgaaaataaatgaacttgaggtaaatatttcaacaaattattgatataattgatacagagcaagtgagccccaaaattggaacttagcctgggagagttgttggcttcacccaggaaagaattcaagggcaagcaagtggtgttaggaacttttattgaaacagcagtgtacagcagcagcagaggtactgctccttgcagagcagggctaccccacaggcagtgtgctcagggcatgggcagttctgcagtcatatctatacccacttttaattatgtgcaaattaagattatacagatgcttctagaaaaggggtggtaacttctgggttttctggtcattgtcatggaaaggggcgctaacttctgggtgttgccatggtaatggtaaactgacatggcactggtgggcatgtctttgcagaggtgcttttgcctcttctctatttcagctattcttcaatctggtccagagtcaagtcctacttcctacctcattcccccttcaaagattaaatactcctctttaaccttaagggggatgcaaaagtgcagaggtacatctttgtaactgcatcctgctgagtttatgggcataggcccttcctaccaccagaggaataaaaatctctggatcttatctaaggggcccacaggcaagacgcttttactctctgggtcagtagatgggatgggttggaagtcttgtgccagcattgtctttacctagaactttcgtaatatagaagacacaaactttattaagaagttaagcaaacaaaggccaaagattagtaataacaagacagctattaaaggccctacgaggccgggcatggtgggtgacacctgtaatcccagcactttgggaggctgaggcgggaggatcacctgaggtcaggagttcgagaccagcttggccaacatggtgaaaccccatctctactaaaaatacaaaaattagccgggcgtggtgaggcaggccggtaatcccagctactcgggatgctgagacaagagaattgcttgaacctgggaggcagaggttgcagtgagccgagattgcaccactgcattgcagcctgggtgacagagcgagactctgtctcaaaaaataaataaaataaaataaaggtcttcggagaggtaaaaaccaagtgagacttgggaaagtacttttgttagtcaacctgatatagttgggatcagtgccctggttatatctatgtaaccaggtagcttgcttatagatcttttgaatgttaacctcaatctgtccagaggcgttaatacatgagcagcaggttttattaataactgcacagactccacctcattcagcttgtaaataatccaatcctagtctattatagagaactacatttgccaaagagtccagggactcttgaactctctttagtccctgacctgtgttggtggctaaatattttagggtttcagttaggtcgttttagggttgactcatgatagacaaaaccactccatagtgccactagtcctattgttgccctgattcctgccagagttaatcctattgcttgtttaattctggtgttcctcagtcttagggggttataggctatgaaccctggaggcacaagggtgtccaatgtacattcacccctgtcctaaatttttgatgtacaagagaaagctacttctaaaagaacaagtggctctctgggaagttgggtgtggttatggggtgtgactttttcccacttacggccacaaacaaaaatgagcccagttgaggcacacatcgaggccttacagagtatgatgtctattctttgcttccaagttgggtccatagaaatattcttcccctgttccaatgggggtggtcgaacaatctttgttttccagaagcgggcagtactcccaccttcccagattaggcagttgtttttcccttgcatgttctgatccaatagaagccaccatatatgggttcctcactctcaagtggaatcccatttaccttgctctggccttgggaacttggcagctagaattggatcacagcatcacagggaacttcctcttttatgtcattaaaacaacagtgggtgcaaaagatagaatcattagtgtactggaggtatagatacccaacttcccaggttcaggtaatagtggtgggggagtgcaggtggaatctgttaagtaggggagcatcccacctaacaagtagggagttttggatacttgaggattgctatcattagttaggagatctggagagatggctgtgagagtttatgaataggccagaagatggaactctctatcttggggatgttgataaatccagcaaccataaagatgattccctgatgctacaatttttgaaatatttactatagagttttgttcctacccacactggattagagtaattgggagatcaaacagtattaatagtgacagcatggtatccagctgggctttagaatggcctctacacccaacaagaacaaaagagatgtctccccagaggaggtagctggctaaagcaatagaaaagaaacattgtagtcaagaagagaaaaattaatgctcctatttccacccatggcatcatgttaccactgctggctgagtgttgattcttttaaataggtagtggaagtcttccaaaggtttacagaagtaggtcatggtgccctctctttgtgcctgtgactcataagaaacaggtttaatcctcgatagttgtactcaagtagttattccctgacatttaagtggtggcagtatttaacaatacccagtagggacctttcagttaggttgtaactgattctcagaggatctttctttttggtttttagtaagactaagtcttgtgagaggcaataatttatttccatattctggaagagacttgtgaatctagcctaaattttaaagggggcatagtgaggtttgtctaactccctgatacctgtcatggcctgagttagtttttaagtttctttggaatttcctttgctcaagggacttacagtcaaaagacttatagccaattaaacattctaggccagatgggaatggaggtggtcaggcactcatcagcacttaaaaaccttttaagcaatgtgagtcaaaaactaaaagccaaaaatgagattatatcaagagaaactatattgggtgaagacactgctcccacaggcctctaaaacaaaacactttagcatctggccacaataatagaaccagaagaaaaaactcacaggagccgacaaaaaagctaaaggagggagttacatgaactcactgagaagctttcaaaagaattagcttacagaattgaaaactttctggtaatttcacaaattaataccttaagaaaatttggtcttaaaatgtaggccatttttaaagagtcaattataaacaattttcttttagttacagcaagcttagtcacacacaaaaaatttattttataaattccctttcgtgaaccttatcataatttacacagatcatctataacatgcttggcctttctgacttttcctacactatctctttcttaaataaccaatcattttaatctaggacaataatttactatagagaatccttttgatgcaaaattactcctttttaaatattctttcttgcaaaaaatatattttctgtcaatagcattttttatatctctcttttttacacatttgttccctcatattttgaacctttctttcaataacttccaaattagacaaaaattattctttttttccagtaaagaatacatttctttggcacatttcatataaaactaggaagcaagaaatcctgaactacccaccatacattggcattctatatatgagaactattccacaattttaagattttaaaccacacaaaaagctcattatttaagcatctattccattcacatgtgtttaacatttttacttttaatagctatgtttagaccacctccaagaaccaagatcccatgcaaaggtagtcaccatttaaagccattttaaccattttaaaacctatgaacatcagtgatttacctagctaaaaatcttaaagttaaattttaaaagacgtaacatttctcttcaaatgaataagcctagactagccttgtttaattcatgagcactcttttatcagccaatatgatagcctgctaaacacaacacacattaaacctgtatatacacttaaacacatcaaataaaatgacatatacaaagcaactggattcaagttatttacaaaattgggacttacctatctgccaaattttgttagcaccagtaggtatagaagacaggaagaggcagggaagaagatcccatagcatcaaataaagaaggaagctgggggaactgcagtgctcagggggaaagcccagagtccccaagccaccagagagatcacccagtagtggagacattgaagaaaaatgttcaagcggctgcttgtctgccactgtgggaagctgtccattaggtcaagggtccagacccttagtaaatttacttggacaaggcagctctctgggggctagcagaagaaggttagctctggacacaatattttcctctcactggggacagttaggacatcttattgccaatggtccttttgcttgcagtagacacactgattctggcccaggggcctgcgagttgggattcctttctgggcattccagccgctgatcttgcgatgctttcttgagatgggtaaccctgcagaggcagggggattaaagcatttgctaataattgcattttttggctatttcttttttttcatctcttttgccctgtccctattgttgtagactttaaaggccatgtttaagagttggcttgcaggaatttgcggtttctttgctgctttttgtagctccttcctaatgacaggagcagattgaataataaaatgcgtacccagaagagtttgcccttctggggagtttgggtctgcatttgtatatttcctgagtgcctcaactaaatgaccctgaaacagagcaggattttcaacttttccctgagttatttctctaattttgttataattgactggcttaaccatacacttttccttccacttttttcctacagcacaagtaatagatggcaatatttgatgacatgctaaacaaaacacaagttgtaatgactgtatatacacttaaacacatcaaataaaatgacctatacaagacaactggattcaagttatttacaaaattggaatatgacaagttatttgtgagtaatgacaagttaaatcaaagaacatggtaaacttaacaaactactctataaacttttttggattctttgaaaactggccaaatttgtccttgtataaagccaaatcacacatagaaattggcatataagctccaagtgttttcttatttccattagctacctcctgcaatagatgtaggtttgcctttaggggccccagtacagggcccctctccaggtggtactggttgggcttattttcctgggcagtgtggggtatagctggggctagttggataagtgaggtggctggtgcctgatgaccttggggtgagatcctttgttagagaactggtaggactcctctcagaattgggggaccgaggagactccagggagggcataggctttctagccggagcagctaggaggggattccttaggcatatagctttctggtgcctggaaataacgagagccagtaaagggccataaaaccctgtacatagggatatcctcccattttcctcttttttttttatacagaataagtccaatcgtaaaatgtcgttataatgtataggaccatgcttaggtaaaatctgtttgctttctaatttgtattgaacccaaatggtgttgcaagagaaaatgagtttctttttctctaagctgaatttgaatttgctccaatagcttaaaagacaccctagtggtcagtcctctgggatgctcatcattgtctccatgactaataagaatatttattggacataggactttttctaagtctaatgagaaaaaaaacaactgggcctttgttatttctcccttttagatttctacttgctatctaagtataggtagtaaggtgttataaaagtggattgtaagtatttgccagtgaatgaaatatgacaaaaaagggtttttattaagcaaagtgtagaaggaaaaaataaataaagtaacaataggaaaagaaaatgttgttacagaaaatgataacttttagggcagaaaatgagaaaagacaagaccaagattcctctaggatgggcctccaacccataatactggaaggaatgccaatgccaaaaccctggaacaaccaggggtgtccaacaatactgaatgctgaaaacctggaatacctgagtatcaagccaacaagtgtttctacaccaaatgcccgaaacctcagagtttccaggggttctccaaatgccaaaaaccccagagtatctgtggggcatccaacagtgaaccccaaaggcctgattggggccacagaaaaatgtgactctggtgttcctcagtaaacacaatggggaacctctcataatcaactgccctgacttaaacaattgccaaaggagccaaagccaaaaaaaaaaaagactgcaaacaaaacatgcattttaggactgaaaataaaatggctagtggagcaataaaatagagtcagaagagaaaggacctggtgaagaagtgacaaggatgtgtctcaggacactcaattaatgagtgacttttcactgaccacttagccaaagacttttatgccctaacttatctgatattgtggggaagggttcagaggggacactcacccattcacagtagccaaaattgtgctgactgatcttccacatgggacccggatgaaggtcttccccaggttcccttaacttaggttgacttagctgtcacacatgaggtgcaagtgcagggattgtttacctgccagcctactggtaggagcagcaggtcccattcaaggtggtactactgtggacacttgcctgttcactcagctccactgcccactgggaaagatgatggatctggaaagggcctttggttagtgttatggctttgcggtgttagcagctctttattgttacagcctcagggttatagctctgcagcttttggttgccatctcaccatctcttgccaattgctgcctctccactgatcactgattgccgtcatcgccactgtctcaccatcttacctctccaccaatttccatctctgctctctcactctctctcacttgctgtctttgtccctttgttggtcaccagataacacagggcaggtgagctctaaaattggggcttagcttgggagggttcttggcttcacccaggaaagaattcaagggcaagctggtggtgttagacaacaacttttattgaagtggcagtttacagcggcagcagaggtactgctcattgcagaacagggttatcccattggcagtgtgcacagagtagtagctcaggggcagttctgcagttatatctatatccacgttttattatatgcaaattaaggggtagattatgcagaaatttctataaaagaggtgatatcttccagctcattggcttgttgccatggaaagaggtgataacttccaagtgttgctatgacagtggtaaactgacatggcactggtgggcatgtcttatggagagatcctttcactttttccctgtttcagctagtcttcagtctggtccagaacccaagccccacctctgcagtcaagtcctgcctcctacctcataatgagccaagaaaagcaaggtaccaattgaaatgtgcagagtagttccatttctacaatgtttaaggacatgtaaaacaatgttataaattgatgatacttctatgtatatatgcatctttaaaagaatgcaagagaatgatgaacatctaaatcaaaatagtggttacctcatggtgtgggagtaggaatgggaatacaagagtgtaggagcacacaaagggcttcaattgtattggtaatatttctaagttggttatgtctcatgggtgttcattatattaatagtattagtcttcttcaatgtctaaaatatttcataatatactaaaagtagcatactatgtctctgacactctacactcgcttttcctcctgaacctctgtttaattatgaaactctaagaatattctcattgatgttggaaacaaggcaatatcaccacgatcatttgacttagctctggatgtaccagctaatgcaattagatgaaagaaagaagatatgtaaaaacaaaaagaagaggcacaatcatcattatttgcaaatgtcattatatacctggaaaatccaagagtaccaactggaaattattataattgtataagtatgtatctgtagaagtgtagaaaatataacaacagatttcatgcataaaagctgctaaaacctagcaatataatcttaggaaatttatagaacctatatgaagaaaaaatgtattttttatttttttctgtctctgatgcttgaatcaagatgaaaaaccattaactctattgaggaacatgaatagatggagagaaatatcctgtttttggataggaagacaatagtgaaaagacattaaagtgtaatacaatcccaataaaaataccaagaaaactttggactaggcatagtgatttcaaagtacatacaaaacatgaaaataaacatgtgagaatagctaggataattatgaaaaagtgataaataaggattaactttacaatatatattctaagctcctgtaattaaaggtgcaggaataggaagacaggtcaaagcaacagttttttcattctagaaatagactcaaacactaacatatataattaaagggccatattaaaatagaagaaaaatatgttaaaattgactatacagtaaaaagtaaaggtaattccctctcccattataccaaaattaattccagaaagcccatatatttgaaattatatgagtgaaactctaaaagtattagaagtaaacatggtcatggggaggtagggggatgggagatcttggcatataaaatacctgagatgcaaactctagaaactctagtggaaaatattaataaatgtcactaaataaatttaaaaattctacacagaacaaatatataaaaggggaaattctgggaaatattttgcaatacatgacagataaaagtttgataatttattatgaatcagtacaagatcattcaatacaaaagagtatgaacaagcaatttactaaaggagaaatataaatggattataaacataggaaacaatcatcagttacatttatgagtaaatgcagattaaaatgagtggcaaatagtaaattttgatatttaacagtgttggtaagttaacaaataacatagaagcaaatccattgctagaaatttgtcctactgataagtggttttcaacctgaagcaatttttcccctaaagggacatttggcaatgtctggagacatttatgaggatcacaactgggacatgtgttactggaatctagtgggtagaagccagggatgctgccaaacattctgcaatgtacagtacaacccccaacaataaagaattatctgaccaaaaatgtaaattgtgccaatggtgagaaatcctgctacagatatacttgtgtatgcagacgcatgttcaagggtactcattgccactctgtttgtaaaagcaaaggactagaagcaacctaaatatctatcaatatgggtctagttaagtaaaatatgacacattcacaaagggctgttgtatagtttattttaaaaaataaagtagatagatgctgagaagaatatgtttacaagagacacaaagaaaaaaattaggattcagaccagtgtatgcaatatgtctccatttatgaaatacaaagaaaaacatgaatatatgcatgtatgcatatacgtgtgatgatctgcaagtacacacaacaaatagagaatggtcatctctgggtaatgaactttttgagtgggagactcactttttattgtgttcttttttgtattatttgaaattctactttatgaaaatattattttcacattctttaagaaacccaggctgatattttaactccaacttacctttgcaaggcttctctctattttatctctaaatagaagacacactccatgtaaagttggccaagacattatttttcctttgtgccctctgcctacaaaggcattctgccaattcccatttttgccttttaaaatcctttaagtggttgtaggtgtctggcattttatctagatttttaaacctgtttcattctctatatgtttgtttttgtaccagtaacatgctgttttggttacaaaacaaactaaccttgtagtatagtttgaagttggatagtgtaattcctctggctttgttctttttgcttaggattgctttggctatttggacctttttttgtttccatatgaattttagaatagtttttttttctgtgaaaatgtcattggtagtttcataggaatagcattgaatctataaattgctttgggcaatgtgaccattttaacaatgttgattcttcttatccatcagcatggaatgcttttccatttgtttgtgtcatctctgatttcttccagcagtgttttgtacctttctgtgtagagatctttcaccttcctggttagctgtattccaaggtattgtgtgtgtgtgtgtgtgtgtgtgtgtgtgtgtgtttgtgtgtgtgtgttattgtgtgaatgggattgttcttttttttctttccaacttttaggttcaaggggtacatgtgcagttttattatatgggtaaattctgtgttgtgggggttcagtgtacagataattttgtgacccaggtaatcagcataatatttgataggtagtttttcaatcctcactctcctcctacccttcaccctcaagtaggccctggtgtctattgcctgcttctttgtgtctgtgtgtactgaatgtttaggtttgtgttcttgatttggctctcagtttagacattgttggtatatagaaatgctaccaattttttttacattgattttgtatcctgaaactttgctgaagttatcggatctaggagtctttggccagagactatggggttttctagttataaaatcatatcatctctgaagaaagtttgatttcctctcttcttgtttggatgccttttatttcttcctcttgcctgatttatctggttaggacttctagtaatatattgaatggaaatggtgagagtgggcatctttttcttcttctgattctcaaggggaatgcttccagcttttgcccactcagtaggatgttggctgtggatttgtcatagattgctcttattattttgagttatgttccttcaatgcctaatttattgagaatttttaacatgaaaggatgttggcttttattgaaagccttttctgcatctattgaaataatcatgtagtttatgtgatgaatcatatttattggtttgtgtgtgttgaaccaaccttccaaatacagcatgttctcacttaaaaggcagagctaaacattgtttacttttacaatggatgcaaagaagggaacaatagacactggggcctacttgagggtggagggtgggaggatggtaaagataaaaaaactacctatcatcagatagtatgcttattacctgggtgacaaaataacctgtatgccaaacccctgtgacatgcaatttatacatgtaagaagcctgcacatgtaccccatgaacctaaaaggtagaaagaaaaaactgatcacgtgattcctgttcattaataccccttataatcttctgtttttctttggcatatgtgatcagtatacacattttaatgtgtataaaaaataaaatccttcaaggtaagtcccatctcaaagaccactttctataccaagtcttccctcatcctctcaaccacttggaagtacacatttatagacacataacactttgtatttttaaggcacccataccctgtgctacagtgatttatgagcatttttactttcttctttcctccatatcaaaaactcaccttacattttgagtttttttaagggaaaaatcatatcttattcatctttgaactagttttatagtatgtagcaaagtgcctgaggcataatcattggtcaataaatatttgtcaggttgaaatgaataaaagtttataatatacaggcaaatataaatgggtaaatacaaaacagaaaacaaacagaaaaaaaataacaacagaattagttcagtttgttggtaacctaaactctcttgttctttagtgcttttaaacctatacatttaactattgttaaaaatgtattgttaaacatatattgcgttttctggaacaggaaaccaactgtgtatactgtaatatacctatgtgatgtttttgtatttcttttaacacaaacttttcaattcttgtatagcaattccactgaaattgtaattgctacttttaagtgtcagtcatttttcatatgtctcactgaggaaagtgctatttgtttttattttacatgtgatgcatcaattgtacaagcacatgagacacttattttatcatctctaccctccatgtttcttgactgttacattttactactgaaatccagcatttcagatattcatgaggctgaaacatgtccataatcatcacattccccatttctttgggaacaacatatacatagtcgagaaactcactgtatcttaaggcatgctttgtcatctactaactttctactcattgggatggagttgcactgagagataaggttgcatttaagcaactgcacacacaaggaagaacagtaaccactgttgaatgagtggtcaatgtcataacactgcttcacagggaggtaaaaaacatggcccatttttattagaagctagaattgtgtccggaatagaaaatgctatatatatatatataaaatatttgctctctctatatatagaatattagatatatataatattagatacataatataatattagatacataatatataatagatacataatattatataatattagatacataatattatataatattatattagatacataatattatataatattatattagatacataatattatataatattatattatagacatattatatattatattatagacataatatataatatattatatgcataatatataatattatattatatgcataatatattatacatataatattatgtacataatatatacataatattatatacataatattaacataatattatatacataatattgtatacataatatttcatatatatatataaatatttgatactgtggaatacttttccccagttagtgaggttactttctattgataatactctggctatacagccattttacttgtttctaaatttaaaatcaaatcactttagcaagtatagatgtagaattttaggaacctctggcctttttacaggtattttccttggcaagggctccattgagttggcaatctagtaacctgcattgtgagggcacattataaaagttacaccaacatctaggactaacttttggcttctcagatggaagataaggatataataaccaggtgttgctgttattacctttagtatttgaagcagttgtaatgtttattttatttcaactttgggtaaatttaaggaagcagaggaaatataattagtctataatttaaaaacataaagccaatgtaagaaaatctgccatagttaattatagtgtccagattaagaactttcagcctcttccagaataatgtatgagcgcagagttaatcacatgtgggattttcaaaacatttaattgagaaaaaaatacaaaaaagtacttttgagaaaatatgacccacagcaatcccattatctccactgttaaacctccccactagctgctttttttctcatctgtccttatctgttatcttgctagatgccatgtgaggaggccactaaagtagaaagaaacctgttctttgccttcaaggtagctctggaggcagtaattaatatggaaataagcgctccattgtgtgattcagacaaatatgatgggagcatatagtttcaaatgaactgtggtcatcagagcaggtcatatggagtacatgggccttaaaggatggattacaccattactgtttcaaatgtaatagtgtagaattatgctaatcatgggttagggattccattttacattaaggtcaaataaattttctcaggttacagaagataattcaacctaaaaatatgtttcaaaagagtacctgaatacagatacattttaaggtgtttttattgttttgttattggaaaacagcagagagtagggatgaacgtgatctcttgctattttttacttgttaaggactaaataagaagaaaatgactaaaactgactgcaaaaaataagaataaaaataatagaaaagttacaactggtatttaagagaacatggatgaaaacttatcatattaattaaagcatggtattaaaaagcaaattcacttagctgttcttcctttatgtttataaaagattggattaaatgaccttccagcttcaaaatctgtaaatttattaaagcatagtgcttgtttatctcattttgttttatttttctttatttttttttttgagatggagtctcactgtgttgcccaggctggagtgcagtggtgtgatctcagctcactgcaacctctgcctcccgggttcaagcgattcttgtgcctcagcctcccaagtagctgggattacaggtgtgtgccaccatgcccagctaatttttgcatttttagtagacatagggtttcaccatgttggccaggctggtctcgaactcctgggtcacttgtgatctgcccgcctcagcctcccaaagtgctgggattgcaggcatgagccaccacgcctggcctgtttatctcattttaaataaatatgagtgttttcagagagtgatgatcaaatagcagaatctctcctatcaaattttttaattgacaaaaataaatattaaaaggaccccattaatgctgcatagctaaattgagtaagtacacatctggttatagaggttatacatgctggggatgagtagatggttattccaacctgttactgttctcacagatgtcagtttgtaattactacctcttgtcagaaagatgctacccacatggatttcccagaatttagtgaagagagtcagaatggagaaagtgaaggagctttgggcttggtgataaaaagacaagtaatatataacatttttccccttaaaaaacgtttctcagaataagtgaagcatttaatgaatgcctttggagctatcaaatatttgtcttttcctgagatccagacgcattacatttacaaactaccgagttatgtgtacctgtatttcattgttggcattttttgatagaaacttgtggtatgcaaaaggaaatgaaaagcttatagtagacccccaacactagtcttacaaattcaagccaatacatcaatttcatattattcagtgtcacccatttgcctttgacatctttgctcacaatattttcttgccttgctatttgtccttcagagttctgctcaaattctacctcttctctaaaagttttcctgtttatctcatattccttttccatttctctgaatgtctctgtagcactgaggcctcaattatatgtgatcttacattgttctctaaattcttactctgatttgcttcactatcctgactgctcctccaggaatgggcatttctctagcttcagttcctctctttatacaatgagggtgacaatataaccatgttaaaggcttctttggaggattaaatgagataaaccatgttaatcgtggatagcacagagtctggcacacattaagtatccaataaactttagctattgttattatgtgctctaaaggcttagtaattgatagcttgattaagttttctttcaagtctgaattttaagagaatataattttttgtctgctagaaatagcctcagagtgtgtctacaaaagtagaacaactagttaaacattgaaaatatggttaactagttgctttctctacatgccactaaaaaccaatttggctgaattatctgagtgaaataattgactgtttaggaataatggcatcagaatgtgcataatacataaattttcaccagtaatcactgctaagtaatataagttgaataaagtcatgcccatgaggcatttagatagaattgccacttaactcagtaaaacaaccattttgacaggctttaagataatttttttctgacttcatcaatttattctgtaagttgaataaattgcctgggattttgtgtatagaaacaacttcaatctctttaagtcctgtcctgatttcttttaagtaccaaatacatggaccaatacttactcttcttatactcctgctgtggggaattttccagtttcaacaaaacattaagaaatgacatgaaatgcacatgcagtgtctgcctcacaggcactaatgttaatacaatgcattttgcttgacaaatcagcaccacttgaatagaggccttgttacccatattctcctatatagtgatctctgcattcccattttctcacattttggtggtaaaaaatacattccattttgcagtggacttcactgactatccagacaataagcacaaaattgtctcagcctgtgtgcaaatatcttactcagcagtcagggctactcaggaggatggccttttagcacaggaaatagtgttccaggtttctggaaagatcaagggagagcaaagctttattgagaatgtgactcagtgtgatacaagcttctggcatatacccaaggtaatgtcagtaacttatttatttggaatttataccctgacttttttcagaaggctttgaggtagtttataagttgtgtataatgtaaaaaaaaaaaaaaaaagacaaggaacatttagggcttaaaacaataaaaaccattctgttagtacagctatgttactctcaactacggaactgttccttacttatttaatcagtgaggggttttctcgctttgtgtcctttagcaaagtaggccttaaatgaaaattttcaggcactctttattgttggcaaggtcactggtggtctctgagattttgtgcctcctgcctcccgactgcccaagaaggctgccctcctgcattgtagtttcatcccaaacagggtgcttggggacctagatgcccaccactgagttacacaaatcagcctttagctgctttgtgacagcaaatacaaatgggtatgatgtgcatatgtgcttctcagtgaatcattcatcatctgcatgatgtgtctccccaggcaagaggtatggtagcacagctccctcaagtaaagcatgtctgataaattttgtagactgttagtggaaattttcagtgtttttctttctaaatgcttagtttatcttgcccaccaaaagcatagcacaaacaactttgccaacatctatgaagctctaagaccaagctctgctcttaaaggtttgggaaagtgatttgtattctttagtcttccagagtgaagaattaaagtttccatagttttggctttactggttttcttctgaccactagctatctgctgtggtgcagagacatttcctgtagggatacatgccttagcaatttgttttcatcactgtcacatcaactcagcattttcttgtcatctttcagttctgataaactgcttctgaattgacagctgtcaccaagatgcttacatagcaatttaaggttggtctaattgacaaaggttaaattttctacttgctcactaaacactaagaaattgggggtgattatagttaggagctattgccttgttatgtgtaaatgaattatggaacactgtagtttctatgcatcttaatagaactagatgtaatatcttgtttctaaatggatcaaagattgaattcacaggaactctagaattcattttattattagcattattgataggaaggtgccaatatatagactttgccgtcttttgttagcacatgatacctactctcattccagttaaggcttgaatgcccaagaaggcactatgacaatattactgcttgaaataattttgttttactttttattgtgcttttattgaagtctgtgtttttaaatttaaaaacatgcactccacacatattaaaatgctttttaagatgttttagaaattgtgtgtcaaagaaattcactgattaagtaatgctaccctttcttttcatatgcatatgcaatttttcactgaatatggacatgtacctttctaatctacaaacatacaactatgtgatggtataggaactgctgatactatttgtactcacttaaggtaataaagaggcttatttagggctgatcacaaaatgagttttcataaagtgaattacatttctcattttattactttattatcctttttatatatggatacttcatctcagctatagtaacacagggaacaactggtggacaaagtgtgtgtatatcctcccccagaaaagcctggggtaacctttgagaagtatagtgcataagaaatgtagtgcctaagtatttgctctttcgctcattcctttgtggttaatttcaatgtaggcatactggggtgtacatcttgagcctgggcagcaaacaaggcatagggtttggccattcttattatgctcttggcactgaatactctaatatcattatgcttttccctacaatgagccatctttcttataaggctgtacttctagtcccaaagagagactgaatgagtgtggatggcccaacctaccctcataactgagagaccaactcagattgcatggtttgtacctgctgctagaaataaacgggatgtgaagaagagtaaagaatcatattgttggcaaggataattctcattaaatattttttccagtttgaatcttctttctgtgcatatgtagcatattttgctcccttggactacatcttctcaaaggacagctattattcctattgtttacattcatacagtcctcttactgcccaatatttgaaatattttaagtttacgagggaaaaaatgaacatatgactatattccttcatcaaaaaatggtttcctatttcaatatcctctctgttctctggatttatcaactccaaaattagttttaaccatgtctgtaactataaaagcacaataaaaggtaaaaaaaaattatttcccaaaccatttcagactaattattggaactcattttgtcatgactctatttctcttttattgtcttcatctctttcatttcattgtatgtatgtataacacacatatgcatgtaaaaaatcagattccactgccatacttttctattttcttgtttcttcctcctgcctttaataagctgtaagcattgcttaagttctcctattctgattcatgtttcaggtagctaatgtaccactccttgttttctgtgatgaagttaggaacaatttgactcttgactatcgtttgtgttaccctcagtcacagttgttctgtactagatgttgttgacaaggcaataataagccctattaaatcctacctcttacatcaccaaaatctatgttattggctagacaaattgggccgatgtgtatctcttcactcagaaagttttcatgacttctccatgtataaggactcataagcaaacactatacaaatctggaaaatatatttccttgtgtggtgtaaaagtcacaggaaagtattaaatttggcttgggtaatgggatattcttcctcatttgtatcatgcaaataaaactccgtaacattttacaaatcacatacccaccctctctccccttgggatggggttggaggtgtatgtttttttttaacaatggtagcattctttttgacacaaagcaaggcagttcaaaataacactgaaacaatcctacattcatgcttcttcttcttctttacaaggcatctgacaggaaaagtatcaatgtgctaatctccacagcaaatcatgagataatggacatcttgcaaaagaatataaggtgacttgaggattataaaggtaatcttgtaatgcttttgaaaactcttcgaaagcactaaaacatcaatggcctgagagagaaggaagacctttaaaatatattgcatattattattcaataaggcaaaagcattatttgatgccttctttgggatcagtagcagttgaaagacctgtgttgcaaaattatatttaaaggtcaacagctgttttattccagatggaacctactcctgaagatgtttaaacacttttttatagaaattgtgattactgtagtgatgctagtctatccctatagaatttctaggacctattggagaagaaatactttagtaaggatatttggccttattaaccctagtaaagcttgatgtaaaaaatcataaggtgactaaatgcatgagaattggcttgaaattcagcttactagtaggaggcattaggacataactttcccctgcagatttgaaggaataatgctagacagcattaagtagtgagaatgcttactactcatatacctccttactgtctctccctaagactttgaacatttttagtctttagacacactacttttggccctattcaatgtattactatttatgtacaagatagtaatacattagtacatttaagttattaagtaacccaggcaaaggaagattttatactgtacatgtctgaggctcagtgctcaagggattaggcaagttacatgagtttgtcaaagggaaattcagaggagaagtttacacagtagccagaggaaggttaagagtcttagaatcaggccccaacagaaaattgagataataagcagaatacagacaggggccagaaagcctttcaaagaatggacagaatgtcagaggtctacctgccaactggtaggagattaggagggctgtccagaggggcactgatgccaatgaattgagcctagagtgttcacactgtgttcacattaatggccaaggctgtatctattaggaactcaaaaaatgagtctataagccagaatttcaagggtttcactccctttgttgcatcttttaagccaacatttattgagtacctactttgagccaggtactgagacaggctctagggaattcagaaatttataaaatagggtccctgcctaccaggagcttacactgttgtggggaagacaactaagaaaatctacaattataaaagcatgctgtgataaaattattcagtaagagctaagggagagcaaaggaggaatacctgcattttatgtaggtgtgggttattggtcatatgtgagcaaaaccgaaaataatcttagaaggagatgccactgaagttgaattgttaaaaataaggagatttggacaggtggatgaggaagcaatggaaggcattcaaattagcaggaaaaacatgtactaaggcattgagggaggcaagtgtggcttcttgaaagagccatacataggccagttttgctaaaaatgagagtggaagggaagagattacagaagacaatgctagaaatttaaacaaggaccagatcatgaatggcctttgtagaacatagtagagaaactggatgttaccttggaaacagcaggaaactactgaaggatactaagtagagagtgacatgatcagatttgcattttagaaaaaaagcacactggcagctgtgtgataagcaggggagttaaatgagtacaggagaggtacacagaggggtatacctaagtcagttaataactgacaggttaaataagcccttacaccgggtacttgcatttgtggaatacagagtttgaactccttatctcttcagaattttttagaagagttcaagacattaccaggatgtgatggttgaaggacagtgatttcagacatagccatagattattgctgcataatgtagttggagggctaccaagatgcaggggcagtatttctaccataatgagaatgacatcaaggaagacatcggcctcccacctggccgttatggctctgtcagaggtggaatcctgacttttctcatcaccagcaatgttattagggaaaagcaagaatttgacgtttctctttgggccctatctactgaatatgagtgtttgagatttaacttttttcattcagagaatgaaaaaggccacaaaatccaaacaacctttcaattttcatttataattggtttacaattataccaacatcagggcctctcctagctcaagcagtattgttctatgatttagcttgagcaagaatagggaaaacttaattttagatttgcagtttctcttgagttagagtccacagctacattagtacccacagtttcctttggaagtgaaatgaaaactcaccattacctgttttgaattgtggtctggcagctgagcaccttgacattgtaaatcgagcagagtcacttgaaaggaaataaaagttacactgattttgcacattcatttttttttattgcctaatgctagttgaccaaaatgtattcagccgagagagttgggaaattgattttattgaaattgataagtaaaacatatataaattagtaattacaaaaccataaaatgtttcttataggttaggcatctttatgcatgagtctgatattaattgtctctaatgatggtgccgaattgatccttccattaatattttgcaagttcagctgttatttttggcaccctctgtgaatgtcaacaatttgcttgcaaagaaatgatagcatattaagcttatgtatacaagccaatattatttaacaaggaagtacaatgttgctgaagacaaagctagtttgaagagtaaaggcaaacagctaatcaatctttggttgtgcactattatttaagagggaaaatttaacttaaattttgtttactattaagctcagagtttggttttaaactgtgatttaattgcataacttctagtatgtggttgcctttcatcttgatgttatattcattgaagctttcaaagaagtgcagataggacttatttccatccccaagtcaacatttattgaatttttatgtagtgccaggcaccatactaactgctttcatagagaatatcttattgaatcctcactacacaactctatgagacaagtataatttacatataagtaatctaaactctaggatcatgaaataatatgtccaagatttcacagctattaagtaataaagccaagatgtgaacttcggctgtctgagtctagagaactcactcttaaccactatgctatactgtattacagtttatttttagccaaagctgaaattatcagctaagaagatgattactaccattatgaacaggtattctgggttcagagccaaatttttatgtatattaaaattcttaatccctcctaccctataatccaacttccacttctacataattaccaaagagaaatgaaaacatatgtctacagaaagacttgctaatgaatgttcattgctactttatttataatagccccaaattggaaacaatccagatttctatcaacaggttaatggattgtattcgtacaatagaatagcactcaacaattaaaataggtgagctgctgagatacacacaacatggatgaatttcacagacttaatgatgagggaaagaagccaggcatagccaagtacatactgtacgaatctatttatgtaaagttctagaacaggaaaaactaaactgtggtgaaaaaaatcagaacagtaattacttctggagaggaattgattaaaaagggtacagagtaactttctggggtgatggaaatatttaacttgattgtgatgtgagacacacaggtttatgcatctgtaaaaaacccattgaactatatacttaagatctgtccatttcattctttataaattgtacctcaataaaaatattaaataagcaaacagaataagggcaaagtttaacccttaaaataacttttacatagtccaaatgggtaaagcatatctagttcattatcaggccaggaatccagattcaagggtatctactctgaggaggccagtatgaggctttaaggatgtgcaatgaaattgatagaatgtgcctagccacatggttctaagagttttcacccaaaagacatgagaacaagatatcagggcctaggctgatccccaagaaaattactgtgagctccttgtgggaagacgcagagtttttcatctctgtaataccagtgcttgatacactaggagacttgcaagagtaaagtgagcagcaggacccagtcagctggctgtgatgatagatgtacaagacctgggtatttcagactctcaagtagaagagagccatggaagcaggctgggggctccaaatacgctactgccaattttgctaagacctattcaggtctttgctcaaatgacacctcctcagagaggccttccctgactacttcatctaaaataatcatccttacccccaccatcacactctgtcctcttaccatgctttattcttcttcatagcccttataatatgctacacagttatttgcttacctactctttgtttctagttactctttgtttctaggtacttttattctttgttatctatttactctttggtgtttaatataagcaccctaagagctgggactttatctgtttttctcactattgtatcttcaatacttaaaaaagtgcctggcacatagcagctgtttaataagtggctattaaaagtaacatattagtaagacttgctggctgaaattaaatagtccaggtctatccaagtgagagcagaatctatctcttacatggcataaaagtgtgattacttgtacctagagttatgatattatactcagaaacattggtctgtttcacaaaatgtgcccattgtaactaaaaaaagcaggcaatgatcaagaaaatgcaagtaaaggcctggctatcaggctgaattgagttgcctttagttgtagtttctttccatcacttgggctgtggagttcaaatagtctcaagagcaaagtcacaagctccaatttatctttatgatagaatgtgcagaaagtgctacttttctgtgtgttgacatctgtcagagctagtctcctttcattctaaaagagatcaatccttcatgtgatagaggattatcctctttgccacctataagctggctttgatccctcttatctcttttcctgaaagggtgtcaccattttaccatttctctagcaacctgcagggttccaaacaatgcactattttaatttaaatagagtcatacctactcagccactcacatatatggctattttagtggcttgagccttttcagattttctgaaatgaaatctccaaatatcagattcttaatttaggataataaaagaaggaggttatgctatcagagcaatacatagtgttatgctttttttccccctatcagagtcattccccaaacataataggtttagttttcttcacagtgggaacttgaatttgctcaacaaggaagtatatattgaggttcagccttactagcctcaatgccagtgtgagtcagttcatcttacttcagttcagcaaacatgtaatgaagtcttgctgcatgttattcaatgtgctagataaaaagattaaaaaacagatcaatgaacctttgccctcatgagaatattgtccataagtatgtaccaagcaattggagatatcatgagtaatataaatgagaacatgcagggtaccatgggtacaaacttcaaggagaaaatagtccataggttcaggaaatacttccctgcagaggcaatagttaagctgagacttgtaagataattggaaattagccatggacagactgaaaatggttatatttcccactaattgaccacatctttgattctagcatacatgctagcatacagtcatgccgaagcccattggctctttttcttaagtagataacaaagaactggatgaatagagaatattatgctttgaataagtttattcaatcatttaacaaatggttattaagtgcttactatgtgccagacactgtggtaggccctaagaataagtcagtaaggcagatgaggtgtttgagatcaaagaacttacatctaatggaaggtgaaagacaagaaaatatcaggtaccaataaatattgaaactgaagtagagaaagactgggggtttcctgttaattaggtaggaggtgacatttatgctgagacataaattataagaaggagccagacaagtgagtattcgggaaccaacatcccaggaagatgtagcatcaagggtaaaaacctaaggaagcaaacatttgtcaagctagaaggacaaataggccactatcactggagcatagtggacaagggaagagcgtagatagagatgaggtagacaggagtcagttcatgtgtagttttgtgaacttagggaagtattttggattttatgctaagtgggaagggaatcccttagaacttcactgtccaatatggtagcaactattcacatgtggacattgagcatttaatatgtggctagtcaaaattgacatgtaccaaagatttagtatggaaacaggaatgtaaaatgtctcacaaataattattttatggactacatattgaaatgacaatattttggatatactaggataaacaaaatatattagtattgggttaaccaaaattatctaattttacctgcttctctatactttaaaagtgtgggtattagaaagtttaaagttacattagtggcttatatttgtgttttacattacatttctgttggacaacactgccacagaaggtttcaagcaagtaagtgatatgatattatttctgatcttttgaagatcacaggggctgttgtacagagaaaggattggaagaggcaatactggaagcatgggaattaattaagagactttttcaacagttagaaaaagataatgctggcttgagctaaacagatagcagtgaagataataggaaaaggtacagcttatgatgtttatggtaggtagagttgattttatttccttatagtttggctctaagaagatgaggaaaaaagtttccaaagaaataaagctttggatttttagcttgaacaattgtgtatgtggtggtaccatttagtaagatgaaaaagagaggagagacagtttctgattgagggtagaaatcaagagttctgttttggagatattgagtttgagatacttgctagatatccaagttgatgagtcaagtaagaaattgaacataagactctgaaatttgggaagaggtcggagctgaagatataaatttaggattcctaagcatgtagctataaacaccatctgtgggaaaagaccatcacccagtgacagtctgtagagaaaagaagagggccaaggacagagtcctggggcatgatatcataaagagtttgaataaaaaaggagaatccaacaaaggagatagggaacatctggtgagttacaggttaaaaaggagtggtaacaaagaacacaagtatagaaagtgttactttaagaaggaagtggtcaactaacttatatggtgttgagaaatcaagtaaagtgaggacagagaatttctatttggaaacatagaggtcattggtgaccttggtgaagtatgggtggcagaaggcccattggagtgaaatgagggggaggatgtgagtgaggaagtggagacagtgaatgtgacaactttttcaagatttgccttgaaggaaagtagagaaatggggcagtagcaggagaagaatatggtaacaagggggaattttcctgtgtgtttgttttattaaaatagaacgtacaccagtctcagtggctcatgcctgtaatcttcacactttgtgaggctgaggtgggagggtcgcttgtgcccaggacttcgagaccatcctgggaaacatagtgaaacaccgtatttacaaaaaataaaaaatcaaccaggcatagtagcacacacctatagtcccagctgctcaggaggcaggagaattgcttgagcccaggaggtagaggctgcggtgagctatgattgcaccactgcactccagtctgggtgacagagtgagacccccatctcttaaaaagggttggagaaaatactagagtattttattattttatttatttttgagagagggtcttgccctcttatccaggctggagtgcagtggtgcaatcatagctcattataacctggactcctggactcaagggattttccctcttcaacctcccaagtagctgggactataggcatgtgccaccatgcctggctaacatttgtgttttgtagagacagtgggtctcactatgtgacccaggctggccccaaacctttggcttcaagtgatccttctacctcagcctcccaaagcactgggattacaggcatgaggcactgtgcccagcttagagtattttaaatgctgacagaatgatcccataggaggaggactgattacccaagagagaagggataattgcaggagtgccatcttgagaaatctagatgcagctctttaattggaacagggacacaccatccattgtaacaatagaaggcagagagtgtgccaagatactatgtgtacgtggagtgggagagtgtggggtaggagtgggaggacaggatagggagatgagctcttgcagctgacttgaagacagtggagaaggtgtgaaatattttttaaaagtgcagaagtaaacatactagggaagtgtaggaacatctctaggcaatgttgtgtgccatttgagagttgtagccatgcatttaaagcgaggccaatctgcacagttgtatggtctccaaaaactttctggaacttgaaggaggaactaaaagaagcggcttctaataaattctatagctaaggtcatcgaaggttacttattttttactttatttaggttgcctgatattcacttagtctggcctgctaaacatggacttttccagtatgcgtgggtgttacaacagaaacctttatgtttgcttacaggctcctcctttttctacacagtggtatgcatactgtgactacatgaaaaccagacatccaagtggagacggaaaaatttccccaaacttcctttagttctagtacacattctgacttgtgtatgtgataatacccaatgacattttcccctatgtacaaggcaaacctttaattttattcctggtgtttccaatttcttacttagtactttccatttaatctttcacttcaacattattacccctctcactcataacatttctttttttttttctgcataagacttttctaatttgtctgctgtttctaattcttttaagtatctttgttcctctatagctcctctgtccttcctcaacttctttttcctctttcatttccttctcaaagcctttatagattcaatccctagcaaatcatatatgggtatattttcattgtgctattcctttcatatggaatatattctctcaacaaggtacttactagtatttcttaaaactttctttttgcaaattattttcttgagctagcctaagctccagaggaaggacatctgttactactatggaattgtaattagaagtctactttccatttatagctctaaattttaaaaaatcccttgaggttagtgacttaacagaaaatagagaattgttattggggatttgggacagtataaagacaagtacaagctggagatctttcatgggtggcactgggagtttggggcctgtttgccctctgctaagatgatatggaccctacctgagattattatggcagtctaaaagtactgattgtgctgtcatccatctccagactcactgttggtaccttattttattcatgttcaaaaatggtattatgattccttcactgaccctggcttttttctaaagaaacactcatgtgctcaataattgcattgactaaagtacaaaataaaataaaatttgaattagtaaaggttttaaaacactttaaaaaggtctaatctctggtactttttaaacattctaaaaattaaaggttacattaaaatggtgcctgttgctgaaaacattacactagtcctgatgtgttatatgaagtccatagaactacaggttggttagaattaaattatagttattaaagacaagaatctattagtattgaattccagatataatgagaattttggcttgctgccttcctgccttcagcctccataaatggggcattttaacccctagcattgtccaacacccaaagatcaatctggttcctaatcagaggaaatattaatagaaaggtccactggagtccttagccttgcagtaagtcatccttcttctattctgcctcttgcttttccttgtgaccaaattcctgctttgtactgaaatttaagcaaatgggttcctatttttcgtttaccaccacttgctttccttatcttgtgcctgacaccctctggaactgccagctaaccttttggtgccaggttaccatagcatttggtcctattgaccccttaagatgtcttacgttgcctaatgttggatcttcttgatgccaactacctatctgattagacttcctaacattgcctctgctatgatttgcacagaatacctgtagtattcagaggagtatatctagtctccaggattctgaatatctcctctctggtctattctacagagagtcattctcttttggccctttgctatagttaatcaatgtaatcatttacaaaggaactgagttcttttgcttcattcagtaaaaaataagcaaatcaagatgaaaaagctggccttcaggaggctcaacctgctttatcattgaggtctgtcttccctgtatttgaagctttttaaataaaccattctaaccagaagagagaagatgaaacagttaaagctcaaatcaaacagactcaagaatatttaaataactgctttctaagggaggaaaccaaagcaaaggcattaggagagtgttgattcttagtagaataaacttcatgggtaaattgggcatcttttaaagtgaagctctgtgactatagttctaaccatgggatcttaatagatggatacaccaagcaatgtgacaaggacatggtaaagggctttcctattacacagtaggtaaactcaggggagaaaaagcagaagcaattcataggctcaggtttgcatatcaaaagaatgaaagatgatgtgaaaagtgagggtacttctgaagtgaacagaaatcaaaatctagttaggttggtaattgggaccaaagtgaaagcaaagggggtaaaaataaaagtgatgagtttctgcagaacgaatttcggaagattgcagcaagagttgtgtgaaattgaatgagtgcaagcaggaaatggcacagaatagaaatgcaaaagcattaaacctccttcaatgggatcctaagagttctgcctgttatccaccaataaaaataataggagataaagagcccttctatatctgaactgctatatacaaaaagcatggtagaacaaagggagagctattcaaggaataaaacatcaagtttacagggagacaggaaaatataacagaacaagtttgagtgtaaaataaagataagcctgacaaagaaggagaatgaaaagaagagctaacatacatatgatgccttgaaagcccatccatttcataattttggtttttgaatgataggtagaaatgaactccacctaaatagcacttttgggatctggattgtgtcctacatattttgaaatttctccttgatttggggaatgaagtcttggaatcctttttgaagtcacgaaagaattgaatgttttaaatcttataaacgatggtccatgaattctctgggaaagaaaatcttcaactttattttcataatggtggcatttatattgtttacatacaataccttccttcctagaatgaggaatgtcagtagccattatcccaacccccctaatatacccccacataccaaagtcattatgtgttaatcctataggaaatgggcaatttttctgaagagattctaaattaaggccttttaaaatagagtattcttaaggagtaaaaatggcttaaagaaaattgatctgtgacgctgtagaagattcacagtttcagtgatctaattctgtaaacaccatcataatattatgtcatgcataatttattattgaaatcctgtgtgagaattctaaggttttttcatgtaccagagagttgctgagattggtaaagaaatgggttaactgtttaagataatggtattactctggatgggaggatgcaatcaatggggtttctaaatattccttttttttcaccattgtggaggtatttatatgtaatagatttgcttttacatcagtgttgaggagggaaaccacccaggatatgcttatattatattccttcccctttagtctctcccaaatatgcaatgcacagctgtttttaaatcaccattcagcatgtcattcaatttttattactctacattattataagtatccagtaaaaataagagtgaaatctgatgtggcttctaaaatcaatgagctatcatagaattgacaaaaattttggttgaaatttagagtacttaattatcacccaaaatacagatgctgaatttcatccttgctccagatgcttcttaaaatatcaaatgtttgagatctttcatttatagatttggttttacaggtgaacacaccaaagtttagcaatttttcacatcatatttatgttatatcctctctctcacgtgcatgtgcatgcctccccctcccgaaaccgagggttatagaaagataattactttttttatcctctgtgtatttttgcataattttcttccccatgttttgatttctctggagcaagtttctattagtgctgtcagtctgtaactgggccacttagtaagagtgggagaaggagacttttttcttctgtattacatcttccatgtgattctgcaactctgttttagtcatctgtccattcacgcttgttactcatgttatttttctcttcgtttctgtcttccccattccccacctccaggccccacacactcagatccatacttgcagaggtcattcctcctctcttccatgagaaataataattgacattaaagtagctaatgtttattgcgtgcttgctatgtgccagacatcattctcagaactttgcaaatattatttcatctaatctatgtaattggcttttctccaattttatttcaaaatttcaagaaggttatagaaatgtaaggcaacaaaaagggaaaaatcagacatgtcactcctgagatttccttttccagggcttgaagaatccttacacataaaagatgtttatagttccagatcatctatccaccaccagaaagggcagcccattcactatggatgtctcgatatcctgttttcaatacacacatctctgcttgtgaggcagttttaatgctccaagtcatcagaaaaggagagtgacttggtttcaaatgatgagtgaccaagataagcagtctgaagagtgggttaaaataaagtaaaatgctttgacaggaagaggtcaaagctggcagttgtgttttgaaatcttattaaaagaggctgacatcactaatatgaaagaaacttctttcttgttttttaaaacttttacgatgcatgaggtagacttctttttcaaaaaaaattcccatcttgagtccttgcaatatacaggaaacatgcagttaatgaaatgagaacaggttgaatttgtgataaaaattggtgtctggctctctgagttcagcaatataatttcatttttattagagtcttacctatctttaacattgaaaattatgctaagaatgaaaattttgaggagtatgtaccttacaaggttaagaaatataattttatttttatcaaattatgctcacattttgtgttaaaaattcactgaacgatgaaaatgttgagagaccctgaatcctattttcacctatttttaataaggatcttgtggtacctcgatactgatgtattactacaatttgccttaaaatggtgttcaccatacccctcttttacatgttaagaagtttcatctgcacaatgtgagatgatgttatctaaattcaattcacacatttggttcaaggttaaaatatccccgtccctcagtgaggtgggggaggaaaactgctttgtttaatgttaatggaaaaatttcacctgtgaaataatcttcaaactgtgaaattaaatcccccacgtatgttctatgctcatgccttcagccttcctccctctacaccgatctaccctgtctctggattcttttaagaaagtatttgaataccatgttgcatagagggcaaatcacaaaatctgggcaagaaggattatttatatgacttttgtgaaacctattccctctaaatattgactctccaactagattgtaagtttaatgaggagaagaacaaagattttaccttcctgtagcctcctacaatgcttcgtatagggtagtgcttaataaatacttaatgatattgatctgaaatagccagtttagttggtcagtaacaacccagaccacttaataacttgattgcctataaacatagatatatctatgcaccatggaccaacaacgtgggcatcacctgggagctcataaatgcagaatctcaggcctcacgccagacttacttaaccacgatgtgcatttgaataagttctccctgtgatttgtatgcacattaatgtctgtgaagcactgctccattgcattaaggattaggcactttaccaccatgaacatttctttctttctcttatatttcttcttgtatgtacctctttccccctcttctgcttatattataggcctactagttccctctacctttttagttcaccatgtatttccaagttttgtgaagactagtcctcacaaaaattctctgaactcttcataaagaatagtcaatatctagtcatttctacttcctcagctagttttgttaaaattatacaaacttaaataacaggggagaatttttagccttctcagccttatgttccctagaaaaatgttacctatagtttcgttcagaaatcatagattacaatattattcttttaaagtaatgagcagagttttggtagggaaataaactctccaaaagtaataatttctgattctcatagctatggaatcttacgttttgtatagataaggggcaaagcaagtaagggaaattcgttctgtgatttcagacacatgggggatttttatctttacctaatgtaggtttttgctgtgttttttctctgtaaaagccatggtgcttcaaaatttaatgagattatatgatgtattatcatcatttgcaaatgcaattatcagctgcgattaatcctgctaattccgagaaagccatattgggtgttatttttcccctcctcgtgggtatttgtgttgctcttactttatgaactttgatcagaactactgcagaaaggagggggaaagcaaatgggatgtatgaaataaggctttttatgactggttttatgtagacatttatgagtgcctaggaggaaacatctcacaaaaattcacttcacctggagagaaaacaatgtaaatattagtatatagatataatatatatattactaacaacttgtagaagaaaaaataatactggatatttcttgttgaattcaaacatatgttttattaatttgaagcaacatcagctccttgtatgtaactttctcaggatattcatttaggcattacatgtcaaggaagatgcgaatgactaatcctagagttctgagctctactgaagaaatcaaatggtaagtctcaggcaattactgtatgcatttgagagtaaatttttatcccaccagattacagatgagttcatcaattattgagcacttaagctcagctggaatcctatgaactactgtttccaagaattaagcaagaacacattttgagattgtgtcactgttgggttgcagttgagacaccttgctattaccatcatctctaccaccacataggtaggataactgcactccttgttagatcctttaaggcttgagatgagtgggttagaattaggacctacaattattaaatttcaatctaccagtggttttaactcttccttggtcaattgtgagaacaatcattgcaattatagtcccctctcaaggggctggcagctgcctttcttattccccacttgtgatttacttttataactgtgtttaatgcctgccaacaacttatatccccaactcttccattagtgaaagtcttggtaaggtgctgaagcagatataaagataagtgagggggataatgaaactgaaagaaatgaagttacttgtctttgattgcaaaatataatgggagaactatgactaatgagaggtgctcagttatttattgaacaaacagttcttcagacttgggggaaatttaaaagaataattcttcatcagaaacagctttggaatgctcatatatatagtcctacattcttattttgtagatgtggaaactatgtcccaaaccatgtgatttgtccagaactaaactaaacctgggtcatctgatacaagccagtgctgtttttccagcataatatctcaataaaattccataggccagctgtatctacaactatttggctcaatatcgaagtataacttctttgggctgaagaaggaaactccatcctaatttaaatcctagtgatataaataggatttaggatttaaattgggtggcaacagagcctgacaatccttaaggcttcttccaatgctaagattctagacataaaatccaccagtgtcaaaggtaaaaatgattcatgctaagcacagtgccatacacactagagctctgcgcctaccttttaaggaagatggaacattcaattactacataatcatgtttttcttgaaatgtactttttaataagggcaattctgtaagagtcactgtgggaaagtgaactgataatgtagatatactacaaagatctagtggtgagatcagaaatgatccagaaacctggagcaagtgagaagagaaatgccaagaagagaaaagtctatagtaagaaactacaaaggcaaagtagaaaaattcagaatcgttttagcactataaacactatacattgacgtggaattggttacttactattgagaagagaattgccaagggcaatactatctgtcttagtctgttttcagctgctacaaccgtatactacagattgagtaacttataaagaaaacaagtttattttggctcacagttatggaggctgggaaatccaagagcataatgttggcatctagtgaggatcatcctatagcagaaggtggaagggtgagagggtgaaagaacataatacagaggaaaagggagccaaacttctgtgctaactacactcactcccacaataatggtattaattcatgcatgaggatgatgaagatggagccttcatggcccagtcacctcccacatcttaacattgccatgatggcaacccagctttaacatgagtttttaagtgaacattcaaactataacacaactctttcaaagtgacgagtatactttctaatcaaaaagagaatttttttttcagtttcatataccataggctatttttcaatgtatatgtcattatacaaaaacaagaaatggggaaaggatttcctatttaataaatggtgctgggaaaactggctagccatatgtagaaagctgaaactggatcccttccttacaccttatacaaaaattaattcaagatggattaaagacttacatgttagacctaaaaccataaaaaccctagaggaaaacctaggcaataccattcaggatataggcatgggcaaggacttcatgtctaaaacaccaaaagtaatggcaacaaaagccaaaatagacaaatgggatctatttaaactaaagagcttctgcacagcaaagaaactaccatcagagtgaacaggcagcctacagaatgggagaaaatgtttgcaatctacccatctgacaaagggctaatatccagaatctacaaagaactcaaacaaatttacaagaaaaaaaccaaccccatcaaaaagtgggtgaaggatattagcagacacttctcaaaagaagacatttatgcagccaacaaacacatgaaaaactgctcatcatcactggtcatcagagaaatgcaaatcaaaaccacaatgagataccatctcacaccagttagaatggcgagtattaaaaagtcaggaaacaacaggtgctggagaggatgtggagaaataggaatgcttttacactgttggtgggagtgtaaattagttcaaccattgtggaagacagtgtgacgattcctcaatgatctagaactagaaataccatttgacccagcaatcccgttactgggtatgtacccaaaggattataaatcattctgctataaagacacatgcacacatatgtttattgcagcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttgtcactcataggtgggaattgaacaatgagaacacatggacacaggaaggggaacatcacacaccagggcctgttttggggtggggggaggggggcgagatagcattaggagatatacctaatgctaaatgacgagttaatgggtgcagcacaccaacatggcacatgtatacatatgtaactaacctgcacattgtgcacatgtaccctaaaacttaaagtataataataataaaatttaaaaaaaagaaaatagtgtttttatctctttgtaatactgttttgttaggtgtaactttctaacactgtgtgtttaatggagtattttcctctcagtatgtgtgacttcttatgattctttgcagaaatctctacctactaccttaaagaagcttagctttgagatccacaaactctctggaaaataatctgtacataactttttaattaatttttttatttttaaaatttactgtataatatttaatcatttatcttgtgtctgtaagggttttgtattatcttgtgaaatgatttttgtcatcttttatgtagagttttgtttttgtttttagtcaaaccattttaaaagcaggtagggctcaagagtaaataaacaattgcatatttgaattgctcccctgaaagttagggtatattctattaacccagaaatgccaatctgacatagtgcaaatagaagtttttcccaaaatagtgcttggcaccttggtaatgtgcacatttcctcctattttattacctactgtggtgcaagggtttcactctcattttgggatggactctgaatgtttcatttgcatgccttttatggtggtaacagacgataatttttttacagatacagttttgctttttatcatcatttgtttctcttctacaagacttttaagttggctagttacagactatctgcttcttttaatgtttatatattagaaggtttaatagaagaaatagaatgtcactgtcgtaattggccatttcccccaccttaatagcattccagagcaaagtttctttagatagcaatgctaagcaaaatgcatttgtgcagcttcatctttgattcacccattcttataccatcatgaatgtttttgaaggtctttgccaaataatcttgccaaaggctctaggcctgctgcttggtatttgctgcacggactgggcctgaggaaaggtgagctaaaaagaaattagctgaaataatgagataattctagaacactagaaaatttagaattaacaaagttttatggtgttggataagtcccagcttcaaagcaatttctgaccatagcatttaaattatttcttaaaaaaatctcaatttatttacagctccatagtagagactataggaagtagagagactctgaggataagttattctcctgctgatgtgggccattgccacaggatgggtggagaggggacaatattgaaaacttaagagtaagctcttgaatgaaagttaggggtaaaatttacttggaacttatggcctttggttaagagagtggacttgactccaaatcctggctctgtcctttactagttgtgtgactttgggcaatttacttaacttctataagcctgcttcctcatatgtaaaggtggtaccaacaattcaattatataaatatattatcaaacagtgaaatacctgctatgtattaaatgttaataaatggaaaatggcattaatatttaattctcaatatttattatgattcccccaggtttctcctttcattaaaatatctctgaaaaatgtttcagcttttcttcttgctttttagttgcttctttaaaaacaaaatttattgaggcataacttatataccataaaaaccacccattttattgtatagttaaatgatttttagtaaatttgccaagtttttcaaccataaccataaaccagttagagcattttaatcacagctagtccttggcatccactgtccactttctggccctatggatttgcatattctggtcaattcatgtaagttgaatcaaataatatttggcttatttcacttatcaagatgttagaaaggttcatcaatgtgtagcatgaatcagtacttcgttcctttttatagttgaataatattccattttgtggatataccatattttgtttatccatttattagttgatgggcatgtgggtttgtttccattttttggctaatgatgctgctatgaacatttgtgtgctagtccttgtgtggatatacatgttcttatctcttgggtatatatctaggagtggaattgtgatggtattaatattaatagtagtatttactactatttcataattcacctgacaattagacagttacatagattcctatggcaaaacaaagtaagtaacttcagatgccccttaaaggagcattcctcaaaacaacataaatcagttagctcttaaaaaaattaaaagattcctatgggaaccatctttaatcacaggatagatcatttaaagactttttgcacatcacttttgggagaattcaaaagataatgttttggttttcaaacacctcaagttttgtcttgtctacacttttgtaagatacccatctgaatgtcaataggacatatgatgcctcagaaaggcaaagatttaccagtgattaatacagggtataaataatggtgtctgaatctgtgcatcaaagcaaggaagatagatcttgtgacatccctaccttttttccctgggatgcacaaatcagtccttaatagaagggggagagaggatgaatgctttcatgcctgtcaatggaatgaaatacaattctatggcaaggaaggatacacagtggttcatgcacagcaaagacatcagggctttctaggttttcagataagggaccatattcagatggccctcactttaagcaataattgagttcttgaaaataaatcaatgcagatattgcgggcctattattaatgtgtattttagtagcaactgggtgctagtttgtagaactagtcctcaaagcacaggcaaggctaactttctctttctctctctctctctctctctctctctctctctctctctctctctctcacacacacacacacacacacacacacacagagagagagagagagaataataaaatgcaaaattatcaagttctaatttatgttacaataaaatttcaacaaagggtaagttaggttgcagcactcaggttaattggtcaatgaagtcagattttttccattttcttttattgtagtttctctgctttataatcatttccctacccacatcttttataaaaaggaaatgaggtattctgatttgatctctggtggtaaaactcatttatcagtgtgccaagtgaaaaggatttagtaaggttagatggccgttgagcagggtttctcaaagtgtggccaggtaactttcttcatccaaatatccatttttatcaggctctctaggtaactgtgatgcacactggtttgggaacactgtagtggagtcttgatattcttatatttgctttacttccaactgtttattaaatgtaacaggtgggaagtaaaccaatgggatattgtaagctataattaaagaaaagagaagagagtatatgtgtgagaggtcctatggcttccatcagagtcttggacaactctgttaccccagaaaagattaagaactgttattggaaaccttgagtgagatctctggcttgagttccattccttttgtgcttctagctatgccaacagaaccgcagcatcaaagagttgcatcctcagggtttattatcatgatggaagggagcagatatcctgatactgttccacaagtactagagagggatgtagaggaactgcattgaaagaggtagcgatactctggtaggcaggaagtataaggtcttcatactttctgcctaccagagacagaggtataatgtcaccaggatcctagagtagaaacatcctagattgtagagggcaagagagttttagtccttgcttgctggtatgggtgaggaaactaaagaggcttctggagagcagtgctccagccctttgtcctgacgattctccttctctatgaagaaatcatctaatttttaaatttccttcccttgaaatacctaatttcttgcccttctgcctactgaaaatcctccttattatccaaagcctaggtctagccttatctcctccacaaactttttcacgatgactctttttccacattgatctctttcttctattgtgttttatagcatataatcagtggctcagtacatattgccttacataaaaagtgttacatgtatttgttttatctccacaattggctcataagctactggtaaacagggcataactgccctgactcctttgatatgaatcaacaaatctagcattataagcaccaggcacatagtgcgtattcagtgacttgaactgaagtacctggaatgtggatggcttatgattcttttttatatcatgagtataagtggagagacaagtagaataaatgagaaaggatgatttcttaaggttttttttagcccttgatgttataaaaatatttttccccagggaacatagcttcactttaatttattttttattgttacataatatttgcacatatttatggagtacatgtgatgttttgtggcatgcatagaatgtgtaatgattataattctcttcttaaaactgtatatgttccaagctaaggttctctttctttcttttccttttctatatttaagttctgagatacatgtgcagaacgttgaggtttgttacataggtatacatgtgccatggtggtatgctgcacccatcgacccgtcatctacagtaggtatttctcctaatgctatccctcccctagccccacaaccccccgacaggccctggtgtatgatgttcccctctctgtgtccatgtgttctcattgttcaactcccacttatgagtgagaacatgcagtgtttggttttctgttcttgtgttagtttgctgagaatgatgttttccagcttcatccatatgcctgcaaagggcatgaactaatccttttttatggctgcatagtattccatggtgtatatgtgccacattttctttatccagtctatcattgatgggcatttgggttggttccaagtctttgctactgtgaacagtgccacaataaacatatgggtgcgtgtgtctttatagtagaatgatttataataccttgggcacatgcccagtactgcgattgctgggtcaaatggtatttctggttctagatccttgaggaattgccacactctcttccacaatggttgaactaatttacactcccaccagtagtgtaaaagccttcctatttctccacatcctctctagcatctgttgtttcctgactttttaatgattgccattctaattggcatgagatagtatctcattgtggttttgatttgcatttccctaatgaccagtgataatgagctttttttaatatgtttcttggttacataaatgtcatcttttgagaagtgtctgttcatatcttttgcctactttttgatggggttttttttttcttgtaaatttgtttaagttatttgtgggttctagatattagccctttgtcagatggatagattgcaaaaattttctcccattctgtaggttgcctgttcaatctgatgatagtatcttttgctgtgcaggagctctttagtttaattagatcccgtttgtgaattttggcttttgttgccatactgctttcggtgttttagtcatgaagtctttgcctatgcctgtgtcctgaatggtattgcctaggttttcttctagggtttttatggttttaggtcttacatttaagtcttcaatccatcttgagttaatttttgtataaggcgtaaagaagagaactagtttcagctttgtgcctatggctagccagttttcccaacaccatttattaaataaggaatcctttccccattgcttatttttgtcaggtttgtcaaagatcagatggttgtagatgtgtggtattatttctgagggctctgttctgttccatttgtctgtatatctgttttggtaccagtactatgctattttggttactatagccttgtagtattgtttgaagtcaggtagcatgatacctccagctttgttctttttgcttaggattgtcttggctatgcgggctctttttgattccatatgaaatttaaagcagttttttccaattctgtgaagaaagtcagtgttagcttgatggggatagcattgaatctataaattactttgatcagtatggccattttcatgatattgattcttcctatccatgagcatggaatgtttttccatttgtttgtgtcctctcttatgtccttgagcagtggtttgtaattctccttgaagaggtccttcacatcccttgtaagttggattcctaggtattttattctctttgtagcaattgtgaatgggagttcactcatgatctggctctctgtttgtctgttattggtgtataggaatgcttgtgatttttgcacattgatttattatcctgagagtttgctgaagttgctcatcaggttaaggagattttgggctgagacaatggggttttctaaatatgcaatcatgttatctggaaacagagacaatttgacttcctcttttcctgattgaataccctttatttctttctcttgcctgattgccctagccagaacatccaatattatgttgaataggagtggtaagagagggcatccttgccttctgccagttttcaaagggaatgcttccagtttttgcccattcagtatgacattgcctgtgggtttgtcatagatagctcttattattttgagatacattccatgaatacctagtatattgagaatttttagcatgaagggctgttgaattttgtcaaatgccttttctgcatctatcgagataatcatatattttttgtctttggttctgtttatgtgatggattatatttattgatttgtgtatgttgaactagccttacatcccagggatgaagccaacttgatcgtggtggataagcttttcgatgtgctgctggatttagtttgccagtattttattgaggatttttgcatcaatgttcatcatggatattgacctgaaattttcttcttttgttgtctctctgccaggttttggtatcaggatgatgctggcctcataaaatgagttagggaggattctctctctttctgttgtttggaatagtttcagaaggaatggtaccagctcctatttgtacctcagatagaatttggctgtgaatctgtccggtcctggacattttttggttggtaggctattagttactgcctcagtttcagaaattgttattcatctattcagggatttgacttcttccttgggagagtgtatgtgtccaggaattttttcatttcttctagattttccagtttatttgcgtagaggtgtttatagtattctctgatggtagtttgtatctctctgggatcagtggtgatatcccctttatcatttgtattgtgtctatttgattcttctttcttttcttctttattagtctgtctagtggtctatctatttgttgatctttaaaaaaaaccagctgctggatccattgatttttggaaagatttttgtgtctatctccttcagttctgctctgatcttagttatttaaggattgtaggacaaatgcttgtctatcacaagaaaacatttttattaactgaaaattaactgtagctttaataaatttgaactcggagattttaaaaaaatacttatgcaagtgagtcagattttgtttttaaggggaaggagtgattgtccctcaaaggaaaattattgaccacttctatcacacttttatgtttctgaattgttctttgagagagaatagcttttaaaaacatcaaaaactctagatcttaacaatctaaggacccaaaacctttcagtgtacaattatagtattattgaaaaatagagaagaatgcaaagaggttgcataattgagtataataaagagtaacataatagagagtggagagggagtaagagctgagtatgagcaaaatagaactagtaggtgagaggccatgggcaagtagaaacatgtctagcaataaaagtaaaaagaagaaaaaaccataaaatagaaaacaaaggtaagaggaagactgtttacggtaggaagtttggaaaaaagtgactaagagcaaaaacattgctgacaccagtgcattgcacatgttccagcaaatagtggactgcaattaacaaagctgattctcacctgttcttaggtaagctactgaatgcaacacaaagggttactaagagaggcctcttgaccaaaagtggttccccccactacgtgtgcctggaattcccacaattagactctttctttgagttaaggcttggcattttcagaagtcatctcttaaagggcaatttaaatagactggaagggttaaaatacatagagctttaatatctgctatgaactcttcatagattggtctttcagaatacttttaaatgtgccagctacccaagaggagcaaagcactgcatgatctgaactgtctagcctcatctcttcctaatccctaccttcttattacactctagccatgaatgaacacatcatggttatttgttatcctgtgactttttatgtgcattccttcgctcagtatgccttcctcctacctttctatcaactgcagctcaaaaagcatctcctctgtgaagcctcacttcagttgccttctcttgtacttccatagcaatttacatatgccttactttgagcagtattgttgatgtattataaatagtggtttcagtatttgtgttcctctctagaccacagtttcatatccataaaccaaactatgcttattccataatcacacgaatcacctagtaaggcagtactgtgtttaacatagtttaacctctctgcacctcagttttgtcatttaaaaaccagggataacaacaacgataacaaatagtattattgagagatttaaataaaataatgcatgcaagtgatattaccttagtccattagatatttcaagcctaaatatatggaaaaatacgaaagaaaggagttaggaaatttgaatactatttggggttcctgcactaactcacttttcattcccagcaaattaccaaggcccttgtttttttctatttccaacacgcactgccaagatattgatctcttacattccctatgtaactattgagtttaaatagaaagagtaacctaaaaggagattggagcctctcagagtgagatagctaagaaataccaggtgttgctatggctgagaaattgccagtcatctttatcacagttgttgccaattcttgagggcttacttataatgtgtccatgcactaggccaagtattttgtttatggttctctatttttagtcaattataaaccaaggttggtttgtcactgggcaggcatgcaatgggagtatttaagtacagaattgagtagcctgggagaatatggctgtattctttagtagcatgttttgctttcttgcagaatatattttttcttttcttcctttgtttacagaaatctgaagaaaaccataccttcaactattgtgtgaagtttatgtcatatctagaagctagttcatggaaaaagctacaaaaattgaaacactagctctataaaaatcagccataagtgccttcttactggaatgagattactaaggtataattagtagtaacacatatattagcaattagaaagtcagtagaattgaggcatgaacaaaagaccatctgttatgagagaaatatccaaccctcataatcagtaggtaatagatactctgttcttgaaacataacagttaaaggataacaaaggaatgtcttattgcttgctaaaaaatactcttgggaattccccaaaaagagctacactgtaatagtagaagttctgatttttaaaaattgagctagaaataaatctggcaacaatttttctctaaccttatcctgatgttcagggactccctcaaaagtaattatagaactcaactgttcatttttaactaaagtgatttctggttatgattaaaataaactttgaatttaaaatctctctaactcatatataaaattcatataaaggatatttggtttgcctcctgaatataggaatcataagagaccctggagatcaggggaaaggtcccagattttggagccaaagaaacctgaaacctgagtattaaagttctgccttacccatctcatgtgcaatgtgtggccctaggaactgattgtgtttttgttgttgttgtttttagatggggtttccctgttactcaggctggagtgcagtggctcaaactattgtgctcaggtgattcttctgcctcagcctcctgagcagctagaactgcaggtgtgtgccactacagccagctatttttaaaattttttgtagagattggtgggggggagggtctcaccatgtttcctaggctagtcttgaactcctggcctcaaaagattctttcatctctgcctccaaaagagctaggattataggcgtgtatcactgggcccgacctaggcagtgtcttaacctcgttaaaacttaatttccttctctgtaaaatggaagtaataatagttcctagctcagagtgttattgtaagttttaaaggaaatagtgcagtcaagcatttagcagcttctgctgctgttgttgtgacagacagaattctggacagggtggaccagggatttacattgaatgacagtctgatgtctttatttcatggagacagattggtctagcatctgtaaagtgaggattcataacattagtacttactacataaggctatgaaaatgcaaattgattatatatgtaaaacctgcatagtgcctggcatgtatgtagtaagggctcaatgaatgttagaaactattgttatgttttggcacagtgtctggcacctaggctctcaatatgtgttagctcttattgctatctctgggaatctagtaattatcaggtgacagagatgccccagcattgtctagtgttttgggaaaccccacacttctcatggacttgaacagtaactcagcaaggtggacagaggactgaaaaaataaatgacacctcttatataatgtatattagataagggagaatgaagactttatgctaaattaggtgactaggcatacgtttaaagatattccatccctgctttagcatatccatttattttcacataatttatcatggttatttgaacagtgtcagcaggtttctaagacaaagccacactgcaaaatcagttggcatctggtttctcttcagttctaatctgattaccagatctaacttaaggagatagacttgaattatttccagagaatccatgtaaacattccagaaatcccttgagatgtacttaagtgaaagttctggtttgcatccaattgtaatgcaaggtcagggtctccaacacaaatgtcatttcaatcttttagtgattattctttcagtaggagcatggatattagttctagggtgctgtggctctagggccatctgaagggctgtgtgggtcagggaaaattacactgaggaattgtcctacatatttttatctccatgaaatcaggttaaaagaagaacgaaaagagatcagtgagatggagggaaagcccattcttaggtatgctgctcggagtttatgggtggccgtggggcttatatacatataagctcaagaattatagaccgctctgctgtttgcctcactgggtcacttctcagtccatcagcagtgcaattcttcccaaaacaccagccagcactgacaacatctctgccctgagtaattatttagtgtacaggggaattctcaggatatcgattgtttcaggagactcagatatctatgatgttaacccattttcatttgccataactatgcctactctattaagtttacttgttctttaggtgtttttgattatgactaggattggactgcccaaaacaatacgtgggtatttgcctatgataagctaacttgaaccttcttatttcttccctttctttctgccttcctttttaccccatttattcaaatagtaaataatatttgagcatatgcttaccatatgacagaaaggcagaatatagagctggagatacataatggcaatcaatgcatgcatagcccttgcccttagacaatacatttagggtgtgagcattcacatcaaccatataaattgtaggaattggtaagtgtatggaggtaatgcttaatgtatacttctgaaccctctgtatattgttcttatccttcataagatttatgtcagttctcatttcccatgagaaaaattttaaaaatataaagaaaatatagaattagatgcagcatcccatacattatgtatatacatatatacacacattatatatatctatagataaatttattttttaacatacagatttgaaatatttatagactaagtttactgaaactcttgtaaagctaggcagcctagcacttagaaggatgaggggatgtaagaaatgtgactgtttccaaacaattctcttattctcattttgctctcagagaaaataaagaagaatcagattgtataatttctgaagattctgctattttatttttaagtgcctcttttctaaaggattcacagtcacacgtattaaatgacttaaagacacatccttctctcctctgtctcaatgaatagtttggtcaagaaccagaagaagtttaaaacttaacactctaggttactgaggaagtttgaagagtcttttcttggatatcccaggctccttgactttcagctctgtgatttttcatgggtgctaaccacacagatagttggcatgagactgtcttgttaaataggatgtgagagacattgaaagcttcccccaccagcctcctcagaggtagagatgccctcccctattacagtggctcctttggggcctctggaagactgtatttaaatttcaaatatctgctcttagagggctgcgttacactgttctgtctcatggaggaaatggttagtgggcaagcagattttctcttgtggagaatggctcagaaagggtccaaaacctgtgaaatgccttcaggtggatttctacagtttaagatcggaagattctaaggctgctgaatcttggtacttcttgatagcagctgtgaagcagagatgtatatacatgaaaatgaaaaacataaggcactagatgaaagagaaattggtgtagaaaggagatagaatgttagtgacctaatataacccttccctattttataattttgtcggtctgacactgccttcctgtaaagagctaatcacaatataaggattagcattctcaagttatctgctccacttgactgtgagtcctttgaaagtaggaaccccaattttagttgctttgtatcacttgctcctaggtcttgcctgatatataataaatgttcagcaaatgctgggttaaaaaaaaaaggaatgtcatttcaggggtctgaaactttcgaatcttctctcacattctttattttggccaaaggtcttatcagatgtcttccctgatcaccctatctaaaattacaccatcgtgctccagcctcttgttttattttgctatctagcagttataactatctgaagttatactatatgattaattcttattctgtttattatctgtcttctctgatataatctaatactcttaatggcagaaaccttgtgtacgtgtgtactgctgcatctccagtacctagaacagtgtccaacacaaaatagcatctcaaaaaatatttttgaagagtgtgccaagagcttgaggatgttcttccaagtggttttgctgcattaatttttgttatatttggattccaaataatatcagatatgtttggaagataatattaaacatagatgcttagggaaagaaaaatctcttttaattctaggtttaattgctccaaatagtcaataaagtggtaagaagaataaaaaagtagaatagacatttaataagaaagccttttggcaacataagtatattatattttactcttatcggggcaggtggtttttgtaagtacttgtttatttcaaaagggtggtattatttgaattaattcactagttaaaattctcagagcctaaaagtgattttttccatttcaattatctttattttctaaaatattttcaaagacagtggcttcatgctgaggatagaggatgtagttgaagaactgtatgtagctcatgattaactgaaactctgtgaaatgagcctcttcatgtatttggcaattattatacttctttaaaatatgattcaaaagatagaaataatattttacaacataaagatcatttgtcttgttttattgtatgttctgcatctaacagttcacttaacgagaatagtcccttgtgtcaaattcaaattctcatttggcacttttcctatacaaattgctttctgcccatcatacaattttgctttgaagcattctggcaatgggtgatatagggagacttagaaccaaattctgcttttaatatggaactggaaacagtcctttcatcttccaggtgatctttatatcatatgtatacaacactttctttttcaaaagtctaccctctggattcagctatgataactatcgagcacagataattaagaacttaggctcttacaatgtttaaagtagcccaagagagcatagaagttctgttcttagaggttcagaaacaggtgaggactgatggtaacaaaggttgtgaaaattcgacattgctggttttgttgtttagggcaagtggcagtctctgaaatatttactggttgagcagagaatatttgttatacttctccaatcaaaagagaaaagaggaattgttaccaataactgaaagcttttacaactctctaacttccttataaggtatagcttctgggagatgtgttgggcagacttcagtaaaagaagatagcatgtttatgttgacagagatgggtcagttacagatttgtccagggattctcattagttgttatctttctgttaacttctttccaacttctgatgtatgagtacagttgttacagtgtttttcacaattttcttttgttttcttgattaattttttttttttggatagaaatacattttctatgcctacttatagcaagtcaggctttgtctttctgaaccattttctctgtggtgacatttggaaatgaacttacaacgttttccactgtgtattgtagggggattattatagacaaaaactcttttaagatacctttttttgttcctgcttagaactattatcagtttcacaaactctttagtcttcttgtcttaggtaggatcaaggaagaaaagagggaagtttcaaaatactttttctagttctccctgcttattatcacaggagaaagctaaaactttgttacaagtaaatcctttaatataattttatttgaacacttatagcactacttattgggcaaccatgtggttagaaccagcttttttgttttttgtaaaacagaattgaagttgaaacaattacttctgccctctaaataattagactgctatactctcctcaaagtataagctgattagactttatctttgacttcagtgtgtttctggcctgccgctaaatgtcaaattaatcttaaacgcccataggattaatgttgaaaattgttacacattttttattcattcatcaatattgcaatatactccctttttcctctttttgggtatggggctgtaaagtttatttgatttcttaaagcacaaagaacctcattgatctcaacataaaacttattatgttactgcaaaataaacatgaaaataacattgaaaaactgtgttcatatattatttataagaaaaagccatttgtaaatgcctgtcagtgtttcttgtagtgcttccctttttaaggaatccattaaccatgatattgttttatatttgacaaaaactattttatggaagaaaagagtgttgtttaagtaactgcagctgtttctgcagtccaggtgggaagaataaagacatctggtttgtttgaggaaacacattaatgagtctttcagttatgaaagaaaggccctgagcatagggtagaggttgaaataaatgggaactaattgattttcccatgaagataacaacattttgaattttctaccagacagcaaaaaagacaagagttgggaccaggaatctgcggaaaagcattgatgggggaatgggctccagaaacatgatagctggccagcactggaatacaaccatgagaagaactgaagcccgatagtcaatgtctactagttgttacctgctctgtgcagcaatcttcctcagttaggctaacctttagtgaaagcctacaggtttgggtaccctttatgtgaaatgcttgggaccagaagtgttttgaattttggattttttaaaattttggaatatttgcattatatttactggttgaatccctaatctgaaaacctgaattctgaaatgctctaatgagcatttcctttgagcatcatgcaggtgctcaaaagtttcagattttggaagaagtaaaattatactgctttgcagataatataatcttatatttgaaaaaaattaaagactccaccaaaaaactattagaactgataaattcagtaaagctgcaggatacaaaatcaatattttaaaaaatcagtaacatttctatatgccaatattgaacaatctgtaaaacaaaaaagtaattctgtttacaatagccacagataaaattaaatacctaggaattaaccaaagaaatgaaagatctccataatgaaaactgtaaaacactgatgaaagaaattgaagaggacaccaaaaaatggaaagatattccatgttcatggattagaagaatcaatattgttaaaatgtttatactacccaaagcaatatacagattaaatgcaacccctataaaaataccagtgacattcttcacagaaatagaaaaaaaatcctaaaatttatatggaaccacaaaagactaagaatatcccaaagctattctaatggaagaatcacattatctgacttcaaattatataaccaagcaatagtaaccaaaacatcatggtaccggcataaacacagatacatagaataatgaaatagaatagagaacccaaaacaaaatccacatacctacagtgaactcattttcgacaaagatgccaaaagcatacactggggaaaagacagtctcttcaacaaatggtgctgggaagacgatatccatatgcagaagagagaaactaggcccctgtctctcaccatatacaaaaatcaaatcaaaatggaataaagacttaaatctaagaccacaaactatgaaactgatacaagaaaacattggagaaaatctccaggaccttggtcagggcaaaaatttcttgagcaatacctgacaagtaaatgcaaccaaagcaaaaatggacaaataggatcacatcaagttaaaaagcttctgcacactaaaggaaacaatcgtcaaagtgaagagacaacccacagaatgggagaaaataatttaaaactacccatctgagaaggattaataaccacaatataaaaggatttcaaacaactctatagggaaaaaatctaacaatatgagctaataaaaaataggcaaatgatttgaatagacatttcccaaaagaagacatacaaatgagaaacaggcatatgaaaaggtgctcaacatcattgatcatcagagaaatgcaaatcaaaactacaatgagacatcatctcaccccagttagaatggcttatatccaaaatacatgaaataacaaatgctggtgaggatgtggagaaaagggaacccttgtatactgctggtgggaatgtatattagtataaccactatgaagaacagttgggaagttcctcaaaaaactaaaaattgagctaccatatgatccagcaatctcactgctgggcacatacccaaaagaaaggaaatcagtatattgaagagatatctgcacacctgtgtttgttgcagcactgcttacaatagctaagatttggaaacaacttaagtgtccatcagcaggtgaatggataaagaaaatgtggcacatatacacaatagagcactattcagccatcaaaaagaatgagatccagtcatttgcagcaacatggatggaactggaggacattatgttaagtaaaataagccaggcacagaaagacaaatatcacgtgttctcacctatgggatctaaaaatgaaaacaactgaactcatggacatagagagtagaagtacggttaccagagactgggaagggtggtggagagctggctggaagctggggatggttaatgggtacaaaaaatagttagaaagaatgaataagacctactatttgatagcacaacagagtgactatagtcaataataacttaattgtacatataaaaataactacaagactgtaattagatttatttgtaatataaaagattaatgcttgatgggatagatatcctattctccatgatgtgcttatttcatagtacatgcctgtatcaaaacatctcatgtatcccgtaagtatatacacctactatgtacccaatcaaattgaaaattaaatttttttaaaagttttggattttggagcatttcagattttgcatttttgtattaggaacattcaacctgtacatgcaaaagcagtgtgtgagtagcaccatgaggagtcatgcatagtgggttgtattaacatctggagtgagtcagtgtagagaaagaacttatcagtaataatgatgccaagattgctgaagttgatcaaggattgactgggaagctagaattcagaaataaaggtaatgaaaatgaccaagaaatataagggcatatcaaagaaagtgctggattacctgcaattacataagaacaaggacttgagttcttttctttagatattaaaagaaagtataagtccagaacgttagagaagtaggagacattcaatttatatatatgaggggttacgagcataaatacatgctcctggagcatggtgaatttataaatacttatgtatttagattttatatatttttcattcttgtacttggtcagttgtgccgtctttaaataaagctgttcaagatctgtttgcagtacctttgtattttgcttgagtgcaccaatttttatcttagatttatgaagtctaattatcattcaacgtctttgttcaagccctagacacatttttccttgttttctcatatctcaattttcaagttaatgattataatgacatcatgattttatgttaagagtcttttttttttagttgaggtctttttattttattttttattttttatttatttatttttattttattattattatactttaagttttagggtacatgtgcacaatgtgcaggtttgttacatatgtatacatgtgccatgttggtgtgctgcacccattaactcgtcatttagcattaggtatatctccaaatgctatccctcccccctccccccaccccacaacagtccccagagtgtgatgttccccttcttgtgtccatgtgttctcattcttcaattcccacctatgagtgagaacatccagtgtttggttttttgtccttgtgatagtttgctgagaatgatggtttccagtttcatccatgtccctacaaaggacatgaactcatcattttttatggctgcatagtattccatggtgtatatatgccacattttcttaatcctgtctatcattgttggacatttgggttggttccaagtctttgctattgtgaatagtgccgcaataaacatacgtgtgcatgtatctttatagcagcatgatttataatcctttgggtatatacccagtaatgggctggctgtgtcaaatggtatttctagttctagatccctgaggaattgccacactgacttccacaatggttgaactagtttacagccccaccaacagtgtaaaagtgttcctatttctccacatcctctccagaacctgttgtttcctgactttttaatgatcgccattccaactggtgtgagatggtatctcattgtggttttgatttgcatttctctgatggtcagtgatgatgagcattttttcatgtgttttttgggggcataaatgtcttcttttgagaagtgtctgttcatatccttcgcccactttttgatgggtttgtttttttcttgtaaatttgttgttcattgtagattctagatattggccctttgacagatgagtaggttgcgaaaattttctcccatcctgtaagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtttaaagaagggatccagtttcagctttctatatatggctagccagttatcccagcaccatttattaaatagggaattatttccccatttcttgtttttgtcaggtttgtcaaagatcagatggttgtagatatgcaccattatttctgagggctctgttctgttccattgatctatatctctgttttggtaccagtaccatgcttttttggttactgtagccttgtagtgtagtttgaagtcaggtagagtgatgcctccggctttgttcttttggcataggattgacttggaaatgtgggctcttttttggttccatatgaactttatagttttttccaattctgtgaagaaagtcattggtagcttgatagggatggcattgaatctataaattaccttgggcagtatggcaattttcacgatattgattcttcctacccatgagcgtggaatgttcttccatttgtttgtatcctcttttatttcactgagcagtggtttgtagttctccttgaagaggtccttcacatcccttgtaagttggattcctaggtattttattctctttgaagcaattgtgaaagggagttcactcatgatttggctctctgtttgtctgttattggtgtataagaatgcttgtgatttttgcacattgattttatatactgagactttgctgaatttgcttatcagcttgaggagattttgggctgagacgatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttactattttgagatatgttccatcaatacctaatttattgagagtttttagcatgaagggttgttgaattttgtcaaaggccttttctgcatctattgagataatcatgtggtttttgtctttggttatctttatatgctggattacatttattgatttgtgtatgttgaaccaaccttgcatcccagggatgaagcccacttgagcatggtgtataagctttttgatgtgctgctggattcggattgccagtattttattgaggatttttgcatcaatgtttatcaatgatattggtctaaaattctcttttttggttgtgtctctgccaggctttggtatcaggatgatgctgacctcataaaatgagtaagggaggattccctctttttcaattgattggaatagtttcagaaggaaactcttctggtagaattgggctttgaatccatctggtcctggactttttttggttggtaagctattgattattgccacaatttcggagcctgttattggtctcttcagagattcaacttcttcctggtttagacttgggagggtgtatgtgtcgaggaatttatccatttcttcgagattttctagtttatttgcgtagaggtgtttgtagtattctctgatggtagtttgtatttctgtgggatcgctggtgatatcccctttatcattttttattgcatctgtttgattcttctctcttttcttctttgttagtcttgctagcggtctatcaattttgttgatcttttcaaaaaaccagcccctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatttccccgtattcattccggagcaggttgttcactttccatgtagttgagcagttttgagtaagtttcttaatcctgagttctagtttaattgcactgtggtctgagagacgttttgttataatttctgttcttttacatttgctgaggagagctttacttccaactatgtgttcaattttggaataggtgtggtgtggtgctgaaaataatgtatattctgttgatttggggtggagagttctgtagatatctattaggttcgcttggtacagagatgagttcagttcctgggtatccttgttaactttctgtctcgttgatctgtctaatgttgacagtggggtgttaaagtctcccattattattgtgtgggagtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtgttttatcagagactaggattgcaacccctgccttttttgttttccatttgcttggtagatcttcctctatccctttattttgtggctatgtgtgtctctgcacgtgagatgggtttcctgaatacagcatactgatggggcttgactctttatccaatttgccagtctgtgtctcttaattggagcatttagcccatttacctttaaagttaatattattatgtgtgaatttgatcctgtcattatgacgttagctggttattttgttcgttagttgatgcagtttcttcctagccttgatggtctttacattttggcatgtttttgcagtggctggtaccggttgttcctttccatgtttattgcttccttcaggagctcttttagggcaggcctggtggtgacaaaatctctcagcatttgcttctctgtaaagtattttatttttccttcacttatgaagcttagtttggctggatatgaaattctgggttgaaaattcttttctttaagaatgttgaatattggcccccactctcttctggcttgtagagtttctgcagtgcgatcagccgttagtctgattggcttccctttgtgtgtaacccaatctttctctctggctgcccttaacattttttccttcatttcaactttggtgaatctgacaattatatgtcttggagttgctcttctcgaggagtatgtttgtggcgttctctgtatttcctgaatctgaatgttgacctgccttgctagattggggaagttctcctggattatatcctgcagagtgttttccaacttggttccattctccccatcactttcaggtacaccaatcagacatagatttggtcttttcacatagtcccatatttcttggaggctttgttcatttctttttattcttttttctctaaacttcccttctcacttcatttcattcatttcatgttccatcacagataccctttcttccagttgattgcaatggctcctgaggcttctgcattcttcacgtagttctggagccttggctttcagctccatcagttcctttaaggacttctctgcattggttattgtaggtatccattcatctaattttttttcaaagtttttaacttctttgccattggtttgaatttcctcctgtagcttggagtagtttgatcatctgaagccttctcctctcaactcgtcaaagtcattctccatccagctttgttctgttgctggtgaggagctgcgttcctttggaggaggagaggtgctctgctttctagagtttccagattttctgctctgttttttccccatctttgtggttttacctacttttggtctttgatgatggtgatgtacagatgggtttttggtgtggatgtcctttctgtttgttagttttccttcttacagacaggaccctcagctgcaggtctgttggagtttgctagaggtccactccagaccctgtttgcctgggtatcagcagcggtggctgcagaacagcggtggctgtagaacagcggatattggtgaactgcaaatgctgctgcctgattgttcctctggaggttttgtctcagaggagtacccggtcatgtgaggtgtcagtctgcccctactggggggtgcctcccagttaggctactctggggtcagggacccacttgaggaggcagtctgcctgttctcagatctccagctgcatgctgggagaaccactactctcttcaaagctgtcagacagggacatttaagtctgcagaggttactgctgtctttttgtttgtctgtgccctgcccccagtggtggagcctacagaatcaggaaggcctccttgagctgtggtgggctccacccagttcgagcttcccagctgctttgtttacctaatcaagcctgggcaatgcgggcgcccctcccccagcctggctgccaccttgcagtttgatctcagactgctgtgctagcaatcagcgagacactgtgggcatagggaccctccaagccaggtgcaggatataatctcctggtgtgccgtttttttaagcccgttggaaaagtgaagtattagggtgggagtgacccaattttccaggtgccgtctgtcacccctttctttgactaggaaagggaactccctgaccccttgcacttcccgagtgaggcaatgccttatcctgcttcggctcacgcacggtgcactgcacccactgtcctgcacccactttctggcactccctagtgagatgaacctggtacctcagatggaaatgcaaaaatcacctgtctgctgtgtcactcacgctaggagctgtagactggagctgttcctattcggccatcttggctccaccctcttatgttaagtgtcttattaaaaactacattcaccagtgtgttctgtgacacatctaattattcacataaagggaatcactttcaaaaaattggggaaatactgtaagccagagtctacagttcacattaagaaactaatagtctctgagaggtcccacaggggaataaaaaaaattaacatggtttaatgtagctttatttgactatggaactcactttttacctaatacctatttatatcccatggaactaatgttcattaaaacaaataatccaaagtgtttttgcattatctcacttattctcacaaataaaatattaaaaaggatttactggtcaaaggagaaaaaatcacataactccaattacatttaaagcatatttatatttaaagagattacactaaaagcaatgtgtaccttttattccatgagaaattaatttaatctgactgcttgcatcttattctccacttaagtttgctgagcatcttttctttattctccttagtacagtgttaaatatctacagtcatccactgaacaaatattccacagcattgcttttttttgtataagagtcttttatgtttttaatccagtatctcccatagtctacatggttccctctaccaaccatggcctctatggaagatcatgaggtatcagtgtcattcttttggtaatgagacaaaatcaaaagtaactcctcctcccaaatttgaccaatgtctacaagaaagacactttacctgaatttatcccttcttaattctaaatttctggtcacctcattgaccctttcccactcccagcacccaagaacacagacccctgaaacaccctgggagcatagacaatcatggatccaggccatatcctgtcattaagattttagaaatgagaacacagaaagtttaatttatttaatcaagatcatacagctagttaatagcaatgtagaaacagtaatctaaatttttggccacatcttggcttctctggctcatggatcaatctctggtattttagagtttccaaggccaacgactacctcttacaacatacacagacacttacatatatacagaagccaaacatataccacatttggaaaaaggcatcagtgagatatcttacaggaccatttactaaaataaaataaaaattccagaaatatttttcttatgaaaattcaatgacagtttttgtttccacataaggtttttagagaagacttgcttgtctgtcctgcacctgctctaatgtcatggaatgcctgaaagagtctcttggtgtcaataacccacatgttcaagaattccccaaatttcacgaacgttacaaactataatacttttatggcattgaatttaaactctcaacagtgatgcacaaaaattagccatgacagtgcttttggagatattgcagcaaaacatgataataatatacaatacaaagggataaaaaccaaagctcatagatgtctacataatgagatcttctattcagaattactatatatttatcttcaccatattgacttgtctagagaaagtggagaaactctatcttagctgacaagttaactccccatatgcttccaagaaacacggaaatctagaagatgaagtcattcttctgtggatattaacatgcacaattttgcagacataaattttttgagaatctcttagaaaacaaagggagtaggaaaaattagtaagaggatcaaataaaagtgttgtctaagagggctgagtggaaacttggtgggatgatgctcattatcttgatgtcagaattggttgttgaatggaaagataaaggagaaatgatggagaagatggtgatattacctgacagaaggctacaggaaaattgaggagtagtgtgaaagtgatttttttgggaaaactgaacaatatgtattgttgggggaaaatgggcctcaacagagtgaagtattcttgtcacggaaaagatagaaaaagggttgggtagttacagggggacaacaatgccagactggggagtgtggactggatacaagagaatgagggagctcaggatgagcagaagggcggggaagcaatattcattaagcaccttctatgtgccagtcaataggccaggcttcaaattattaccttgctgaaatcttcacagcagccctctaataggtatttatccctgattccatatccatgctctgcttcccctcctattacaatggctgaagaattcaaacccctttcaaaggctagcactgtcatttgtcctctagatcccatcccctccatttttctttttattgaaacattctcaatggtattcaaacatactctgctctctcttctattaaataggcaaatgcaactcatcaagctctttttctcccttgctactgccccatttctctacttcctttcatggcagaacttctcgaaagagtttttcacaatcacttcatttccacacctctaactgacttttgaacacaactagaggaggagtaggaggggacactcattccaaagtgtccaattaagcccaatcctttaaaagtattatgttgtcatgatggctgttaagagcatggtgaaaagatattagaataagatgtggggaatcatgaccgtgagacagagaaagtagtcaaaggttttccaccttttaaaaatgtacttgatcccccactaattgcacaaactctgcccctcagacctagatccacccacagcatcaggcccacacttctggcttcaatccactctattctgtcctctatccactccaataaactgaaacagttcctattagagttcaccaatgaccatcattttgcaaaatccaatggtaacttccctgtcctctttatactcaacctctcagtagcatctgatcctgttaaccatgtcttcttgtaccaccatttctgctggattgctggatatcatactctcttgtttttctcctagtttactgtctagtcattcccactttcctttatgtgttcctctttctctgacttttaaatcttgaactgcaggccactggggcagaggaagcatgcacactagtgcatggtgtttggtatctcatcataccactttggtggaagagcagtggctgtagaatctgtttctttttttaactttgattttagattaaggagtatatgtgcaggtttgctatatagatgaattgcatgtctcggaggttttggggtacagattatttcatcgcctatgtaataagcataataccctatagattattttttgatcctcaccttcttcccagccttcatcctcaagtaagccctggtgtctgctgcagaacctctttctaggtatatgattagtgactgaacctccagtgccctgtctcctggtgctagaggattatttatttatatattgcattaacttctagttacttctttgcacctctgccctctttctgcattttgcatccctacaggactatgccctttggaatttatcctcctgaattcactttttacttaactaaagtagtatattagagaggacagacaggtagtttcaataagggaatatcaatgcctataagctctgttgtcatatcaaggaaaaatgacatatttcagtagaattaggaaatggactttctcttgtttaagggctgtgaggtggtaatttataagggaagattaaaagaacaaagtacatataacttggcttagagggaggtctaaagatctgcaaatatctctaactgcacaaacattagcaagagaaaatattgatttagcttagtacaagctacaaggtgctgtaactaagaataatgaagttaaattttaagaacacagagagaatgccatgaaaatattagaataaaaatagagtgagctatggaatattctgcaaagggaagcttttctaataaagggaaaacagctctgtgagatgaaacaaatcgttgttatgcaagatcagtgacatcctcaactccaagtctgcacaaatgtaagaacactagttttctatcttgtgttacattaattgggatgacagttcctatgcttctcaacatacctataaataggttctgggtcaacttctgcctgtaggtattccttgatcttttaaagacaatgattacccacttaattttttcacttcagagaacatacagaaaaagagaggtccttcacgtcccttgtaaggtggattcctaggtattttattctctttgaagcaattgtgaatgggagttcactcatgatttggatctctatctgttatcggtgtataagaatgcttgtgattttttgtacactgactttgtatcctgagactttgctgaagttgcttatcagcttaaggagattttgggctgagacgatggggttttccagatatacaatcatgtcatctgcaaacagggacaatttgacttccttttttcctaattgagtaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcagtacctaatttcttgagagtttttagcatgaagggttgttgaattttgtcaaaggccttttctgcatctattgagataatcatgtggtttttgtctttggttctgtttatatgctggattatatttatcgatttgcgtatattgaaccagccttgcatcccagggatgaagcccacttgatcatggtggataagctttttgatgtgctgctggattcggattgccagtattttactgaggatttttgcatcaatgttcatgaaggatattggtctaaaattctcttttttagttgtgtctctgccaggctttggtatgaggatgatgctggcctcatataatgagttatggaggattccctctttttctattgattggaatagtttcagaaggaatggtaccagttcctccttgtatctctggtagaatttggctgtgaatccatctggtcctggactccttttggttggtaagctattgattattgccacaatttcagatcctgttattggtctattcagagattcaacttcttcctggtttagtcctgggagagtgtatgtgtcaaggaatttatccatttcttctagattttctagtttatttgcgtagaggtgtttatagtattctctgatggtagtttgtatttctgtgggatcagtggtgatatcccctttatcattttttattgtgtctatttgattcttcttttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccaggtagttgagcagttttgagtgagtttcttaatcctaagttctagtttgattgcactgtggtctgagagatagtttgttataatttctgttcttttacatttgctgaggagagctttacttccaactatgtgttcaattttggaataggtgtggtgtggtgctgaaaataatgtatattctgttgatttggggtggagagttctgtagatgtctattaggtctgtttggtgcagagctgagttcgattcctgggtatccttgttgactttctgtctcattgatctgtctaacgttgacagtggggtgttaaagtctcccattattcatgtgtgggagtctaccaagggacgtgaaggacctcttcaaggagaactacaaaccactgctcaacgaaataaaagaggatacaaacaaatggaagaacattccatgctcatggctaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaagagcatggtactggtaccaaaacagagatgtagatcaatggaacagaagagagccctcagaaataacgccgcatatctacaattatctgatctttgacaaacctgagagaagcaagaaatggggaaaggattccctatttaataaatggtgctgggaaaactggctagccatatgtagaaagctgaaactggatcccttccttacaccttatataaaaatcaattcaagatggattaaagacttacatgttagacctaaaaccataaaaaccctagaagaaaacctaggcaataccattcaggacataggcattggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactcaaacaaatttacaagaaagaaacaaacaaccccatcaacaagtgggcgaaggatatgaacagacacttctcaaaagaagacatttatgcagccaaaagacacatgaaaaaatgctcatcaccactggccatcagagaaatgcaaatcaaaaccacaatgagataccacctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagagtggattaagaaaatgtggcacatatacaccatggaatactatgcagccataaaaaaggatgagttcatgtcctttgtagggacatggatgaaattggaaatcatcattctcagtaaactatcgcaagaacaaaaaaacaaacaccgcatattctcactcataggtgggaattgaacaatgagaacacatggacacaggaaggggaacatcacactctggggactgttgtggggtggggggaggggggagggagagcattgggagatatacctaatgctagatgacgagttagtgggttcagcgcaccaacatgtcacatgtatacatatgtaactaacctgcacattgtgcacatgtaccctaaaacttaaagtataataataatataaaaaaagaaaaagagagtatttgtgtggcacactggatatcacggcagactagccaggggctctggctacatctgaccctgctaaaccactccaaggactgaggggatagatatgttggctcacctggaagcaaatcttggcatactattgttcttcaacacactttttaggaagcactgtgcttttcatttagacttgggaggcagccagtctccaacccccaactcccaatcccttcttctattcctcctgtttcactaccttcttatggctctactgaaataagtcccttccgtctttctctttcctcatccccttctcaaagcagaaaaaaaaaaaaaaaacatgttttgctttgacataataatccaaacaatttctcccaagatccttacaatgtggaaagagagccatagtcagtatatcctgaggaggtaggtaggcatttttctagttctctaggacacatctagcttaccactactgtttacaagtctgagttgaagggaggcaatggtcaattgttacaaacttcataaactgaccaatgaatatttgcctggtccatatttaggttgttcttttcatcatgaaaagttccccagtttactaaccactagcaaaggtttgtctcttaaaagttgctaagtctaaataataacaacaaactaaaattctagaattattgagtctgattttatgagtatcaattacagtattttaattatatattcctgatcatacttaaggctgatgactatttaaaatttggcaaaaagaaaacacaacagtcttagagtactaagccaagttgtaatgctcaggccactaaatgcattaaaccttgtactcagaacacttgtataaagcctggaacacttatcagaatgtcaaaacaatcaggaagataacagtctttgcatctgagagattcagtgggataagtggaaagagcacaggaccaagacttaggagttctgggttctctcaagtcttgttcctgtcatttgcaaacattgtgcacttaggcctaccagatcctcccaagtgttaatagttttgtatttaaagacgaatgtggttagatatggtgaactgaacataggcctgaatctctactccatccctaaaccccactgaaatgacattaaaggaataaaaagggtataactcattaaaaaaaagactgagtaggaaatgacatcagacagggggtggtaacaaaaatttggaagctggaaagcagatggacaagtgttacactgactcagctgaccttgggaaagctaagcctaagcctgaagaggagggggatgcaaaggcaagaagcaagcccatttccaccatagaaccccagaaagtttcaaaagttagaaatatcaaataaattttcaggcagggaagtaggttgagactgaaaacaagtgaccttatgaaatgtctttaaagcaagtagttagacccctagatatctttcccacactgtactcccagataattgaatcctccactcctattctgattggagacagaaggtttactctttggggaggcttaactactcaggctctaggcttaggaacagtaggcccagctgaggacagcaaagatgacttgtactgaaaacagggaaaataagggaaagtctacatagtcaacaatgaacgtcccaatgccctttttccatactcagtttccagaaacaggtagctaaacttctaccatggtatagattggagccagaggacagataactctaagagcaatacttccaagtggaacatgagcctgatagcatgctgacaacttgaatgtgtagttagaggaggttttcaattattcagagaatttggtgatgaattaattactggtatatagaaagctaagcaactgaaaaaaatgagccaattaatgagctccagaaaaattaaaatgtcatacaagcaaagaaaggtaatcataatagagtgagtagctcagctataaataatgtgacataatcaacaatattgtaaacactgaactgatttaaccaactatggtgtatgtgctgggtagaaggggccttttaggaaagtggaattctcttcttataataggaagtcagcaggtactacctaatattgaattttaaaaaataacagtgtaagtgtataatttagatgtgtatgtggaggcaaacatcagaagaaaaagagcagagagttggatgttgtttactttgggagaaaatatatcagcagttagacagaacagagcaggggactgctctttgcattacaagcctagtagtactgcttgacttttattgtgtttatttatttttaagtgacaggtctcactctgttactcaggttggagtgcagtggtgtgatcatagctcactgcagccttgaactcctgggcttatgcaatcttcccacctcagcctcctgagtagctggaattacaggcacatgccaccagacttggctaactttttaaaatttttattttatgtatttcacagagatggtgtcttgctatgctgcccaggctagtcttgaactcctggcctcaagaaatcctcctgcctcagcctcccaaagtgctgagattacaggtgtgagctaccacacctggcactgcttgactttttaaagtatgtacatttattacttagattaaaaaattaatcttaaaaaattattaaatttggctaaataacctttggtctttcctattttgaaaatgtaatgactatgcaaaacattaatagtttcttctgagagcttgaacctcacactctttcatgaaattagatattacttaggaagagaaaacattaagacttccagatcctcatagacttcctagtacatgaagtgctcaagctactcatgtgggttgtttaaactgcagtttaaatttagtttggtgcatttactttctgccacatatatatgactgtttctactttggatattgcatgacatccacatatatgctaatcctgaaaaatagatggaaagcaaatatggcttgaagtaaccaggaattgaaaaccaccatgaatagtgtcagcctgacccaggagagaactttttatgtcccatgaatgactcttaccctatctttcaatagtggctgcactctgctttctgatcagaatttctctctggattgaaacttttatttccttctctttgcttgattcttagcatttactgaaaaacatcagttaccagtgcttacagacatcactagcagtaattatcaaattccagactaaacctaccttttgcttcctagtgaatctaagagctgattcttctctctcccattcctctttgtccagtccctgcattatatccagtgcaatgcatttaaaaaataaactacacttgacttcctaagaaccttggctataattttaaataaaagaggttggtgaccatcagcattatgtgtaagtcctgtttactggtaggtttgagcacagtgtccattcttgtattcttactaattgctattctattagacaccattcgtttttcattgtcctttctctacatcgcctactttacctacataagcactaacctttttttttttttttgggggggtgctagacctagtaaaagggccaacacaagcaatttgtctcaggcatttctctatctcccttgttctgccgccttcctcccatttggcagatagaacctttcacatgattttaaaccccattctgcccgctcccttcactcctgaatatctagaaattccagtaaaattccttccacatacaagaaagcatcccatatccacacctatctcaccctcccttgcctaacagaacttaactccctggatttccattcagcttgagctacgttctttctcatcacatgcagggagttgcatataccccttacatagagagttcttttatttttgaatgtagacttaatttaaatatttgaatttggcttaaaagatgatgcatatctagtagacaccattaaatattattccaaaaagcatcacagctttagcaactcatatttccttcaggctttttctttcagattaattcaaactattaattttgaacctctatgtatgctcggtatgccattttactctgtgtaaaattggcatgctgttttagccaattaaaacggaaaatatttctgtttggttttaattgatttatctatttattcacttactattattttggcaagaaagggagttcacttccctgaactatttcctttggattgagaattcttgatgttaggttgagtgttaatggttttcagtccagctgttaatgatgcaggattcctatgctctagggagattttagaaggaattaagtgtgaatacctcctcacctgcttgtcttctattctaacaagagcttttgctcattaaaaagtgcctgctctagcttaattcttctcagagtgaacacttcaggattatgcaagcaggctaggtagtctcctctgattcaatattcatacctttgaaaagagatataatgtgatgaaaaatagagatgctaactgaagaacaactattatttgctattaccaagaaaaactggatgacattaaagaaaatcccagattaaccatgtgaaaaaacttaatctgggaaaagaaactccttctgggagtcagtagattgagggaaaagaagagagatagaaagaaatggaaggtatagaacaaacccaatgaaagcatggtgactcaacagcctgaagtatctgttttagaaacgacttcccagaccaccactgagaccagtgcgaatgcagaagtgagcaagtaaggaagcagctctgtaaaggaagaaggaatagagatcacatcgcagcaggagtgtccattgtgacagtctaggtaaaagagagagaggaaccacagctgtgaggggacaagttggttcctcaaaagatattaatgaggttttcatgacatgtgtcaggatgcaaatgacaggggaagagtccacttaacaatggagttgtcaaagatgtaaaaatttgcagcactacttcaatattatttcacttacttaatgtattttcatgcttaatgaactaaatcactggactgatttgtttagggcagcactgtccaacagaaatataatgtgcactacatatgtaattttaaaatttctggtaaccaaactaaaaaatataaaataaaacaagtaaaatgaaatttagtaatttaacacaatatagtaaaaataaccattttaccaactaatcaatgtaaaaaatcattgatgggatattgcacattttttttcatgctgatacttcaagacctagtgtatattttataattacagcatatttcaatttggactagtcctatttcatgtgctcaatagtcacacgtggccagtagctgccatagtggacagtgtacatttagaggaactcatttttgcatcactacctatgaagtagtcttgaaaacaaaacaaacaggatatgattaagccactatatctgaactgtccaacaccgtcaacactagcaacatgtagaaatttaaattaattaaaactaaaaatccaatccctcagttgcactaaccccatttccacttctcaataaccacatgtggctagtggctcctctgttaggcaccacagatttacagacttaatgcctttatcttccaaactgaaaattagagaacaatgtctaaatcactggcaatttgtatcatccttgatgaaaacaaacatttcttctttttcatttcattccaaaatccccttttgccctgtcaacttgttcccacctatcccctcaataaaaccttaccatggtcttgcctgcaggatgcaaaattgtttgagagagtactgaaaattcagtcatgagggtagcatttcttactacttatggtttttttttttttcaagtttcatagagacctgtggcatcttgtgtttagaatatatagcaaacctggtaaagagtggtgaggagtggatttctgaaaatgctgacatatctttgaaaatattataatcttagctggcactatgacaattgtagaatgtatggtttgaaaattaaaaagaagagaaatggaaacatatagcaacattcgtttttaccccttcttcatgttaggcagattttctttttcttgtgggtgctctgggcattgttctaacttggtatttgcaagtcaatggcaaggcctgttcagtgctgagggaattacatagtcatagacaattagtcttttaaaaggtctgctgcttggaaatttgccactaaactcagtatagcctcagcacataatgtaaattcttaatgattataacttttctaaattcagcccttaacaaatctcataatagtgttttgaaacttttaaatcaaacataacccaattaggttggtatttgattaaactgaactgccacttcactgaagtgtttaaataaatcaacattaatatgcttttattatagtaaataaagttacttctatgtagttgaaatgtcaatactcacacatagctcttgaaaattaagtactccttgcactttgaataatgaatccagtattaattggggggaaactattgatttctttttataggcctgtggaagtactttgccccaaaactctacaagttcttaattaaaaaaaaatagtaaactaaatatctgttaaattctgaaactactgtcagagttgtccttatagtggttctgattcatggccttttctccctaaaaatgcaacacagactgatccttcaaataataattataaagaatctttttcattctaattgaataaaattgttagaagattcttggatgctttgcttcccacaaaatacttgcactgtgtgtccaataatagattttctctagcagatagtcattatcaaaggttaactagcatcaagtggtagaaaaaatcctgtttctgtccataggtgcagcatggtgaattccaatatctcatctaaggagtaaaaagtatgctttttggaagtaggactcagtacagctttccatttgtcatttctattgctattctacaggtagttgctataagatgatgctacatttttttatggcattcgcagatttacatttcattgatattctatctttatgtatactttagcagtctatttgatttttgactggttgtctgaatcctctgtaggatgagtctcaaagtagcctaaattcttatttaagtactctctaacagtgtgttccttacttttaaaaagttaagcctaaaagaagtctgccttggaactcttgtttactggacatagatgtttacacatttttgttacaagatctttggggtgtcgattttcctcccaaaacctctgtggccagtgcacctttgcctgagtttttgtcctgtgtcccaggtccaggaagaatgaggtacacagacaagtaaagggtaaagaagtcaaagaagagctttactgttagaacagctcagaggagacctgcagtacctagatcctctgaaggcaggccatcccctgagtgttcagctctcagcagagaggaggccctggagagggtggcttttctctgcaggcagattgttcagacatctctgcaggtctctgaagctctcagcagagagggtagctcctttgtgcagctggtcatccagttgtctgtccctcctctgccctctgccctgctccaagttgggtgcttttacggacctcggaggagaggaagtgcgtgctgattggtccgagggaagccatgggtgggcccagagcaggcacactaagtccccattccagtgggtctgcaggactggcagctgggccctcagccttcaggccctccctggcctgaatgtggggacctactggggacccacccctttttgcccaggaatctgtctgcctcctgctgccatttatggccctgggctcagcccaaccccactaccacatcagagcaggcgccaggagaagacagaggccaggcagcggagcagacaccccgagcctgcagggactggggggtcatgtctgcccctgaggtgcaggctgcagagatgcacaggtcctgtgcctcggagggcagccgcagctgcacccagggagcttctgctcagccaactcagaatgggtggggctcctgcttgtccctggcttctgcctggtccatggagtgggaagcccaggtcttcagctgctggtcagccagctgcagctgcatccgagagggcagatccccccaagagcacagggagggtcggatccactacacagtttgggtggccgtagccccgcccaggagggcagggctcctgtctgctccaaagagcaggaggcctgggtctgcagccacggtttgggcgactgcccctgtatctggggagctcctgccctaactcagaaagggcgggcctcccaccggctgcatggagtgtgcagctccagccatgcctccctgcggtagccggtgtgatggcagcagccactgccatcagtttcagctagaacaactatgattaattagaattagcctgggagttgaacaatgagaacacatgaacacagagaggggaacaacatacaccagggcctgttgagggtggaggatgaggaaacggaacttaagaggacgggccaataggtacagcaaaccaccatggcacacatatacctatgtaaaaaacctgcagtttctgcacatgtatcccatttttgtttttgtttttgaagaaataaagggacaaaaaaaaggattagccttgttatgactgacagaaaaccttaaataagagtgacttatacaacgtatgttacttttctcatgcattcaagtgcagaggtacacagcatggctggtatgggctagctctttgatcttgcagctcttccatgcttagcctatattctaaggcatacctcatggtcaaagaggccttcctctagccatcatgtctgcattctacccagcaaggagtaaagggaagagaaggacaaacttttccctttaaggacattctcaggagttgcatgctctgcttccacttagagcccattgtctgggactatctcctggccacaactagccgtaaagaaaactgggaaatatagtctttatgctgggtgaccatgtgttcagctaaaaatttagaattctgttataatggaacacaagggatattgaaagaaaattaggtgtctgtgtaatactgttctctggaatggaactcatggtcagcaaaagactataccgtgagcctggaagctgttgttagaaaaataaagaaagcaactaagattctgttagagctttccaaaagaagtacttaaactaccttttttttctggtttggtattttttcagagcccctctcatcacagcatattaaaactcctgctcctctcatagaccttaaatcccttggatttcagctgtttctttttttttttctttttttaactttaagttccaggatacaagtgcagaatgtgcaggtttgttacataggtatacatgtgccatggtggtttgctgcacctatcaacctgtcatctaggttttaagccccatatgcattaggtatttgtcctaatgctttcgctccacttgaccccacctaccgaattgccccagtgtgttgttcccctctctgtgtccaagtgttctgattgttcaactccctcttatgagtgaaaacatctgctgtttggttttctgttcctgtgtaagtttgctgaggatgatggctagaataatcagttggaaatgcagaaatcacctgccttctgtgttggtcttgctgggagctgcagaccggagctgtttctattcgcccatcttgtcccctcccctcagctgtttctcatcaaaacttcctgtactgcctgaagaagttactttccaattttccaccctagcataatgtatcatttagagaaaaaaagctgagttcttttctgaaatgcctgaaaattttattcttttccattttgcttttttcttttgccacacattaaaacacctctgctgatgttaaagctgcctgtacaaccccaaattaattgaagttttggagttgatcaagtaataataataatagccactgtgttttgagtgcttactctatgccaggcaccatgctatgggtgtcacttacattgtgtcattaagtcttcagaacaactcgttaaggtaggactatagatgaggaaactgcagcccacagagattacataacttgcccaaatccttatagctagtaagtgattgagtatagaatttatacctaagaaaacagagtctagaacctcctcctcccacacaccctgattggttgatattacagtatgtcctcacttaatatgttcatcaatagattcttggaaactgtggctttatgcaaaatgacatataacaaaaccaattttaccacaggttaattgatataaacaaatagagtaaagttctcacagcatatgtctggtcaaaaaaacatcaacaaccttttaaataaaaccaaaacacttataatgttaaacaatgaaataaatgtgagcaatacttacatttttaaaagatttaattagccaggcatggtggtgtgcacctgtagtcctagctattttggaggctgaagtgggagaattgcttaagcctaagagttccaggttacattgagctatgattgtattactgtactccagcctgggtagcagagtgagactctgtctcgaaaaataaaataaaataaataaaaacaagataattatttacccactgattacagtcctgggtggcaggtggccagagcctattctggcagttaagggtcaaagtgggaaccctctgtggacaagacaccatcccatcacatggcacactaatacacacacacacacatacacacgcatacacacacactcacactgagaccacctaacatgcacagctttgggatgcgggagggagccagagtacccagagaaaacccacatagatatggggagaatgtgtaaactccacacagatagtggccctagcaaggatgcatttttttttcatcatgagtaaaatgatgttgctttgatgttcaagaaactgctgtattgtatatggaaaaatctagatctgtgctatctgatatggtagctgttaaccacatatgtctgtttacttttagttacttatttgtttgcttccttaagacagaatcttactatgttgcccaggctggccttgaactcctaagctcaagtcatcttcccatttcagcctccccagtagctgggactacatgtgcataccaccatgtccagcttatttacatgtacagttaaattgaaattaattaattttaaaaaagtctcagtttttcagtcacacagtcacatatcatatgttaattagatacacgtggctagtagctactatatggaacagtgcaaatatgaaacattgctattaccacacagaattttcttggacagtactgatctagataaccctgctcctaacctagatttctttttagcctaaattgtctggctggctgtgtagatatggccaaagagaaataggtgcagcctcttaaagaagatatctgaatttatcattctgccccataaatttcacatttgtaaacaaatatttaagtgaaaaatgtgaattttccttgaatattatctccaaaattatcaacccattaagatatcctcattataacactatttgttatgtatatgtgaatagttcactggtgaaatcatgtcagacatatttcaattctacatagttgtcttagtctgttttggctgctataacaaagtcccatagactgggtggcttacaaacaacagaaattttttctcacagttgagatcaaggcactggcagatttggtgtctggtgaggtcctgcttcctggttcgtagacagtggtcttcttgctgtgtcctcacatggcagaaagagcaagggaggtctttgggcctcttttataaggacactaatcctattaatgaggactccattctcattatctgatcacctttccaaaagccccacctcctaataccatcaaactggggattaggtttcaacatacgaatgttgggggaaacacaaatattcagtctatagcaatagttaatgtctgatataacacagctgacatacatagccttcatggcatctgttagcccttttagcattataaagaataagttggttcttattatttttagcattacacagtgaatgttttgattggcaaaaaataaaataatgaggaacacaagaatacttatctgtatataggaactacacacagtcactctaatctcatcccattggctattttatgatttaatatttaaattgaaatctaaaacgtgagtacttagtaaaaagactggatttgtctgtgaatttgatgtacagtcaaatgcaaaatcttattctttagaattgcccacagttacaactccgaaaccactgtaggaaaagcccccagtctcactaaatcactctgggttttttcctgaaaaagcccagtgggtttgcctagttggaaattctatattaagagactactctggtagttggccaggaaaagagcaaccaaaatgacttaatacactactgcattcaattaggtccacttttcttctttcaaaggtgaaaggagaaacatttgactttaaaaagcaacatcttcctataattcgaatgtctattctttgtgtgcttaagaaaacattcagaacagaaattgcaaatatctcattacaattttgaaagaaaaaaatgacagctttcttctagtgaatattacaaattaatgattttcctacatatatttcttatgaatatatgtagctccaactaaaaataataaaatgtcatattaagaaggcaaatattctcacctccatatactggaagtcttctttgtgctagtaggtattctggaaaatctaaatttgcatttcaatcaaagaacatcaataatcggacagagcagactgatgatctttcaaagttccatttcaatgcacctctgagataaaagaggacttctgacaattttcagcatcctgtattgcattgtctattttgaggtattatgtaaaatccaaaaatatgttttgtcattataaaatccatacctctgaactggtttaaaaaaataagcatcttaacaggtatgataattacagtaccaatttgaagaaatcaagaactttaagattgggagaaacagttaagatcatctaaaccacagagaactcaccattaccattggatgtagtagatcagaccctgaatcctgaaggagaaaatgtggctgtaagtctcagctctgagattatttgtgagactttgtctaagtcactttctcttcccctggacctttgtttttctactctgtaaagagaaattaaacttctttcatatctaaggtctatgtacaatttcttgctatctgccaaaagttaagcagccatttatatagtactttagcagactctacttcagtaaaacactaaattagctagactatattactattaattaaatttggaggaaaaagaggctaaaccccaagcaagctagtatcgggaattcatatgaaaaaatgacttctaggaaatgtttttaggtcaaaacacagtcctagacattataatttttgcatctcctgctctgtagagtgaatattgatgtgcatggtgatgaccatgacgttctgaatggccattattgcccagtaacaatgcagtcctatgtgctagactgcattcacttgagcttcaactcaatttgcctgggccatttaaaaattaaaaataattttaaacaggagttgaaagcaacaaaatgctttctgctcaacttttgttagacaattcaattacctacaatatcctattctgtaagcatactagttaatcaaggttttactgtgtattctttaaactagcaagttagttaattaattggaggaagtgaaatgtttggccaggctagatgtctgcactgatgtaactgcttggattttattgttatgtttagtaaggagcaaaattgcatgaacagtgacatgtgtatgtttggctaaggaaaaggcactttatttatggtgagaatggtcaggctttagcagaagtagttgaaattgctatatgatacccagattatacagtttcccagctgatccagtaaatgatcctgaggcctccttacctatttctaggaacatttattaatgaattatcttttttggtcttatttcctatgccaaacaataatctagctacctccatctatcagagtccccttataatgaaggaaacagcaggatctctattgtggggaaggaagtgaagctgttcatctttgtatctctaccacaaaccacagtatctagcacatagtagatgattaataaatgacaaataaacaagggattatttttgactgattggttattttatttttatttatttatttttttttaatttatttattttgagatggagtctcactctgttgcccaggctggagtgcggtggcatgatctcagttcactgcaacctccacctgctgggttcaagggattcttctgcctcagcctcccaagtagctggaattacaggcatgcgccaccacacccagctaattttttttttttttttttgagatggagtctcactctgtcgcccaggctggagtgcagtggtgcgatctcggctcactgcaagctccgcctcccgggttcacgccattctcctgcctcagcctcccgagtagctgggactacaggcgcctgccaccacgcccggctattttttttttgtattttcagtagagatggggtttcaccatgttacccaggatggtctcgatctcctgacctcgtgatctgcctgcctcagccttctaaagcgctgggattacaggcgtgactcaccgcgtccagcctaattttttgtatttagtagagacagggttccaccatgttggtcaggctggtctcaaactcctgacctcaggtgatccacatgcctcaacctcccaaagtgttgggattacaggcgtgagccactgcacctggcctgattggttattttaggtggtagagtaataattgctctttcagggacagttttgtagtcatcttacattaggtttctcaaacaaattttagccaagaagaaacaacatgttacctgaacatatgtggaaacttaacctcttcctttctgtgcccctgctgtcaataagagaaaatcagccaaatctttgataacaaatgtctgttgtaaagacacatagtagagattcaattaaatttgttaaatgaatatgttggaaacaagggcaacttatcaaataaaggtagagccattttacagacttttttccttttctccagaaaaaaaaggaatgtatgacttagaacaattcagataatatcattgataacatggagaaggtatgcacatggaaggaaaaaaattttctgttaaatatgaacaagacttggcaccaagtgaggaagatgccatgtcagtttccatgatggaagccaaatatattaataagggtaatcacaaaggcagtttttgtcctaattacagttaacccttgaacaacatgagggttggggcagtgacacctcttgcagtcaaaaatccatgtataacttaaaaaaatgtgaatacacagtagatgtatatatttttggggtacatgagatattttgatactaacatacaatgcataataattcacgtcagggcaaatagaatatccatcacctctagcatttattctttgtgttaaaaacaatccaattatatccaattatactctttcagttatcttaagatgtaaaataaattactgttgactagtcatccattgtgctatcaaatactatatcttattcattctatttaactgattttgtactcattaaccatctccacttccaccccacccccagtacccttcagagcttttggtaaccatcattctactctctatctacatgagttctgttgttttaatttttagctctgacagatgagtgagaaaatatgataattgtctttctgtgtctcacttatttcacttaacataatgacctccaatttcatccatgttgttgcaaatgacaggatcacattctcttttatggctaaatattacttcattctgtagatgtaccagatgtgccaaattttcttttctttcttttttttctttcttttttcgagatggagtctcactgtgttgcccatgctggagtgcagtagcacagtctcggctcactgcaacctctgcctcccgggttcaagtgattatcctgcctcagcctcccgagtagcttggattacaggtgtctgtcaccatgcccagtgaatttttgtgtttttagtagagatggggtttcaccatgttggcaaggctggtctcaaactcctgacctcaagtgatccaccttcctgcctcccaaagtgctgggattacaggtgtgaggcaccgtgcccagcccacattttctttatatgtttatttgttgacagaaacttaggttgcttccaaatcttggctattgtgaatagtgctgcaataaacgtgggaatgcagatatctctttgatatattgatttcctttcttttgggtatacctaacaatgggattgctggatcatatggtagctttatttttagtgttttgaggaactgccaaactcttctccttagtgcttgtactaatttacattcccgctaacagtgttcaagggctcccttttgtccacatcctcgtcagcattcattattatcttgttttggatataagtcattttaactggaattagatgatatgtaattgtagatttgggtggggacacagagacaaatcatatcattgcccattcaatatggtactaactgtgggtctgtcatatacagctcttatcgtgttgaggtatactccatctatacccagtattttgagtatttttatcatgaagaaatgttgaattttatcaaatgctttttcagcatcaattgaaatgcttgtatggttttatccttcattctgttgatatgatgtatctcattaattgattagcttttgctgaaacatccttgcatcctttgggtaaatcccacttggtcatgacgtatgatcttcttaatgtgttgttgaatttgttttgctgtattttgttgagaattttgcatcaatgtttattagggatattggcctgtacttttcttttttctattctttttctttttcttttttttttttttttttgatatgtctttgacttgttttgttatcagggtaatactggcctcatagaatgagtttggaagtattctctcctcctctatttttcagaatagtttgagtaggattaatattatttcctcttaaatgttacttttctgttcacatgttggatttctttatgatttaatcttggtaggttgtatgtgtctagaaatgtctcattttcttctagattttttaatttattagcatatagttgctcatagtggccccaatgttcctttaaatttctgcagtatcagttgtaatgtcttctttttaaattctgattttatacatttggttcacctctctttttttcttagtctgattaaaggtttgtttacaccgtttttactttcaaaaagccagcttttcatttcattggtcttttgtattatttttttatttcagttttatttctgctgtgatctttattatttcttttcttctagtaattttgggcttggtttgctcttgcttttctagttccttaatatgctacattaggctgtttatttgaagtttttcaactttttaatgcaggaacttattactataaactttcctcttagtgctactttcactgtatcccataggttttggtatgttatgtttccattttcatttgtctcaagaaattttcatattttcttcttaatatcttcattgacccacttgtcactcaggagcatactgtttaatttctttgtgtttgtacagttttcaaaattcctcatgttatttatttcttgttctattcccttatagtcagataagatgcttgatattatttcaatgtttttcaatgttttaagacttgttttgtgatctaacatatgttctatccttgagaatgatccatgtgctaaggaaaaataatgcatattctgcagccattggatgaaattttctgtatatagcagatccatttgttctgtagtgcagattaagttcaatgtttctttagacagatcttccagaaagaaaatcaacaatgatgaaagtgccttgttgacatctccagctattaatattattgcattgggacctatctctctcttcagctctaatatttgctttatatatctgagtgctccagtgttgggtgcatatatatttatacttgttatatcctcttgctgaattagcccctttatcattgtatagtgacctgtctcttcttacagtttttgtcttgaaatctattttgtctgatacaaggatagatactgctgctctttttggttttcattggcatggaatatctttttccatccctttattttcagtctgtgtctttatgtatgtctcttgtaggcagccaataattgtgtcttgttttttaattcatacagccactctatatcttttgattggagagtttagtctatttacaatcaatgttgttattgataggtaaggacttactcctgctattttgttatttgttttctggggttttttgtagtcttctcttccttctttccttccttcctgtcttccttttagtgaaggtggttttctttggcagcgtgatttaatttcttgctttttatttttgtgtatccactgtatatttttttatttgaggctaccataagacttgcaaatacaatctaatagctgaatattttaagctgataaaaacttaatgctgtttgcataaacaaacaaacaaacagaaaagttctataaactctacaccttttttgtccttgctttttaactttctgttgtttctatttctatcttattgtactatctatatcttgaaaagttgttgcagttattattttcgattgtctcatctctttgtcttgctatttaaggtaagagtagtttacacactacactcatagtattacaatattctgtgtgtctttgtacttactattaccagtgagttttgtatcttcaggtggttacttattgcatattaacatcattatctttctgactgaagaactccctttagtatttcttgtaggacagatctagtattaataaaatctctcagcttttgtttttctgggaaagtattttaccttcgtgtttgaagtatagtttcaccagatatactattctagggtaaaagtattttttttccttcagcactttaaatacatcatgccactctcgcctagcctgtaaggtttccactcagaagtctgctgccagatgcattgaagctccattgtatgttatttgtgtcttttctcttgctacttttaggatcctttctttatatttaacttttggtagtttgattattaaatgtgttgaggtagttttctttgggttagatctccttggtgttctataaccttcttgtacttgaatattgatatctttctctaggtttgggaagttgtctgttatccctttgaataaacttcgtagccctattttgttctctacccccttttcaaggccaataactcttagatttgatcttttgaggttattttctagatcttggaggcatgctttattgttttttattctttttccgtttgtctcctctgactgtattttcaatagcctctcctcaagctcactaattatttcttctgtgtgataaattctgctattaaaagaatgcatcaaaattcaagcaagccccagaatttttctattattttaatctctttgttaagttcatttgataaaattctgaattccttctctgtgttattgtgaatttctctgagtttcctcaaaacagctattttgaattctctgtctgaaagatcacttgtctctgtttctcaggattggtccctagtgccttatttatttagttcattttgtgaggtcatattttcctggatgatctgaatgcttgtgctcacataatgacttcactctccttcctccaagcacacagattatctttctgtgccaagtgctcacctcaggggatggggtaggggtggtgtaggtgattcaagactgtcttctatccttgtcaatgcttatttccttaatatgttgtttgtcagtgtctgcaaattgatgagttaggtatttattttagtctgggtttcttttgtactcattcttcttgagaaggctttccaggtatttgaagacttggatgttgtaatctaagccatacctgcattaggtggcaccccaagcccagtaatgctttggttcttgaagactcacagagataccaccttggtggtcttggataagatccagaaaaattatttgaattaccaggtagaaacagatgccttgttttcttcccttactttctcccaaacagagactccttctctgtgctgagccacctggaggtggggatggggtgatacaagcatccctgtggccacccacagtgactgcactggatcagacctaaagccagcacagcactgattcttgcccaaggctcactgtaaccactccctggctaccacctgtattcactcaaagcaccagggctctacaatcaccaggtggtgaagctatctaggacttttttcttccctacatggtgataagttaccccaggactcaggcaggtccagagatgctatttgggaaccaaggagtggagtcaaaaaccttagaaatatacctcgtgttctattttactgcatcagagctggcactcaaaccatgagatgcaatccttcccacttttctctcccccttccacaggcagaaaagtctcacccatggccaccaataccacaagcctatgggtagtactgccaggctggcacaaatgttctttccatattatgatgttaaaaccaggtactgtggcctcttatctgatttttggttgttacgaagatgctttttttgtgtgtgttgatggttgttcagttagatgttccttgggttagggatgattgctgtaggcttcttttcagccattttgcttcaactcttccaatgtataacttggctactcaaaatgtaaccactaatatctggaaaccttgttaacaacatagttgattaacacatattttgtacattatgtgtgttacattctgtcttcttacaataaagttaaagaaaatatcattcaaaaatcataaggaaaagaaatatatttatttatcattaaatggaaatggatcatcataaacgtcttcatccttgtcttcatgttgagtaggctgaggaggaggaaaagggaagggctggtcttgccatcttaggggttgcagaattgaaggatgtgaaggtggaaggggaggcaggagaagcaggaacactcagtgtaacttttattgaaaaaaaatctcctcctcctcagcttcaaatcttaaaaatgcaagggcaggatcaagatcggttccctttgactcagagtgaatgcaaatctgtggagcttctaaaacctacagaccatatgtactgacactaaataattttaaactgatttaggggactgcatgttatatagttttctggaaacaaagctatgagactgaaactgacagctcaaatataatagttgcatttgattgaaaaataaaactaaaatttgctgttaatggaatatctagcccctgaagagtattgagtcaaatttaaataactagaagggtccaccacatcgtaattgtttgagggttcatatgacagacatggaaatggttctgtttggtttctattttgacatacaatagatcttcttggatgggttttgctgacaacctgtggttacaaaaacgtctcctgggtggtctgagacttcattccatgtttatagattatttatattaatttatttctattaggctcaaatactataattggcatctcatcgtaaaaagcactagtttctccctctggttaggcatcccatctgatcccagacagaataaaaagtgggcaagttgtaggggaacatggaatgaggacaaaaatgattttgagaaaaatcaaagattgggaatagagtctcaattgaataacctactggtagtcttggaaaatagatagaactgatgagtatgaagaacattgcaaaacgtacaaaatattttcagtgttcaaatacctaaaagctctcacttttatataaaatgctggcagtggggttgtgttgcctatgctattttaagaaatgggttctaactacactttgttttaatgtaattgttgttttgcaagttccgctgagtaagacctactgcatagaagatgtcactttaggcaggagttacattaaatttggtaaccaagacagaatacctagctgttgggtgatgattctttttaggtttatctgtatgtttatctctctcccttcccctaccccattccttacttcccaactctggagggggattcttgaagtggttttcagatctgtcttggtttaacacagtgggtaaaagggaggttggaataagctgaacactgcaagttactggtggtgggagacgggctatagctgaagggaggtgtgatgactctgaatgggaagcaggctgaacctcattggctcagaaatgaaaggctttctgtttcaaaacacttataccaacattttcctttctgtcctcactcccagaattcaatctcttccttgcttctccctaatacttcagggagacaattgcctttgttctggtcccagaacatatcttcatcagtttccctagtcatcctgcctacttaccacatctcacccttgttgcctattaattttaaccactttatatccaaaattatacttgatttactgagtaacagttccttgaaacaaaacctactacagtagtaccaactgtgatagtgactaaactcaaatgtgtcctaagagcagctactgacattttgactgacaaatatgattgttataagggatggagaagtgtattttgtcagttacatatatgcctggacttactagccccatgaaaatgtgtttttgataggtgtctcagagttgtgaaattcaagtaccaacttgaatttaaaaaataccaatgtggcttgtgggaactctcagtaagtctgtacactcaaataatcaatgctttgatggtgggtagtcttccctttgttatcatgctcccctttctccgtcgacacatattttaagtgacatttattaaatattattcttcatcatgaaggaggcaaattagggcagagtataacaaatagcatcaggaatattacagtgaactttgctttaaagctaagacagacaaggcaatagagttctaaaaggaatgccaaaactctcccttcccagaatcttctttgaaatgttatctgagttaatgccccatctctttaaatatggcctggaagtggtgtcaggagggtgctttaagaattttagacttcggttaagctgggcagattggttggaactggtgaattggaaaggaataccaatttggcaagtttatgtttcagcatgccacacaaagttaaaaactgcactttgttttaatttaattgttgttttgcaagttccgctgagtaagacctactgcatagaagatgttaccatgtagtcatcagtctctaggctggttgttcttaactgagggtatttaggaaactttaaaactcaggtaaaatacctgcagagacacacacacgcgcacacacacatacacacgtgtgcgcgcacatacacacatgcacatgaatacacatacagagaccctttccatctcctttccacctatgctggaggcttggattcagtagatctgaagtggagcctgagcatctgcattttaaatgctccatagtacattccaatgtacagccaagactgaaaaacccctggctcagacacttcaatttggtctggagtttgatgtcctgtaggtgctttattgtgcaacaaacttatttaacaagtactatttgtcaggcactgttccaagcattctataatagctactcatttaattctcataccaaccctatgaggtaggtattatcatcatccctattttgcagatcaagcgaaagagagatacagataatcttctatcttaagtaaaaagacataaaaactatgtcccattgaagcatactattaagttaattgtatattaaagtgctgtgaacattgtgaaataagtacatatgattaactgagggtatttaggaaactttaaaactcaggcaaaatacctgcagagacacacacgcgtgcacacacacgcgcgcatgcatgcacacacacacatacacgcatgcacatgaatacacatacagagaccctttccatctcctttccacctacgctggaggcttgtggcattaaccagagtgaaagaagacaccttggtctggtttatgaatactgaggaatacatgaatcatctttactctcgatatctttgaaaacaagatgaatagctaaagagtaggctctccagtaaaacttcactctagaagatgagaaaggagcaataagacacaagtcaaacatattataacatgtgaatgtttattaatatcattaaaatatatgattgggtcttccttttttgcctttttataaattaagaaaaaccctggtctacttgatgaccttaaaatggactccaggaataataatgatatgatctattactagcaaattcagcaaccaaaacttcagaaaactagtccataagttcagtattctgtgtttattaatccatagtgatgtgtcaacctttacaacacagtcttttattagtaaagttaaatcagacagaactatagatacaaaaacacctaggttccagtctcagccttgagactaatgtgttctacgttctttcccctctcaaagccttagtttcttcatctgtaaaatggatgcgtttgccctagataatctctccaaggtctctaccagtataaaaagtctataaatatgttaagaactattgtgacaggaagctcatggcttttgtttcttcgatgtaataatttgttcctgcctatctcctgggatctctgagtgagcattggttagaaagaatgttgagctctctggtggacagctgacttctcttacccagcagaaatgaatctgtcaactttcattaggcattgtcgggtagcatcatgctcagtgatagattgtaccagaagtagtgttaggttgacatccaattataccaaggttctaaaaaggtagtctatttcactcttcttaaaattcctgagaatttgggatgctgcaaaacacgtaaaatggttgataggaagcaaaaaattgtttgccatgcattttaatactttcattttgaggctattgaagctgtatatggtcgtattatcaatagaagtgccttaaaaaattgtcaaggttagaagaacaggtttctggaacacctcacagttgtgatcacaactgagccttgtgcttttagccaaattgctccctggcctgttccccaagatggcacaatgtcaggagagcttcctcctaaggaaaatggcccaagaaagaaaaaagataggggtggtggttaggaagtgaaggaggcttctcctgatttccttgaccttttaaacagccataccatctggaaacagagtgggcagcacatcacacagagtgggcaaccacagagtgggcagtggcaaatcagagtcatctggactacatgaataattatgtggacatttaaattcccacccaataaaatccactttacatttataataattttaaaatattaagtgaataaaaatattaatttttccaaactctgcaagccttcatttggatttggctgtataaatctggcctgaagataatttctttctatttaccaacatagaaaggaattcaaattatgttgttaaatgaaacaagcaagttttataacacagttttagtttgattctacgaaaacaatgtagtatattttagaaaaagaaatgggaacattatgttgtatggagcaagggctgggaattctagaaattctagataactttatctttgttatatatttctatatttcatttttatacaacaaaaacattttagctttacatcagattaaaacaaaataaagtcttgttttagaaaaaaaagtaagggatatttgagggctttgggggtaataattattttcttccaacaggagttgaattatcagaaccttttcattatcaacttttgtccttaaactaaaagttaaaatctattattctcattgggattgattttctgtttcttgctttacctcaacaacccttttggcgaagatccattgaataattcaagaattctttctaaggtataaaacaagtcaagatggctagccccagctccttggtcccttgcctgggtgagaaagatctcagcacagcttcttttgctgggcatagaatggcttttgattttcttgatgtggctgttacctgatatttcaagagttgctctgaatatgccttggtaatctcttggtctaggcaggccaggctgaagagactattttgctcattgtagaatagtatctcataaggctccttattatctgggcaaaaccaaaaatctgctactctgcctctggccccagcagagccttttctaattaatactttatttggcagcagatgttttctgtgtgccatacactgaggcaacagctaagcagaatcccttaagtgaagatattccactaggaagggcaccttcccccaacccttcaggcttctctagtttgctcaggaaggtcttccttattgtcatatcttaaggcagtctatttttcttttcataattggcttactctctaaatagttactgtgttttctcaaatttctaaagccataaagagtatgttcaccttttataataccagcactttgggaggctgaggcaggtggatcacttgaggttaggggttcaagaccagcctgaccaacatggtgaatccccgtctctactaaaaacacaaaaattagtcaggcatggtggtgagtgcctgtaatcccagctactcgggaggctgaggcaggagaattgcttgaacccaggaggtgaaggttgcaatgagccgagattgtgccactgcactccagcctgggcaacagagtaagactctgtctcaaaaaataaaaataaaaaaatatatatatatatttatgtgtgtgtgtgtgtgtgtgtgtgttcaccttttaaacaatataaaagtatacagaacaaaacatgaaaatccccctttgtttccttccccatcttcaatggtctgatatacatctttccagttccctttctatgcatttacatacacatgtatacataaatatatatgatgtttctttgcatccactaaaattttctgcaaggttgaaagtgttctaaatctgtgctatgcaatatggtagctacatgggacagctgagcacttgaaatgtgactagtgtcactgagggactaaatttttaattttaagtaattcaaatttgtttaaatttaagtttttaattggcaacccaatgggaaagaagaaatgaaattttctctgtagacaacaagatcatatacatagaaaacccctaaagactccatgaaaaactgttaaaatgaaaatggtaaaagtgcaggatacaaaatcaacacagaaaaatcagtagcatttgtctatacaaacaataaactatctgaaaaagataaagaaaataatcccatttaaaataaaatagaaaaaatacttatgaataaatttaaccaaagaagtaaaatatctttataccacaaactatcaaaattgaaataaaaaaatgaaaaatacaaatacatgggaggatatgttcatggagttgaaaaattaatattgtcaaaatagccatagtacccaaagaaatccacagattcaacgcaattcctatcaaaattccaaggccatttttcacagaaatatacaaaaaaaaatcctaaaattcatatgaaatcacaaaagatcccaaagagccaaaacaatcttgagcaaaaagaacaaaaccagaagcatcattctatctgatctgaaaatttaccacacagctatagtaaccaaaatagcatggtagcagcataagaacacttatacagaccaatggaacagattagagagccaaaaaataaattaatatatttatggccaactgatgtttgacacaggtgctagtaatatacaatggggaaaggactagtctcttccatacgtggtgttaggaaaactggatatccacatgcagaagagtgaaattagactctcacatcatatatgaaaatcaactcaaaatgtatcaaagacttaaatataagacctaaaattgtaaagatactggaagaaaacacaggggaaaagcttcttgacattggtctgagcaaagattgttttggagatgacttcaaaaacacaggcaactgatatagtttggatctgtgtccccatccaaatctcatcttgaattgtagttcccattatgcccatatgtcaagggagggactgggtgggaggtgattggatcacaggggagtttcccctaagctgttctcataaaaatgagggagttctcatgagatctgatggttttataagtgacagttcctcctacacacactcttttcgcctgctgccatgtaatgcatgcctgcttccctttctgccatgattgtaagtttcctgaggccttcccatccgcagaaccattagtcaattaaacctctttcctttataaactacccagtcttgggtactatctttataacaatgtgacatcaggctaaaataggaaattagtaccacaaagaatggggtactgctataaagataccaaaaaatgtggaagcgactttggaactgggtgacaggcagagttggaacagtttggagggctcagaagaagacaggaagatgtgggaaagtttgcaactttctagagatttgctgaatggttttgtccaaaattttgatagtgatgtggacaatgaaatccaggctgaggtggtctcagacggaaatgaggaacttattgggaattggagaaaagatcactcttattcttttttttttaaattattactatactttaagttctgtggtatatgtagaggacgtgcagtattgttacataggtatacacgtggcatggtgctttgctgcacccatcaaccagtcatctacattaggaatttttcctaatgctatccctcccctagctcctcactccccaacaggccctggtgtgtgatgttcccatctctgaacacatggaacaatgaatccatgtgttctcattgttcagctcctacttacgagtgagaacatgtgatgtttggttttctgttcttgttgtttgctgagaatgatggtttccagcttcatccatgtccctgcaaaggtgatgaactcatccttttttatggctgcatagtattccatggtgtatatgtgccacattttctttttttttcttttttttattattatgctttaagttttaggatatatgtgcacaatattcaggtttgttacatatgtatacatgtgccatgttggtgtgctgtacccattaactcatcatttagcattaggtatatctcctaatgctatccctcccccctccccccaccccacaacaggccccagtgtgtgatgttccccttcctgtgtccatgtgttctcattgttcaattcccgcctatgagtgagaacatgcggtgtttggttttttgtccttgcgatagtttgctgagaatgatggtttccagcttcatccgtgtccctacaaaggacatgaactcatcattttttatggctgcatagtattccacggtgtatatgtgccacattttctaaatccagtctatcattgttggacatttgggttggttccaggtctgtgctattgtgaacagtgccgcaataaacatatgtgtgcatgtgtctttatagcagcatgatttataatcctttgggtatataccctgtaatgggctggctgtgtcaaatggtatttctagttctagatccctgaggaatcaccacaccgacttccacaatggttgaactagtttacagtcccaccaacagtgtaaaagtgttcctatttttccacatcctctccagcacctgttgtttcctgacattttaatgatcaccattccaactggtgtgagatggtatctcattgtggttttgatttgcattgatggccagtgatgatgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtccaatgagtaggttgcaaaaattctctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcccaggttttcttctagggtttttatggttttaggtctaacatttaagtcttcaatccatcttgaattaatttttgtataaggtgtaaggaagggatccagtttcagctttctactcatggctagcccgttttcccagcaccatttattaaataggggatcctttccccatttcttgtttttgtcaggtttgtcaaagatcagatggttgtagatatgcggcattatttctgagggctctgttctgttccattggtctatatctctgttttggtaccagtaccatgctgttttggttagtgtagcttgcagtatagtttgaagtcaggtagcgtgatacctccggctttgttcttttggcttaggattgacttggcaatgctggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggttcttcacatcccttgtaagttggattcctaggtattttattctctttgaagcaattgtgagtgggagttcactcatgatttggctctctgtttgtctgttattggtgtataagaatgcttgtgatttttgcacattgattttgtaacctgagactttgctgaagttgcttatcagcttgaggagattttgggctgagacgatggggttttctagatatacaatcatgtcatctgcaaacagggacaatttgacttcctcttttcctaaatgaatgccctttatttccttctcctgcctgattgccctggccagaccttccaacactatgttgaataggagtggtgagagagggcatccctgtcttgtgccagttttcaaagggaatgcttccagtttttgcccattcagtatgatattggctgtgggtttgtcatagatagctcttattattttgagatatgttccatcaatacctaatttctggagagtttttagcatgaagggttgttgaattttgtcaaaggccttttctgcatctattgagataatcatgtggtttttgtctttggttctgtttatatgctggattatgtttattgttttgcatatgttgaaccagccttgcatcccagggatgaagcccacttgatcatggtggataagctttttgatgtgctgctggattcggtttgccagtattttattgaggatttttgcatcaatgttcatcaaggatattggtctcaaattctcttttttagttgtgtctctgccaggctttggtatcaggatgatgctggcctcataaaatgagttagggaggattccctctttttctattgattggaatagtttcagaaggaatggtaccagctcctccttgtacctctggtggaattcagctgtgaatccatctggtcctggactttttttggttggtaagctattaattattgcctcaatttcagagcctgttattggtctattcagagattcaacttcatcctggtttagtcttgggagagtgtatgtgtcgaggaatttatccatttcttgtagattttctagtttatttgtgtagaggtgtttatggtattctctgatggtagtttgtatttctgtggaatcgatggtgatatcccgtttgtcatttttcatcgtgtctatttgattcttctctcttttcttctttactagtcttgctagcggtcaatcaattttgttgatcttttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcagttttagatctttcctcctttctcttgtgggcatttagtgctataaatttccctctacacactgctttgaatgtgtcccagagattctggtatgttgtgtctttgttctcgttggtttcaaagaacatctttatttctgccttcatttcgttatgtagccagtagtcattcaggagcaggttgttcagtttccatgtaattgagtggttttgagtgagtttcttaatcctgagttctagtttgattgcactgtggtctgagagacagtttgttataatttctgttcttttacatttgctgaggagtgttttacatccaactatgtgttcaattttggaataggtgtggtgtggtgctgaaaataatgtatattctgttgatttggggtggagagttctgtagatgtctattaggtccgcttggtgcagagctgagttcaactcctggatatccttgttaactttctgtctcgttgatctgtctaatgttgacagtggggtgttaaaatctcccattattattgtgtggtggtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttccttggtagatcttcctccatccctttattttgagtctatgtgtgtctctgcgtgtgagatggggttcctgaatacagcacactgatgggtcttgactctttatccaatttgccagtctgtgccttttaattggagcatttagcccatttacatttaaggttaatattgttatgtgtgaatttgatcctgtcattatgattttagctggttattttgctcgttagttgatgcagtttcctcctagccttgatggtctttacaatttgtcatgtttttgcagtagctggtaccggttgttcctttccatgtttattgcttccttcaggagctcttttagggcaggcctggtggtgccaaaatctctcagcatttgcttgtctgtaaagtattttatttctccttcacttatgaagcttagtttggctggatatgacattctgggttgaaaattcttttctttaagaatgttgaatattggcccccactctcttctggcttgtagagtttctgcagagaggtcagctgttagtctgatgggcttccctttgtgggtaaccagacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctagattggggaaattctcctggataatatcctgcagagttttttccaacttggttccattctctctgtcactttcaggtacaccaattagacatagatttggtcgtttcacatagtcccatatttcttggaggcgttgttcatttctttttattctttttttgtctaaacttctcttcatgcttaatttcatttgtcttccatcactgataccctttcttccagttgattgcatcagttactgaggcttgtgcattcatcgtgtagttctcgtgccatggttttcagctccatcaggtcctttaaggacttctctgcattggttattccagttatgcattcatctaatttttttcgaagtttttaacttctttgccattgatttgaacttcctcctttagcttggagtagtttgatcttctggagccttcctctctcaactcgtcattctccgtccagctttgttccgttgctggtgaggagctgcgttcctttggaggaggagaggcactctgatttttagagtttccagtttttctgctctgttttttccccatctttgtggctttatctacctttgatctttgatgatggtgacgtatagatgggtttttggtgtggatgtcctttctgtttgtcagttttccttctaacagtcaggacccttagctgcaggtgtgttggagtttactggaggtccactccagaccctgtttgcctgggtatcagcagtggtggctgcagaacagcgggtattggtgaactgcaaatgctgctgcctgatcgttcttctggaagttttgtctcagaggagtacccgggagtgtgaggtgtcagtccgcccctacttgggggtgcctcccagttaggctactcgggggtcagggacccacttgaggaggcagtctgcccgttctcagatctccagctgcatgctgggagaaccactactctcttcaaagctgtcagacagggacatttaagactgcagacgttattgctgtcttttgtttgtctgtgccctgcccccagaggtggagcctacagaggcaggcaggcctccttgagctgtggtgggctccacccagttcgagcttcctggccgctttgtttacctactcaagcctgagcaatgcggtcgcccctcccccagcctcgctgccaccttgcagtttgatctcagactgctgtgctagcaatgagcgaggctccatgggcataggaccctccaagccaggtgcgggatataatctcctggtgtgccgtttgttaagcccgttgggagggcgcagtattagggtgggagtgacccgattttccaggtgccctctgtcacccctttctttgactaggaaagggaattccctgaccccttgtgcttcctgggtgaggcgatgcctcgccctgcttcggctcacacacagtgcactgcatccactatcctgcacccactgtccagcactccccagtgagatgaacgcggtacctcagttggaaatgcagaaatcacccgtcttctgcatctctcacgctgggagctgtagactggagctcgccaaattttctttatccagtcatgctggagaggttgtagagaaataggaatgcttttatactgttggtgggagtgtaaattagttcaaccattgtggaagacagtgtggagattcctcaaggatctagaactagaaataccatttgacctagcaatcctattactgggaatatacccaaagtattataaatcattctactataaagacagagagacacatatgtttatggctgcactattcacaacagcaaagacttggaaccaacccaaatgcccatcaatgatagactggccacgttttctttatccagttcttgtgatggtttgctgagaatgatggtttccagcttcatccatgtccctacaaaggacatgaactcatccttttttatggctgcatagtattccatggtgtatatgtgccacattttcttaatccagtctatcactgatgggcatttgggttggttccaagtctttgctattgtgaatagtgctgcaataaacatatgtgtccatgtgtctttatagtagaatgatttataatactttgggtatattcccagtaataggattgctgggtcaaatggtatttctggttctagatccttgaggaatcaccacactgtcttccacaatggttgaactaatttacactcccaccaacagtataaaagcattcctatttctccacatcctctccagcatctgttgtttcctgactttttaataatcaccattctaaatggtatgagatggtatctcattgtggtttggatttacatttctctaatgaccagtgatgatgagcttttattcaggttggttggccacataaatatcatcttttgagaagtgtctgttcatatccttcacctgatctttgatggcgttgttttatttttcttttaaatttgtttaactttatagattctggatattagccctttgtagattccggatattagccctttgtcagatggacagattgcaaaaattttctaccattctgtaggttgcctgttcactctgatgatagtttcttttgctgtgcagaagctctttagtttaaatatatcccatttgtctattttggcttttgttgccattgaatttggtcttttagtcataaagtctttgcccatgccaatgtcctgaatgttattgcctaggttttcttctagggtatttatggttttaggacttacgtttaattctttaatccatatgagttaatttttgtataaggggtaagaaaagagtccaatgttggttttctgcatatggctagccagttttcccaacaccatttattaaataaggaatcctttccccattgcttgtttttgtcaggtttgtcaaagatcagatggttgcagatatgtggtgttatttctgaggcctctgttctgttcattggtctatatacctgttttggtaccagtaccatgctgttttggttactgtagccttgtagtatagtttgaagtcaggtagtgtgatgcctcaagctttgttctttttgcttaggattgccttggctatgcgggctcttttttggttccgtaggaaattgaagtagttttttccaattctgtgaagaaagtcagtgttagcttgatggggatagcattgaatctataaactactttggtcagtatggccgttttcatgatattgattcttcctatccatgagcatagaatgttttcccatttgtttgtttcctctcttatttccttgagcagttgtttgtagttctccttgaaaaggtccttcacatcccttgtaagttgtattcctaggtattttattctctttgtagcaattgtgaatgggagttaactcatggtttggctctctgtttgtcagtttttggtgtataggaatgcttgtgatttttgcacactgattttgtatcctgggactttgctgaagttgcttatcagcttcaggagattttgggctgagatgatggggttttctaattacacaatcatgtcatctgcaaacagagacaatttgacatcctcttttcctatttaaataccctttatttctttctcttacctgattgacctggccagaacttccagtactatgttgaataggaatggtgagagactgcatccttgtcttctgctggttttcaaagggaatgcttccaatttttgcccattcagtaagaaagtaagggatatttgagggctttggggtaataattattttcttcctacaggagttgaattattagaaccttttcattatcaaattttgtccttaaactaaaagttaaaatctgttattctcattgggattgattttctgtttcttgctttacctcaacaacccctttggcgaaggtctattgaataattcaagaattctttctaaggtataaaacaagtcaagatggctagccccagctccttggtcccattcagtatgattggctgtgggtttgtcataaatagttattattttgagatacattccatcaatacctagtttgttgagaatgtttagtgtgaagggctgttgaattttgttgaaggcatttcctgcatcgattgagataatcgtgtggtttttgtcattggttctgtttatgtgatggattatgtatattgatttgcatatgttgaaccagccttgcatcccagggatgaagctaacttgatcgtgctggataagctttttgatgtgctgctggatttagtttgtcagtattttactgaggattttcgcatcaaagttcatcagggatattggcctgaaattttcttttttttgttatgtctccgccaggttttggcatcaggatgatgctggcttcataaaatgagttagggaggattccctctttttctatttgttggaatagttgcagaagaaatggtaccagctcctctttgtacttctggtagaattcggctgtgaatctgtctggtcctggactttttttggtcagtaggctattaattactgcctcaatttcagaacttgttattgctctactcggagatccaatttcttcctggtttaaacttgggagggtgtatgtgtccaggaatttatccatttcttctaggttttctagtttatttgcatagaggtgttcatagtattctctgatggtagtttgtatttctgtgggattggtggtgatatcctctttatcattttttattgcatctagttgattcttttctattttcttctttgttaatctggctagcggtctattttgttgatcttttcaaaaaccaggtcctgggttcacagcgttcaaactttactaaggatcagactgcttcctcaagtggttctatgatctcgggtatactgaatgggagatacctcccagtaggagccgacagacacctcatatgggagagctctggctggcatctggtgggtgcccctctgggttgaagcttctagaggaaagaacaggcagcaatctttgctgttctgcagcctcctctagtgatacccaggcaaacagggtctggagtggacctccagtaaactgcagcagacctgcagcagacgggcctgactgttagaaggaaaactaacaaacagaaaggaatagcatcaacataaacaaaagtacgtccactcagagaccccatccgaaggtcaccaacatcaaagaccaaaggtagataaatccacaaagatggggatagaccagcgcaaaaaggctgaaaattccaaaaaccagaatacctcttctcctccaaaggatcacaactcctcgccagcaaggaaacaaaactggacggagaatgagtttgatgaattgacagaagtaggcttcagaaggtgagtaataatgaactcctccaagctaaaggagcatgtcctaacccaatgcaaggaagctaagaactttgaaaaaatgttagatgaattgctaactacaataaccaggttaaagaagaacataaatgacctgatggagctgaaaaacacagcacaagaacttcatgaagcatacacaattatcaatagctgaatcgatcaagcagaagaaaagatatcagagactgaatatcaacttaatgaaatgaagcaagaagacaaggctagagaaaaaaagaatgaaagggaatgaataaagcctctaaaaatatgggattatgtgaaaagaccaaatctacatttgattggtgtgcctgaaagtgactgggagaatggaaccaagttggaaaacactcttcaggatattatccaggagaacttccccaacctagcaagacaggccaacattcaaattcaggaaatacagagaataccacaagatagttgtcaagtatctactttgtcaagtagagcgaccccaagacacataattatcagattccccaaggttgaaatgaaggaaaaaatgttaagggctgccagagagaaaggttggattacccacaaaggtaagtccatcaaattaacagtggatccttctgcagaaactctacaagccagaagagagtgggagccaatattcaacattcttaaagaaaataattttcatcccagaatttcatatccagccaaataagtttcataagtaaaggagaaatagaatcctttacagaaaagcaaatgctgagattttgtccccaccaggcctgccttagaagagctcctgaaggaagcactaaacatggaaaagaagaccggtaccagccactgcaaaaacataccaaattgtaaagaccatcgacactatgaagaaactgcatcaactaataagcaaaataaccagctagcatcataaagacaggatcgaattaacacataacaattgttgcctcagagggtgcaagtcccaagctttgacaacttccacatggtgttgggcctgcgggagcacagaagtcaagaactgacatttagaaacctctgcctagatttcagaggatgtatggaaacacttggatatccaggcagaagtttgctgcaggggaagagctctcatggagaacctctgctaaggcagtgtggaaggaaaaaatgtagggtaggattcctcacacagagtccccaatggggcactgcctagtggagctgggagaggagggccactgtcctccaaaccccagaatgatagatccactgacagcttgcacagtgtgcctggaaaagctgcaggcactcagcaccagcctgtgaaaacagctggggaccgggggtgccccaccttgcaaagccactggggcagagctgcccaagtccctgtaagccaacctctttcattagcatgacctggatgtgatacatggagtcgaagaagatcagttcagcgttttaatatttagtgagtgcctcacttgattttggatttgcatagggcctgtagcccctttgttttggccaatttctcccatttagaacaggagcatttacccaatgcctgcaatcttatcatatgtaggaagtaactaatttgcttttggttttgcagcctcataggcagaggggactagtgttgtctcagatgagacttcggactgtggacttctgagttaatgctgaaatgagttaagactttggggtactgttgggaagatatgattgattttgaaatataaaaagtacatgacatttgggaggggccagaggcagaatgatatggtttggctctgtgtctccatccaaatctcatctcaagttgtagtccccataatccccacatgtcgagggagggaccagctgggagatgattggatcatggaggcagtgttccctaggctgttctcatcatagtgagtgagttctcatgagatctgatggttttataagtgtttgatatttcctcctacacacactcttctcttgcctgctgccatgtaagacgtgcctgctttctcttccaccataattgtaggtttcctgaggcctccacagtcatgcagaactgtgagtcaattaaacctctttcctttataaattacaggcttgggcagtatctttatagctgtgtgagaatatactaatacagcaaataaagcaaaaatacacaaaatatcaatctaaaaatcttctacacagcgaaggaaacaacagagtgaagagacaacctatattgaaagaaaatatttataagccatacatctgataaggggctcatagccaaaatatataagcaactcaaaaaactcaatagcaagaaaacaaacaacatgattaaaaatgggcaaaggacttgaatagacatttcttaaaagaagacatataaatggcaagtaaatacatggaaaaatgctcaacactgctaattattagggaaatgcaaattaaaaccacaatgagatatcacctcacaccagtcagaatggctactataaaaaaggtgaaagataaatgttggcaagggtgtacagaaaagagaactcttgtatatcattggtgggaatgcatgtaagcacagccattatggaaacttatatgaaagtttctgaaaaaactaaaactagaacttccatatgatccagcaattccattcctgggtatacagttaaccgttgaacaacatgggagttagggatgctgactctcacggcagttgaaagctcatgtataacttttgactccccacaaactttgctactaatagctttctgtttactggaagccttactgataacatagttgttaaacacatattttttatgttatatgtgttatttagtatattcttaaagtaggctagagaaaataaaatgttattaaaatcataagaaagataaaatatatttactattcattaagtggaagtggttcatcataaagcttctcatcctggtcatctttacattaagtaggccgaggagaaggaggaagaggagggggttggtcttgctctcccagtggttgcagagttggaggaacatctctatataagtgaacctgcacagttcaaactcatgtcgttccagtgtcaacagtatttacaaaggacatgaaatcagtatgtcaaagagatatctgcacttgcatgttcattgcagcattattcataataaccaatatatggaatcaacccaagtattatcaacctaagtatttacctgtggaagaatggataaagaaaatgtgatacacacacacacacacacacacagtggaatattattcagccttaaaaagcaaatgaaatcctatcctttgtgacaacataaataaacctagaggacattatgctaagtgaaataagctatgcactgaatgacaaataaggcataatttcacttatacatggaatctaaaacagttgatctcatagagccagagagtagaatggctgggggtggggaatgggaaatggggagatgttggtcaaagggtataaagtttcagttagataggaggaataagttttttgagatctattacacaacatgaaggctatcgttaataatcatgtctatttcaaaattgctaagacagtaaatttcaaatgttcttaccacaaaaagtgataagtatttgaggttatggctatgttaattaccttgctttaatcattctacattgtatatatatgtgtgtgtgtgtgtgtgtgtgtgtatataatcagattgtaccccataaatatatacaattataatttgtcagtttataataaaataaataattaaaaaataaataaaatttaagttttagtagccatatatggcaattggctatcatattacgcagtgcagatcaaaatagtagggaccaggaacttagaaaacagcaacagtgtgagaaatataactatgggtactagggtaccagtgttttactagagatgcatcatctcactttatcttcacaatcctattattaacagatttttaaaaaaaccctcaggcatagagaattttagaaagttgtccaagacagaaggcattagagtgtggattcaaattcagacaatatagctccagaaagtacccccctgagtttaagcatgtgggaaatcatgtgataaactggaaatggcataagttttggtatagagaaaactaattttggatcttcatcctgccacttattggactctgtgtgacattaggcaagtcacctatcctctctgattctttattataaaacctataatatgggactcacaatacttctcaccatcaatgggatatacactttaatatatcatatgttatttccccctcttccatcttccctatcaaataagtttgcctttggggcaaaactacctatagtaggggatgttttcactggccatgaaacagattaaaattaactgagattaaaacagatcaaaattaagcaaacacattattccttgtgggccagggcttattatcacagaattctagatagctgagctaattgaagggcaaagaagtctctggaactaccacactgaatgtaaggataaaggcaaggagcagtttggtctgctgcagattaattggctaatgcctatggtttgtaatcagattgtggttcaagttctagttctaataattactacttgtgtgaccttgggaaagtcacctaccctctttctctctgttttctcatatataaaatgggggtaataaggaagttccagagactttcttgcctttcagttatctcagctgtctagaattatgtactaattacatgttgtcttgtaacctttgaggaaagataatatgtaaagtctatttccctgaaattcagagctggagttgcttttgtgttcttgatttcttcaattttcttatctctgaaaaaaatgttggcacttctgcctatgtggtttatgaatcctgccatagttcgattagagtaatgtatttttgtaacacatttgaaccacatgcttgtgacatactccattgcatgactctttcgttaagatctactggaaatgtcagagtctctttaaaggcagttgttaaacattaacataagaatgtttgttaaactcttccagaaaaggatactatgtaaatcataacatcatttaaattggtcaaccactattaattcaggctaattgtggaagagtccaagctgaactgctgataaatctaaagagtacagtatatataaaggagtgctagctagctggtgatgagtaagactcatggtgggcctactttaatgaaagatatcattcatttgtaattgtaatcactataataatggagtggaattaaagtaattgaaagcacagtttggtctattaagtagtttgaatattcctctagcatttctgtttattccattaattttcttagcaatatcctttcatagatatatcctttcatagatattgcaaggtcaacttaagcccagcctgggtccaaatgatcacaaaacttgagtttattaggtccacattaatgaggacttattataatgataaatctataaagatcaaaacctggggcaggctatcggttatgctatctcttatttaattgctttggtttttttctattataaatttcacctttcataccactctacacatgatgttgggattagaacagtctcctgagaacaccataactaaatgtgtatgcttaaatagagacccacttattggtgccagttaatccttaatgaatgtaacatcaataaagtaggtaataaaaaaagttaaattttattgctaatcttaaatcctactttaaggagaagaaaaaccttaatgctatggctagagttgagtagcactagattagcattggtgtacattaataatgaaaatagctgagccccattagtgtcacttaaagttttgtgaattagagatatggccctacaaattaaacaccttgaatactgaatgggggaataattattatttaaaaagttaaaaccttcacatctcttctaaaggaaaatttttcattggtatagaattacataccattcactctacagtatgaaaaggatggaactttgcagaccataaaaagtataataaaggagccactaaaattgatttttatttaagcagattactagtgttttcttccttaactggaaggagtgccctgtactcctccaacctattttcagccatgatactatttctacatgcataattagacactgacccctttgaggaagtttaaatgtcccttattatccccaacctcaactccaaaacctttttcagccaagcaagagaataggaaatatatagaaatgaatgtgcaaaactttccaacatgtgtgcatatagaacaaattgtgaggtcagtgaagtgagtccctattttccttcttactctgtatgcttctttgtctccaaccatgcccaacccagtagtttcctctgtagcccagggtcttctacgtcaatgccctaaaaaagcctgcactccccttccccacctcattttccatcccctactccgcctccacaaaacttacttgttctgagtcaattttatcagatccctgctgtctttcaagagtgttattagtagtagtaatggcagtaggaggaatcatactataacaaggaaaactaatagccagtgtgagtataatgactgttatattatgctccaggcactctgcaagcattttacatccagtacttcatttaatcctcacttttacagatgataaaattgaggcttagaaagagtaagtgtcttgtctaaggtcccacagtgaataagaggactcactcttgtttgtttgttgtagctcttaactgctacaactctatactgcctacatagttttaggaaaagcagtaagagttaatatcccagaaagcattttgaaaaaagttaaaatggttgttccctcctaaaccatttgtagttcattatcggactttgctgtattgtcttatttttaaagtagggggatgggagagagtaaggaagagggaggaaaagaaaggaaggaggataaagaggaagaactgactttcaggccagaatggatactttgccttagtcaaacatccgagtacataatatctaggcttcttattctccttgacaagatgcaggccagtaatgccatgaaactggcataaatacagttgtccctcagtatctccaaggattggttccaggacccccacatattcccaaattcttgcatattcaagtcccacagtcactgctctgtagaacccacatatatgaaaagttggccctctgtatacacaggttttgcttcctgcaaatactgtattttctatgtttaactgggggaaaaaagtatgtataagtagaactgtacagttcaaacccatgtttttcaaggatcaaatatattccccatctccctttcccatccactcacaaattcctggtccaatcacttgtggctgaggtagcaggattggtttcacacaatataaataatagcacattgtgtgagaaaaaaactgtgggacactttccttaaaagttctatacatacagacatagcaggcctctgaggttacctcaacttctcttagagcctatcaagtacaaatatgtatgattctcttagggcttaattagtgggtggacaatataaaagttgaggacatcctccaaatgacagaaagggtggccttatctcaggaatgagagttcttctagccctaagactaatgccatgaaatatttgctactacacctttgcttctttctcatttccaaatccagtactctctcccaggtacactctggggtcttattggtttcatctaaagttcctaatcagccattaatgattctggctccctgaatgtaaaatttcttttgttttctttaatatgaactgtgaggactcaggatccagctggccctagatacttagggaaactattgagctctgctttggtggcaattgccttggctagttgaaagctctgtttagttccccatctgtgtttgtatgtgacttatataaattagttacttttgaaattgcaggtggttttaaaacaaaaactcgtattctaagtaaaaggataagtgagggctataccttctgaaactaacctgaagtaagtaatcttgtatcagtttcctgatcatactctagctttcttctccaactggagtgaccctttacaagacatggtctgaagctttttgcaaagacagcctcttctcaaatgtatacctggcagtaattttcccatgaatggtcttgatgctaacaatgtctgattcatctgcctttttattctcttctgttactaactcactagaaataatctctgacaaagtccacatgtatgagaattagccttagaacaagagaagccaagacattggctattagatgttagggtgatcaaccatcctggttttcccaggattgttccaagattaacactgaaaatcttgtgtcctgagaaaaaccctagcccaaagcaaaccaggatggttagtcaccctaccagatgtacatgtaggctatatggtgtattagaaagaacactggtcttcaaaagtctgagcccaagtcttactactgtcacttattatgttaaccatatagtcttctattttttcataatacttatcagaattttaattttgtattttgatatttatttgtttagtgtttgtctttctcattagaaggtgagccccatgagtgctagagtcatatcttgtttgttccccattacaactccaacacttacaatgcctcacaagaagtaggcactcaacacttatccattgaattaataaattagtaagtcacgactgctctagttttccattttctcatccataatggagacattacttacttccagtagttgtgaggaattgagacaatgtgtatgtaaaagagacaatgtgtgttttgtaaaccatacacaaaacattattaatgatggtacttatgatgtgtgcttgataataatatctgtcttttattgaggaacctattcagtggtaggccttttcaatgttttttttatttcattgttatcgtccttcatataggtaggttggtattttatccccattttagaaattagaagattgagtttacaaagaattacggccaactacaaggctagagggcacagtctccaagactgcactcacttctgacaccaactgcaactttggatgattcccaaaaccactcttatgtaggataaatcactagaaagactcatagaacttactgaaagctatcatactcatagttatggtttattgcagggaaatgatacaaattaaaatcaaccaagggaagaagcacatataccagaatccagaagtactaaatatagagcttccattttcctctctctgtggagtcaggacatgttactctcctggcatccttatgtgacagtgctcatggtgtattaccaaccagggaaacttacatgagccttgttgttcagagtttttattgagactcgattacctaggcatgactgatcatttgcccacatagttgatctcagtttctgggtagactgataccatccaatccaaagctcctactccaaatcacattgttagtatctgtctatcataaggcccctaagcaaataaaaattacctcctgggagctgagggcaaaggccagacctcttttggagcaattttaaattctttcttacagaaaggtgcagagaggtcaatcaacttgccaaaagttgcacagctggcacatgtacaccctagtcagcctccctctagtgcccatgctattattttccattgtgtgccctgtgtgcctgaaaaacaatgcagttttaatgtgctataaaataatgtataaccctatacatagaataaagaaaggcctaactggaagtaaaaaaaaataataggcagaaattgtactactttctcatctacctttttcctctcatagctctcaaatttgaaccttcctttattccttgaaccataacataggcccatacttggaaaagtgcaaagtggacaaaagtgggtagaaagtttgtctagggtatgcttccactctaccaacctcccctcttgtgcactagggcttataaataccctcatatgtgcacacatgcatgcacacacagaaacacacacacacacacacacctcaactcacaaaggggcctattttttatggtctgtctaaaaaattcaattttatgtgttaaataaaaattggaaatccttcctacggccatttgcttttaaatatgagcttcttaaacatagaataactatgatgacaaagaaattaacatcatttgatgagatttataatagggatttgtggttatagagtctccctgtgtctccaatcacagtatagccagccatcccatacatttgtgtgctagaagctggagaagggtgtggaaaaatgacaagtaataacaggagagggaaacaagaaaggaaggagggatactctgaagctctgaagtaatctgtacctattcagaagtggagaacagaattcaaggggccacattacatggaacatcatccaaagtttagataaaccagagtaagcctagcgaagactgaaagagaaggcaaagggtttggtacagccattttatttgttatcttttagatggaggagaaggagtgcaaaattatagctaacctactacagtggctagcagtagaaacagcacagaccttagagcgaggcacaccagagtttaaattccaactccaccgttaactatgtggccataggaaaattattttgcttctccaaccctcagtctcctcacttgtataattgatgctaatactaaaacacatctcctaggacccttaaaagagattaaataaggtaatgtatgcacagtatctctgaggtcagttaccaggtctttgaggtcagtattgcctggaatccttacttggcaatgggtagaggtgcaagtctgatgactagagcatgtgctgagccacctcctcagatgtggcaaaatgtgagtaaagctttgttatcctacttggtacaatggaaatatcttgcattatggggtcaatacattcaggtttcaatccaggctatgctactttcaagctatgtgacctacaggaaaatgtttagcctctctgtgactcagtttccttatctgtaaaatgggtaatagcacacatagcttgcaagttctgtaaaggacctatcccaatatattgctttcttatgctccacagtgtttccagagaccaaagaaagagcatcttcataaacagatagatccaataaaatattttcatgtaaactacatatcatacatatgcatatatatacaagatgtatatgtataaaaatatatacatacattgaaaaaattctttccttgagtaatagtggcaccaccctagttgaaatcaattgaccataaatgtgtatgtgtgtgtgttttctagactgtcagttctactccattgatctatgcatctatccttttgccagtattgcactgttctgattactatagctttgtaagttgtgaaatcaagaagtatgatactgcaaattttgttctttttttcagattgttttggtcattgagtctcttgtaattccacatgaattttaaaattaacttgttcatttctgcaaaaaaaaaggcagttggaattttgatagggattgcattaaatctggagatcactttaaagagtattgccatcttgacaacattaagtcttccaatctatgaatacaatgtcttacagcttacttaggtctttaatttcttttggtaatgttttacagtacttagtgtgcaggtcttgcacctccttgattaaatttattcctaagtatttttttcatgctattactaatgggattgttttcttaaattcattttcagatccttggatgctactattaatatatatttttgtataccaatatcgtatcttgcagctttgctaaactgttagctctaatagcttttctgtggattcctgagtattttctatatacaagatgtttctatatgcaaatagatagttttacttctttttttccaatatggatcatttttattccattttcttgcctaattcccttgcctgtcaccctgtacctccagtacaatgttgaatagaagtgaggagagtaaaaattcctgacttttttctgatgtttggaggaaacatttcaatcttttaccactaagtatgcttctagctttgtgtttttaatagattacctctattggattgaggatgtttctgtctattcttagtttgttgagtgctttttattatgaaaggttgtcagattttgtcaaattattttcctgcatctattgaggtgatcatatttttttcctttttattaatattacaaagctacagtaattatgactgtgtggtaatggcataagagtaggcataaagttcagcggaatagaattgagagtgcagaaataaactcatatatctatgtcaatttttttttacaaggatgccaaaagcattcaatgggaaatcaatagtcttttcaacaaatagtgctgaaacagctggatatccacatgcaaaagaataaatttggaccactttctcatgccatatacaaaaacgtaaactagctcaaagaggtagatataagagctaaaacaataaaactctcagaagaaaacataggcataaatctttgtgatctttgattggacaatggtgtcttaaatatgacatctaaaacacaagcaaccaaagaaaaatacataaatgagacttcataaaaattaacaacctttatgcatcaaaggacactagcaagaaaatgaaaagatcgcccacagaatgggagaaaatatttacagatcatatatctggcaagagtctagtatccagaatatatcatgagctcttataactcaacaatgaaaacacaccttaaatttttaaaaaggcaaatgatttgaatagccatttctccaaagatctacagatcaacaataagcacatgaaaagatgctcaagatcatcagtcattagggaaacacaaagtaaaatgacaataagatatcatttaatatcacatggaatggctataataagaaaagaaaaagaagtattggtaagtatgtggagaaactgggaccctcatgcattgctgatgggaggtaaaaatgtatacccattgcagaaaacagtctggcagttcctcaaaaagctaagcctagagtgttatcatatgaccctggcccaccaattatactcttgggcatatatccaagcaaaatgaaaacatatatttatacaaacacttctacataaattttcatagtagcattattcatattcataacagccagaaagtggaaatatcccaaatgtccatcaacttatgagtgtataaataaaatgtgttataaccacacaatggagtattttgacataaaaagggaattaaataatttatacatgatataacatggataaaccttgaaaacattatgctaagtgacaaatatcagacagaaaaggccacatattgtatgatttcttttatatgaaatgtccagaataggcatagagacaaaaacttggttagtggttgccagaggctgggagaaaggggaaatgggctgcgactatttaatggacatgggtttctttttgaggtaatgaaaatattctggatttaaatagaggtgataactgcacaatctcgtgaatatgccaaagccactgaattgcacactttaaacatacaaattttatgttttatgagttatgtattaataaaaaagttaatttttaatccaaaaagcactttgagaaaaaaattaaaaattaatatgtgtcagaaaaaaatacggacaatacaaaaatctatcacttgccctaactcttgccaggtgtatctgtgatactttaggctgcccaaccagcctttcacaagctgtagcagtttcaagatgccagggctggcagggcacagtggctcatgcctgtactcccagcactttgggaggccgaggcgggcggatcatgaggtcaggagatcgagaccatcctggctaacactgtgaaaccccatccctactaaaaatataaaaaattagtcgggcgtggtgactggcgcctgtagtcccagctaccgggaggctgaggcaggagaatggcatgaacccgggaggcggagcttgcagtgagccgacatcgcaccactgcactccagcctgggtgacagagcgagactcagtgtcagacaaaaaaaaaaaaaaaaaaaaaaaacatgccagggccccctcagagtattggcccaggtccaagctaattcagactgtgtgaaccttttcttctttctttacaacagaaattagcaagggtgtctcatttccaggaggggaagtacagaaaagagtactgtggttatatatctccaaagttagctaagatgaagctgcagattcaagattaagcaacattaaatttcagctgaaattgtatatctgtctgctgccactttataaaatttttcacttaagatgacacaaaagcctatttattgagttgtgtacaccattaaagtttaaaagtttgacatgcatatgctgttttttgtgtggcagtaattaactgtaattgaaaaatatcccattttttatggttctctgaattttcagtgatcttttcccctccctccttcctctcctctaactctgactgcttcaccataacataatcctcccctgccccacattcaagctactttaatagaaatgtaagcaatttaagtagggtacccgttacgtcacaaggttttaaaattattaaggctcctactctcctagtcgggtctatctttgagatatgtgactttatgcctggaaccatgggggagtggagctgggaaatatacccatcacatagaagaaaagggctctgttctataatattccttttgtccatctcaccttctctaagaatggaacataaacctcattcaagaaagatgtgtgaaaaacacttctgagatagcatatagtagaagaagtgtctatgccttcatcaggatccctgagaggtgaaatgtcctttttatagctggccaattctgaattttaatattatctccttcaaggagactcaggcctccttgctaaagcacagcttataattcttccacttgtactttctaggcaggatttttataactagatctacttttcttcatcagtctcttgctttctggcttcactcatttcatctccggttctacccataattcttggctgaattcccacttgatcctactactggtcataacctaccaggaaaaatccccatgggacatcattcactctgaaatatttttgtcttgcctcagagtcacagaaatttcgtcacctaagcaaggaaaatatattttcaaatagtaacatggtgtctgcctggacacaatttaaaataactcttaggaaaatctctgatcttgtattcccaaatatttggatatattttgatctgcaggtcttcttcatgctgttcatactttgtatgaaaggagtgtgcttcacaaagcatcagactgaatacaagaaaatcaatacgcaatctgtgtgataattaattaaggtgccagaatgaatgactttttcttccccttctgatttgggtcagagtcgtgtttgatttgggaagttgtccattttcaattatggtttgttctgtgttctttttatgtgaccagaatgaatgactggcagaaaatcatgttatggcaaaaatctatgggataagtttaacacgctgaagatgtggtttggcaaaagttatttccaagaaaaggctgataaatcagagtgagatcgtttaggagaaaggcatacctacatgtataggtaagactgtgatgaagccaactttattctctgtgcattgttttcagttttcacatacagtcattaagcaaacatttggtgagcaaatactctatgtcaagcattgtacaacgcactagaggtgcagctatgtataagaatgttgtgcgttcagaaaatttctaacaagggagagcaacattaaacaaagagtcccacacataattcattaagtacaattttttgtagtgctacaaagaagtatacagtagttccccattgtatcagtctgttttcatgttgctattaaaaaatagctgaggctgggtaatttacaaagaaaagagattgaattgacttatggtcctgcaggctgtacaagcatagtacaaacatctggtcagcttctaatgagggtctcaggaagcttacagtcatggcagggggtaaagcgggagcaggtacatcatttggcgagagcaggagacgggtgggagaggtgccacatactttttttttttttttttttttttttttttgagatggagtctcgctctgtcgcccaggctggagtacagtggcgcgatctccgctcactgcaagctccgcctcccgggttcacgccattctcctgcctcagcctccttagtagctgggactacaggcgcccgccactacgcctggctatttttttttgtatttttagtagagacggggtttcactgtgttaggcaggatggtctcgatctcctgaccttgtgatccgccagtctcggcctcccaaaatgctgggactacaggcgtgagccaccgcgcccggccgccacacacttttaaacaaccagatcttgtgagaactcactcactatcatgaggacagcaccaagccattcatgaggaatccacccccatgacccaaacacctcctaccaggtcctacctccaatattggggattacatttcaacctgaggtttggaggagacaaacatccaaacctcatggatttttggatgatgacaaacatcatcccttatctgtgtttcactttccatggtttcagttattcatggtacagtacaataagatattttgagagagagagaaaaatagaatacattcacgtaacttttattacagtatattgttatagttgttatagattttattattagttattgttgttaatctcttactgtgcccaatttataaatgacaattcatcatagatctgtatgtagacgaaaaacatagtatatataaggtttggtactatccacagtttcaagtatccactgggggtcttggaatgtatcagccacagataaagaagaactactgtaccttgtctagctggatttttccataactctaaagttactattcagactaaagccaggaaacatccagaaagctttctatggccttctgtacatgaaggctaagggcataaataaataatggatggagggattccttctcagggataaagtgagaggtctggtgacctcagtttggggtctagagtatcagacaatgtgccccaaccaaagaaagcactcaataatgtaatgcagctcattcccagtccaaagctcagcttcctttatgcttattttacttggtgagaactagttctcattgaacattgcccagagacaggttgataatgatgatcaagaacaggctgttagtgaactccagaggtggtagggctgatgacagacctaattctctggcaaggggatggccttaatgtctattaataataattctggattgcttggtgttaaaaatatcaggatgattgaatgaaggaggctagagaacatctataagtgaacagggtcctattcattctggatgatataggcatcaccagcctgaaggcaggggacctggaacagatctcttcaggtataagattctgtgaagtttaacttgctgaaggattaacactcctagaagaatggctgaatgccaattccactttccttaaatgtgcattgaaatagtacttgctggtgccaatttattcttagctctgtgggcctgcccatggatatttcacatagaggggaacattacttatatttgatgcaagggtcccagcctaaaggtgctcacagttttcataactcaatttagtgtaattatactcaacttagggaatgaacaactcccgattcctctccccagtgggcacatgattaattggcttagtgacgaaaaaaatggcttcaacacagacctaagctctagtgggctcccagaagattaggttttaaatttcgatagagtttacttggccctctgtcattaaactgggataagtcaagtttaaaaaccaaggcctttttatatcagcaagggcagaaaaaccctaaagtaaggacaagagtttatctagcatatatgccagacagatgccaaatgccagttgactagcacatctttatggggaaggatgccgcattttaataattagccccattttagaataattggcatgtagaatctttttgagatcctttggagataacattttttaggagtcattctgattctatttgcatgttaagcccttaccagtatctacttggtctgggctgttgcaaatgtaatgatcttagtcatgttcagtcatttgtgtaaccaatatactatatacgtaagtgtatttgtagccatctgagcatgaatgcatgtttcactccctttgtgagaatttggagatgttaaaaaaaaatgggcgtctgtaggaatggtgtatcccctttggcaggtatatgttgccactccacttacatactctgagaactctacaatcagggatttaaagacattgcttctgttaaatgttccctctaaacatgtatgtctaactgggggtaatgctttgcaaagaacgtatgctctagaaaagggtggtttcaaaatcagttattgccactcagcctgcagtcatcatttagctgaatgcaggaagcagggcttttttacgtttgactcttccataccattgtgacccccatgcctaattcaggaaatgatgtggaatagaaaaattaaatattttaaaatgcgcaatgtgtggagtgtggagagagacactatttaaagaacacctatagggaattcttagtcccatctagttttcgagagtagtcatgcagaaagtggtaaattatacatttagctgggcccaagtttctgaggagtcaggtgttacaagtctgatttcatgtcatcctcttccagtttagctgactagtctaacccttcacccacaccaattgtgctctctgaaggatttcagtttagctgtatgctaggccaggaggtaaataaaggcagataaagttatggcatccagttgcctcagctcttgaaaagatttgattctgactctaccctccccaacacaccgcacaaatgctatatcattctccttcatcctgtacaaatattctgtttctgacaacccacatattctcaactgacttactagttatttagccacttatattaatcagggttctccagagaacagaaccaattgtgtgtgtatgtatgtgtgtatatacatatgtgtacacacacttacataaccaatgggctacatgttagggcatttgtggctatctgaacatgaatgtatgtttcagtctctttgtgattgaaacataaacacatgtatgtacacatgtgtgtatatatgtgtatatatataaagtgatttatcataaggtattggttctcattattatggaggctggtaagtcctataatctgctgtctgtaagctagagaataggctattgcaataacccaaaatgaaagctgacagtgatatgaacctggtgctggcaatagaagtggtgaaatgtggttggattccacatatattttaaaaacacaggcaacagtatttgctgatgggttggaatgaggggtaagaaagatagtagtaaaagatgatagcatggccaagcaaaggaaaggatcaagttgctccttactataatgaggaagcctggaagaggtttttgggggtggagaaattttgagcacagttttaaacatgttcagtttgccaccttttcaatattaacatacaaattagatgtgtttggtgcctggaacagtgcccagaatgaggcccgtactcagtaaatagttttaactgaatgaattaatactctttaagttctctctgcctcctctcagttacaaccacatcatctcaccaagttagtctgcttcttcattataactgattctcacatttggtgttaagtgagcctaaaaacacaactgatgatttcctttgacctctttctaagataactctacttagtctcacatactttctattttctgggagtgtcaagaaggccctgtttgctctggtttcccatctgtgagcaagaaaaacaggtaggaagcctgttattaatcttcttgcatcaatacttacattgtaaacctatgccgccatctttcattagtcacagagaagactaattacattgactagactgatgaactcagtatgcaaatgttcatgtaataagatggtctgcccaattttctcctgcagttattcaaatacctccccaatgtatagcaaagccagaaagtcctacggttcactaatgttaaaaagtatatatgtgtgggcttctgggcctatggatacataaatatgtaaaattggccatctttacaacttgatggtggtcaaagtagaactaggctagggtactgggaccaagaaaggcagttaatgtgtatgagtgtcccctaagggtatgatatttgacagggatttgctaaccaggactagcacagactagtcattacaacctgaaggaggcacagtcatccatgaagattatttctgctgtgctgagggtaagctgaagataaagggtgttcctggtcccataataaaagagaaacaatgaattattttgtataaggcagttttcaaacgcctgggtaaaagtctaccctggtggcttcctttcctgaagcaatggcgttaatcactggaagttaactagcaggtccaataactgtagtcacaataatgagaacctggcaaacagtattttgttcagaggagtctgagcttcagggcctgtcttcattagtgggttctagtttagctgagagttgtgggctgagcagaacttcaagctctttctgagccccagaccagctatagtctcagaaaaggattttgtgccattaaaggtgggtcattagctataagcgttttatctccaccaagaggggtaaatttcccactgattattgtgctctgttttggagaaagtttcagaaaaaaacactagtgacgaagctttatagcagatgttgggggtggagagttattttgttattttttgtgtgcatgtgtgtgttggcaggaaggtataagatctaaaaattaaatttaaaaaacataagaattggaaagtaaggaacaaatttattgaaatctggtgagtgtaactggatgaacaatggatgtaaagatgaacagcttctcatggccaaactaggactagagctcttagctggactctggagcagtcagggcacagaaagaactcactgatccctaggcaaaggccaatggtgctaggggaccagagagggaagatttgctcagcaactcattcattcttcattcatttattcatttaacaaacatttattgattagtcactctgagctgtattggggcctcagtctacattgatgaatcaaacaaacgtgacctgtcccctggaattcacatcccagtggctgaaatggacaaatatgtagggaaaaaatacagtaataaaaagctgtgataaatgctattgaatgctgaccataaaatagacattgcacaaggagatttaatctttccacttcaaggcaaggatagaccctgtcactctctaacattttttaattacttgaaatgatttaattcttaaataatatatttattttctgttttctccaagtacattgaaagccccctgataacaagtcttgttcacaattacatgtcttgttcactgcagtgtctttctcagtgctcaataattacttgttaggcaattgaatggatgaattttttattatcttcatgttaaccctgttagatgtgaaatacaaaaatcaattatgcccatcttatagatgaggatatgaggctttggaatggatctggatttgggaatcagcatcttattaagatataactactactaataataatgatttattggatgctcactatgtgtcaggcagtgtgctaggttccctgtgtggatcatgttattgaatcctcacaacagctctgtgacatagatgctattattatcccctttatatacatgaggagtatgaggatcagagagataaagttactcattctagatcaagggggtgacagtccacaactaatttgaatgtctgttttgaagacctaggctcactccacccactataccagagtgcttgcatggcctttatctgttctacaggagaatgccaggcagacactgtttctgacttactttactacccgttgggctcgttagtttggtttgagtacagaggaggaaactagaaccagttagttccttatggttacatagtcttttatgacagagctaaggccagatctagggcttctggcttccaggccagttttctttgatgtgaccacgtgatctcttttctcagtgactttgaaatttaatccctcctataaaggtttcctttctgaatggggccacaaatattaaaagctccttgtactttcagaaacttgaaccttatacatgatacttgtatatatctgagcagcccccaattcgatatttcatattgagaaggaagaaaatgacctgagcaaagtagaatcaaaattctcctcatcctgaaaatctaccctcagctttgtagtccgccaaataagttcctggacgatttgtggaagagaagtagcccaaaagactgaaaacaaaagcacactgtataaagacaggtaggcagaatgaaataactaaagattcaccggtgcagagatagtgaaaaagcaaccccctcttcagtatggatttcaggagcctcaatgcatgaaagtcccatgattttcttcttaaaattatctttgtatgattcttaagtttgaaaatgtaaaaataacaagaataagaaaatataaaaaggttatggcaccaactgtttgtcactggttcatttattactatagctgtcacctaaaaatgtatgaagaatgtgacatagaagagctaagttcaggtgagagaacatattcatggttaagagcatggcctctggagccattctacctgctttggaaaccgggctcttccatctactggattggcagccatggaggagtcattttatctttttggacctcagttacctcatctataaaataagtactagttggataatattatattactatatattatatatgatattatgtattctgtttttcttaggtcattttccttcttgtcaatatgaaatatagaattggagtctactcagaaatatacaagtgtcatgtgttaagtttaaggtgctgaaagtacaaggagcttttaatatttgtagccccattcagaaagcaaatctttgtaggagagattaaatttcaaagccactgagaaaagggataagataaaatagtcgtgctgaggaaaataatattatccacactaatacctacaacctagagtttctgtaagtactaaatgggattacaccaataaaaggcttagaacaatgtctgtcataatagtaaatggtaataatagtttttattacatgggggaaagatcataaaattaaaatttatttccttatattctaccatgcatttcacatttattgatctctccttctgggccaagcagtgtgctaggcacttgacagatggatgagatgcatcccctgccatcaaggagtatccaatctaggagaacacagactcatacacaactgattataatgatatgtctattcccagtaagcatttccaaccacaggcattatttgccatcatgtatctctttctctttatcacattgctattcagcatacagaatgttaaagaccagatggtgttaagctgcccattttaggactagttgtaaaagttcactccttatctcacatttaacacattatcttaatgagaaaaccattcacaaagcatttacggagtacttactcttagttggtaccttgagaaggatataaaaaggagtgcagctatggggctttgggaaaagcaccagacttgaagtcagaaatcttgagtttgagtcagggctttgccactgatcaaattgattgaccttggatgagtcacctaaaaactgtgtagctgagaatattaaatgaactagaaaataggaaaacagctggctttcaataattttccagttattcagcctttcattttttcagtataagacacaagacactgacgaattaatgaatgtcagtaagatggacgaattcactgtaaaagatatcaaagcaattttgtgattaacatagctttctcctgacacctagagaacccaaatgataaagtggggagtttgaagaagtaagcagctgagtgcttcaggaggattcactagtggtaggtgcaggatggctttttggctggggcaacaatggagggtcaccacttttaatgaattcattctttttgagaatatttagaaagcaataaaaggtcaaatctggcatctcatcctcccatccattatcacgtcactgaaattgacttttgctaagttcaccaatgactttattgtcaatgaaaccaatggtcacttctgaatcctgattttatgtgactgtttagtagtattctccatagttggccactctgtcttccttgatacagttacttccttggacttctgtaacacactatcctgatatactttacaggtgctttttctcagtctcctttttgagcccttcttctattatctaaaaattatatggcagaggtcctcaaagctcagttttttctagaccctctttattcttaccactctaccctccctaaattcagttaccatgtatacataaatgggccccaaatccagctctgctggactccagactcacatagccaactgccttgtcaacatctgcatctggatgtccacatcctacaggtatgttaaactggacatgtcacaggatgaatttatcaactcactaccctctgcaataaccttgactgtacttgactatactcctcttcattcctcccaaatcaaatgcaccagcaagttctgtttttgttgttgttgttggttttgtttttgagatggagtctcactctgttgcccaggctggagtacagtggcacagtctcagctcactgcaacctccatttcctgggctcaggtgatcctcctgtctcagactcctgagtagctgggactacaggcctgtgctaccatgcccggatttttttttttttttttttgtatttttggtagagacaggtttcaccatattgcccaggctggtctcaaattcctgacctcaggttatcagcctccgttggcctcctaaagtgctgggattacaggcatgagccatggcaaccagccaagttctgtcattttttgcaccaaaatatactttggctatgttaaagtctcttaatcttctctgccaccaccttagtctaagcctcagtggtgtctgagctagaccactgcaacattctcttaactgaattcagcatatatactattgccatttgcctggatgatattttacaaacgtaaattagataatttcatgcccttgtttaaaacttttaaaataggtccccattatccttagaataaagccccaaataattactatgctctataaggccctgcatgaactgacctgtgtccatatctctgacctcatcttgtacctttctcccatttgctctcccgcttcactctacaaacatattgggcttcctgtctcagtgcttcagcattctctttctctctccctttcttacatttcagatttcagttcaaatatcacttccaccaggaagccttgcctccaggctagcttagtctacctgttttgtgttccatagaaagctgcactctctctttttccctctcagaacccattttcttacttgtttaatgttttccttctccattagactcttaagtttcatgaaggccagaactgtgtctgtctaattcaccaagcacgatacctggaacatagcagatatctttaaaaaatgattcttacacaaatatccaaagcagcatcattcataatacccaaaacgtagacactgcccacatctgccacttgatgaatggataagcaaatgtgatatatctatacaatggaatattatttagccatgaaaaataataatgtattgattcattatacaacaaaaatgaaccttgaaaatatataataaagaagtgagtcaccaaagatcacacattgtatgattccatttaataaaaaaaagtccagaataggcaaatccatagacacagaaagtacattcatggttgccaggtgctgagaagaggggaaaatgagaagtgactgtcaacagtatggaattacttttggggatggtgaaaatgttctaaaattacataggggtgatggttgtacaactctgtgagtataataaaaacaactgaattgtacactttaaatgtgtgaattttacatatgtgaattatatctcaataaagctgttaaaatgaattaatgagaataatataaactatagatctgacaacgtagaaaaatgctgagtgacttttaatttacgagagagcaaagaaacaagaaatagtaaagcttcatctcgtgaattgcacacacttatttcatgcaactgcttttacctccttaggaaccggcaactgaaagagaaaacatgggtcctaaatttggaaaggacctcagagattatgtaattcaactatctcactctacatatgagaaatggaggtgcagagggaaagtgactctacaagttcgcacagcaaattcatgaccagacatatacgaaagcctttgtctcctgagtctcatttcagggttctttccatgatacccagccaagtcagcttccttaagagtttttccagtagcccttcacaacttccgtttacaaagtagtaatccctatctgcaagggaagctgtgagatatagtttctgttagtaaggaagaaagggagaacgaccctttgggaggcaacttgtattttctgccacaagttcttttgcggaaaattttggattggccagtatttagatctggaagaatccaatgttctctgctgttacctctgaagtcagcatgaacatttccagtacagtgtgaatacaatagccacacatggaacccctttcatgataaacatctttagccccagttgagagtctccacaattcctgagcaatttgcatttggcagggctgtgtgcaagacattactggctcaaatgaatgtaaatttactttagaaacaaatcaaggtaacattcactatcctggaataaagaaacaaggtgaaagatccttttagaatgcaaattgcaacctgttttgtaaaaatactgagtgacagcaggcacagtggctcacacctgtaatcccagcactttgggaggtcaaggtgggcgggcacgaggtcaggagtttgagaccagccttgccaacatagtgaaaccccatctctactaaaaatacaaaaattagctgggcatggtagcgtacacctgtagtcccagctactcgggaggccaaggcaggagaaccgcttgaacccaggagacagaggttgtggtgagccaagattgtgccactgcactccagcctgggcaacagagcgagactccacctcaaaaaaataagtagataaataaataaaaataaaaataaaacatggagtgactttacttgtctttttaaaaaaataaaagtttaaattttctttcctacaggttttttactatatctaattacactggctttggaaaagagttgataaacatggataatattttaatttaaaattgtttaaaaatgtggccaggcatggtggctcccgcctgtaataccagcactgtggttagaatgtaacaaaaattgcaggaattaaaaaaaaagaaaatgttttttaatcattcactttacttttgagcctagtggttttaataggatgtaattaacaacattttccatgtttttctatttgttttctctgcttgttgcaaactacctctttaaagtaaaattgtattggagaagtctagggtacagtggcctcttctcttgtagtttgcaacaacttttccccaagtaaattgatactaatggcactgaaaatacctggaagcttgatgtctagaggacaaaaaggaaagagtggctgcttcttccctatatactgtatgctaacaaagaaaccaggtctgcagaatccttttaactttcttgacttagtttcatatcaaccccaaaagtcatgtagtattgaccatttgcagaacagagcaatgacaacaattcctccagataagttaattatctgcattaaagaatgcctcatgtttcttgatctactaataatattagataacatgggctattccaaggcattttaatgagtaccctggcgatgacagtctttgggaaaatatttctgacttctaattaactttaaaagtttccttgggcattttttctggttgttgttgttttgaaactgagaatgaaagaaggaaattatatggtagacatttaatgcattctttctgaatctttctgtagatgacataaattaatggctgttctcatttttcatgctcccatgcatgaaaagaaagaaattaagacaataatgttatttaactattataagaggaattcatctttgatcagaattatccagagctttctacctctggcatctgtgtactttactgagacacctcctgggccaatgaaccaactcaagctctgccaaatgtaaatgtttaaattttagtgattccggccccaaatcttactgtctatatccacagcattgggagaacacccttttctgaagcataagaaattctattacccagcagcctgggataagttaaattagtcagtagacaatttcactacaggagtatctgcctctaggaaaaccattaattttgtttaaagtgactgtgtcacaattattgaggacttttcaaatttttctattgccagagagtcttgcttaaagagaagaatgttgattgactacataatttttcttgctcctctcctcctcaaaaaaatcacacacacaaatatgcaaatatgtacagatatttaactcaattttgactgacctttcaataagttttctggataattaaagtagggcctttataagttaaaaagataatcaaaactgtggtactggacttatgctatgcacgaatgacagtgtctcacataaaggtattatatagaaaaatgaacagaaaagtgaataacaaattgtacgaaatgtaaggtgtgtggtctattaatctaaagtacaacaatctcactgaatatacgtatcagcttacatttttgatgttatgtttcagtttgcatttttgtgaacatgaaatcctcaaatgcaacataagtctgtgtgggtcaagtcggccatcctcactgcacacatgtgcgaatgcaggcatcccctgaatccaaaattgttacaaaagaaactgctaaagtagattaattctgcatgtagctttcttggtgcccttaagggcagcaagtattcctccagggaattatgtatgttcactcttcattgttttcctctaaagggatcatattatcagtgaaagaccctattggtcccaggcctactttagaagtgtcttttaaaagattgctaggccttcctaagaattaaatagaagaaaaaggcagtctgtacagatctcacctctggtaaccaaaagcaagcatctttgcagctaactttgcttctgttgcaattgatacagggacaaatggctgtaattatataggggaggataccaaatctctatttagagaccagagctctattagcagtgcattttccagggtctgatgactagtaaacaggaaataagcctatctaccttgaatgagcacagctatccccctggggagttccattaaggataacagtgatgatggtatgtgccactactgggcactcttctatgcagcgcatgctaagtggaaatggcattcttttctcagactctctgctcacttcctgtactgtatataactgcattatgagatcttgggtgtccttctacagaggtaggaccaagtgttctttcgaggattgagagaagagagatttggaggtgggacaatctagccaaataatcttagtcactttattattcataaggatgttaaccaagagttccttagtagcaaaatgagattctttatgttgtcagttttccaaaatatattccacttctctctgtctcagagcaggccttttcagagtagaacattgtgcctccactgaatggtaccttgctttggctttgaagtctctctatcattttgtattcctaactcctctccccaagtctccatctatctgtcctgaatcctctctgacagtcatcttattgtagattatatatgaaatgaaaaccaactagattttttcagttattgctgttgcttgtcattcctttttcttctccatattctgacttcagatttgaggaatggctacaattcttgattatctatgataattgtggggcccatgaaagctatttattcaaagcacaatgtagaaaaagggagggctttagagttgcacagctctacactgaaatcctatcactatcccttactagttaactgattttgggcatattaagttctctgagccttgtttacttcctctggaaaatgagtgtgaaggactaaatgtttatgctccccccactaaaatgtatatgttgagattctaacccccaaggtgatgatatgaagaggtggagcctttggaaggtgattaggtcataagggctgagccctcatgaataggattggtactctgaaaacagagacctcaaagagttccctaagctcttccgccatgtgaggttacagtgggaagatggttatctgtgggggaggaagccctcatcagacaatgaatctgctggcaccttgatcttggacttcccaacctgccgaactgtaagaaatgaatgtatgttgtttatgagctacccagtttatggtattttattatagcagcctgaacagattaaggcaatgagtctaataagaatatctactgtttggagttttaggattgaaaattattcccctttgcatattctgagttaggagccactctttgagtcaggcaaatggagatacaaatgtcaatttcattattaataaagttgatttaaaccggagactgattactgctactactttcctactcatccaccttgaattccaaacttacccagccaggcagtcatagacagaactgtgcaactgtggtcttgccctacaacgggaaatccttccccaaaaactttactaatggctaggctgggaatttacaggttctccaaaagagagactgaaaactcataagtgaatgaatcatacctgctcagtcccttctttcaatgttgccaagcagctttttcccctcttcagttaggcaggagtggtgagggatgacttggaattgctcctcccctattctttttcttctctatggaaacttgagcagtgaggcacaagagttgtcttattaacagctaggattagtgtgaggattaaatgagataccacatgccaactatcttatatagtacctggcacatgatagaagttcagatggacaatacaggaatcaaaatccagcattactcattagccatgtggttttgtgtctggaatttgtgggttcttggtctcactgacttcaagaatgaagctgcagacccccgcggtgagtgttacagttcttaaaggtggtgtgtctggggtttgttccttctggtgttcggatgtgtttggagtttcttccttctggtgggttcgtggtctcgctggctcaggagtgaagctgcagaccttcgtggtgagtgttacagctcataaaggcagtgtggacccaaacagtgagcagtagcaagattcattgaaaagagcgaaggaacaaagattccacagtgtggacggggaccagaaccggttgccactgctaggttgggcagcctgcctttattctcttatctggccccacccacatcctgctgattggtccattttacagagagccgattggtccattttgacagggtgctgattggtgggtttacaatccctgagctagacacaaaagttctccatctccccactagattagctagatacagagtgtcgattggtgtatttacaaaccctgagctagacacagagtgctgattggtgtatttaaaaaaccttgagctagatgcagagtgctgattggtgcattcacaatcccttagctagacataaagattctccaagtccccaccagactcaggagcccagctggcttcacccagtgggtcccgcactgggccgcaggtggagccgcctgccagttatgcgccttgcgcctgcactcctcagcccttgggcggttgatgggactgggcgccctggagcagagagcggcgctcgtccgggaggctcgggccgtgcaggagcccatggcggttggtggggaggctcaggcatgggggcgctgcaggtcccaagccctgccccgcagagaggcagctaaggcctggcgagaaatcaagcacagcagctgctggcccaggtgctaagcccctcactgcctggggcttgtgggccagccagcagctctgagtgcggggccgctgagcccacgcccacccagaacttgcgctggcctgcaagcgcgtgcgcagccctggttcccgcctgcgcctctcccttcacacctccctgcaagtggagggaagccggctctggcctccgccatcccaggaaggggctcccacagtgcagccgcgggctgaagggctcctcaagcgcggccagagtgggcactgaggccgaggaggcaccgagagtgagcaagggctgcaagggctgccagcacgctgtcacctctcagttttaggtaatttacccaacctttctgaacttcccttgtttgatctttaaaattaaggtaataacaattagcttgcacagttgtaaaaattagagaaaatatctgtgaagggcctggtgcatagtaggtacttagtaaactgcaactattatcattatcatgatccagttgtataaattgatttgtagattgtgtcctgcatttttttttcccatagcagattgacatagcagtgctcacatttatcaatgggaatagtcaagggttgaattggtaaaagtgtagctgagaagcaagtccaggacccaaggcaagcattctgggaatgtaagaatttctgtggctcatccatagagcagcaaacctacatgtaaatattttagaggtgactgaagtttgaaacgtccttttgtaatataagtatatttttgaagattaaaaaaatatttgttttgcaaagaacattttttcccatatggaactaattttttggtaggaaattagacttgtagagacaaggttttcatgcctttcattcttttcaggcttacaaagtatttcctatctggaaccccagttcttggccaatttaatgttgctgacaattgtatttggtaggataatttcagtttcacctaggttcagagaataattgccaatatatttcggaaagactctcttaaaatgttaagtttttccctagagagcaatctagtacaatgaaatcttcttgaaatattatttgccaccattttagaccttccagtttggtgaacgtattactgtcatacttcattactgtgtatttttggtgtacctttcacatcaaaaccaccattcaaaacattttgtgatttaaaagtacaaagtcttaaaaaagaacatagcacttcttcttatcagaaatccagcacagatgagaagatttattgtctgatagtcaagattggattgtgcagttgtttgtgagaaaccagtggatttgatcagaaatggaatgagtatactgatgtggcagagagaatggaaaatttgggttttgggtttttgacttttttggggaaaatgtctctaaaacattgttttcttaacaaattaattctaatggaaaggtagtaatcatttaggtttaaccactgaaacaaacaagttgctttcccagagttgacacagacactcaacaggtgagtgaatgggctctgtccttgaagctgtgtccccacccaaatcttatcttgaattgtagtttccataatccccacatgtcccgggaaggacctggtgggaggtaactgaatcatgggggcagttacccccatgctgttctcatgatagcgagtgagttatcatgagatctgatggttttataaggggcttttcccccctttgctcagcacttctccttcctgctgccctgtgaagaaggtgcctttcttcccctttttcttccaccatgattgtaaggttcctaaggccttcctagccatgcggaactgtgagtcaattaaacttcttcataaattacccaatctcaggtatttctccatagcagcatgagaacagactaatacatattgctcataagagggactgagtgagagtaacccagctacactactgtataaacaagccagagcttaagggatattgttgagatcattaatatcatttaggtacatgaagtacagtgacccactttctaccttccagaactaggcagaataaagatagaaataaactcttcttttaaactgtctctgttagttgttgcctgacagacttgaagtcaatgttggacccataaacctcaacaaatattcaaagggaaattccaaaatagttgtttaaagtggctaagttttcaccccagtgtagagaacaaaatagtctgtatgtactgtgactgtgtcaagaaaatatttgaggtggcattatcaaacaatttaaatgtggtctttgatgatccagaaacaaaaaaccaccagagaagtcaatctgttattccaaaggtcagggccatcagccccagtagctgaaaaaaggaaataatgcaaagagcttctggtcctagggctgatcaagtgagaggaaaggacatccccaggaagccactcttctgtattcttggctcagaggcagctggtaatgccaagtgagttacatatttactccattcacaaatgtgcaagtaaattgaggccaatttgtgttaggattaaatttattccaaagaggtgctcacttgagtggtcctagcaagccagccatttttagttacttcagctctatgggtaagtttaggaataccaaactagcaaattaagaaggaaaaaaaggaaaaggaaaacatgttataaaaatctaaaatctccatggacttttgagcaatttctgttgttcttctgaaatgtattgcttttcatttctccagatttgatgtttaaatgatagctgacaattcctgtttgggaaaactcatgcacagatagttattaccctgtaagaagagatgtgagcgtattcggaaatgttcatcatgtgccatagctcaaaaaacatatggtacacagccccaataaaaatgagatgcagaaattaaaatgggcgggtgcttctggtttttgtttgttaactgcaactatgtaggtctaaacttcatggttttgtaggtaagttactgatacagtggttagccgtgccagtgtcttggggacaagccttatggatcccagtattgcagaaaaaccaggctcagtgcagttgttacatttcacaggacacactttgacctgtgatgtagccaggtttttagttacaagctccatcataacagggctctgttgtgttttgtacagttcaataaatcaatttgaacagatacatctcttgttggaaagaacttagatactttttttttaatgagggagcaagcatttgaattgaaggatttgaatacaaattgaagtatattcttacatgtcttagagattatatgattgcaaaaaacaggaatcttcacaagttaagcctagtaaaggagaatgcattttagggtaaaggaagtctcatggaaccccaactcatgggggattagaaattgtcaggcagctagctcatctttccatctcttgctctctgtagcaacacaatctgtcatctctgcttctttctgcacagcggctcgatcctgcattctacaaaatggcttcctctgcctggctcttaatttctacttccccacacctccagctcagctgtagctttaggttgttgttgcacctattctggccctaaatgtttttgacctaatgctttcggtgcccaataacttctgacctatttagtctttgttttctctttgttcaaattttcaagaaaattggattggcttttgccagtcaacaattgattcactcccagcatgtgtgtccacttaggcagtgtttgggggaaaaagtgttaacaaaaaatgtacagctgtaagcaatgtagtttaaactaaaaagttagttggatactgtgaaatgactaatgtatcaaatacatccattattgtaatgataatgatgataacaatgactatagtaattaaattactatagtaatttagtatagtaattaaaacagctacatttatggaactctttgtaagcttattatatagacttatttaatcttcacaacaactctaaggagtaggtattattactgtcccagtttttactgatgggaaaatttaggcacaaagaagtgacttatccaaggtcacatggccattaagtggttgaacaagcctcaaacccagacagtctgacactagaattttgatgctctactgatgattctgacactgttacaatgaatttgtgaaatgtggggctgcaagatagcttctttgtgaagaaaaaggaaaattcatttaaaccagcaaaacctgtatgatacatactagatatatatatttagtccctccaatatcctttacccagggagaaagggattaggatctcaagaaatatttgtgtctctatgtgggtggaaagagaagaattactctctcatctgagttattttagtacttttagataaatgaaataacctttaaatattcgtgatcagagcattacccaattgtctctttgccttcatatttatttgaattcaaattaaatctgccttttagcaactatcgagaataagatctggcactttggagtggaagccaaaactggtatgtatgtgatgttactgccctcttcccaagccaccattttattgctcttctgggaatccagttaaattacagctgctgatatattgtggactgaggatctaaattcaggctttgaccaagtcatgggctggtttctttgggcaatatttcacttcctgttttatctgtgctgtcacctaaatttagcacttagactatactccccgatgtctgcagaagttttaaattattttccagtgatgcataccgtgtctatgcagaattgagtgtgacagatttgcagtaaaatcctggagctctccaactcctttttaaatgaattagatcagtagctctcacggatttgacttggaatgggttgtaaggtgatgtgtttcctgcaaaactgattgagttctctttggtgtccttttttttttcctctgctgtgcattttaccatttggtggactaatcagtttcttaaaagcaaaagatggatgctgccttctaaaccatgggaggtgtcaaatgcctgctgcattaagaccctttcccctacttgcaggaatgatagctatgggcagaactgtaatagtgttctaaattgagaaatcttgaataagacataaatctaaattccacacctttcttttttaatgtgggcttcaacaagcgtcagctataattggtagaacagcctgacctattaatccatagataaaaatgattcaattaaagagaaatataaatattgaaggtaatgtaaaaccaaatgaagcacatcaccgaatttatgtgcaaataaattaacttgaataaaaattctccagtacatacaatgtccatatgctgtcttggtaatgctataattaagtcagagagtcatgtcatactggccttttccatctgctctgtgatctgttaagggacccattcaaacagaatgacagctgacctcaaaatgatacactctactactgccattttaacagggctgttggttatgcacattttgtcttcatttatactgggctacgagtgtttttccattaaatcaagtaaattggagcatgtggttttctattaaataggtttatttaaaccaatattttattttctgaataaactttttttttatttttcagaagcaattgattgtattggagacatttttgttttgttttgttctaaattcaagtggtgttagaaagaaacagtgattaagaatagcaaaataaaggcactcttctctttttccttctaattcttgttattcgatcaaagcaaagtggttaattcttggagcctcaggatgttgtgtatgtaattgacacaaaagatgtgtaaaagaggagccaatatttataatactaattgatttcatttattttacttcccttgtgtatgcctcactgtcattcttgccattatcttaatgttcttgtttccaatagcactcagaaaagtcattttaaaggcaggggatctggagcacagatgtgtcaggtgtaaaggctctcctccacagagacattcaaattggctaaaggaaaccccacggaatagtgcagctgaagatccagcatttgtccatctgtttatatccaggttaccttgtgacagtctatttaatttctggtccctggagtgtctctatttcaatagtacatgcatatttcttttattagaactgcagaaggggaaaattggtaactcttggaaccaggatgacctttagaagattacatttttgttttgttttgaacaaataacacaagttctacaagagggtttgctctagtcaaacactcaacttcttagagggaattttaaatgtctcctatttggccttggaggaaaaaaggaagaaagaaataaattatacttgcaatacaacagagagtgcttagaaaatgggtttaaaatatattacaatttaaaaactttttaaagtaaaacccaagccataccagagacagacagtatccatagagtgaccaagactgacccacataagaggctggagaattacaaaagatgatcatcagacagatgcccattgctctctggggaatcttgaccttggcatgttggtttctgaattaattcagagaacctaatttgccaatgtggaaaagtcacataatacatggtatcttatttataaataaaaatccagatggaatttcttagtaaaatgtatttaggtaagtctacaagggacaaggaccatattcttttacttatgcagtctagaaacatttgctgagcatctaatatgtccctggcattattttagcttcaaatgatgtgttagtgagcaaaatgaagtctgtgctctcataaagctaacattacagtgtgggggttgtgggaaggcagacagtaggcaaacctgttatctgttctgtacagggcccaggacccattaattagccttgcatctggatgttggttcaaagataaatatttatgaggctttcctgaaattgtaaactttatacccaagagcatcctgatgagctaaaatgaaattgaccacatatactcatttcaatgaaataatgtttgaaaaatttcctttcattttgcccaagtccatatagtactttattgtagtgtggtgaaaaggatataggattagattctgccaagaaacttttacctgaggtatttatatcccagtggagagaaacaatgatgcctaattaaaagataaagatagaaaaaaggggcagagccagagaaggaaaaatagggagtaggggtggaggtagggttaggaaaactttattcctgcaatattctttaaatatataagaatttattttcatatcagggcaatatcctagtagcttagtttagttggtgagagccccacgttaggatggcatcatagttaaagattcagttcttatttgaaccagttagcttaaatctatcccatccctttaacccaaccagtcatgatacgaatatcagccacaaatcacaagcagttgcacattttccacactactggaaaaaaagaatgaatcaaacacatcttctttctgtatgatcagtgaggcatgagaataattggtagattgatgatctgagatgtagttgatgagttagaaccatgaattctgccagacctttggaacaaagcatattaaatagtattttttttgtgggtgccaatggcagtggtaacatgggagaggattatttaaaattgtgtttaaatattcaaagctgtatgtgctaggtatataagtgaactagtatttctcttcccttaagtaacctagagataggactacatttatcaacgttctctttttatctccttctgcagtcttccttcaaaacctacaggcttttaaacaaagaccctccatgactcttatcaacatatctgttcctgggcctctcccaaaatgatttagagataaattgcctcaaacctggcttggtttaatgctataatccattatggttccttttggaggtagcaaattctcatcaacttcattcttattaatcacctatctaaatgtagcatcatcagaacaatttcagaggtttttaaggcacaaccttgacttcctgtcatttgtaaattggcttataacagtcctggcactctgctaaagtgcttaactggtcattattcctccttgtactacatagcctttatgctgccagtagcccatctcgcctttctgatgtcccatcatattacctttaaaacagtaattttgtttttttgaactttgtgatggggggttagagtaggtcataggctatttttgagaatctagagaaaacagaaatctctacacaggagaaaatatacatgaacatatggttttgtgtacactttcaagggatttgtaaacttgtgaagcccatccatatacctcagagtacaaagtcatggcgtcaagattatatgatttacaaacatatttaattgaagtaaaccccatatatgcctatttataggctcataaatgttataacatttttatttttattttatttttccatctaaacttcctccactcagggtcagatttgcattgtggtctgccagcttttctagtcttctttgactccctcctcattttctattacaggaatttcccttaatgacattcttgcatgttcaatcctttcttggcatttgtttctcagagatcctagactaacacattcttctactacttctataaaaagatactatcatattataatatttttaggactattaagagaaggtgtctatttctgttttttccatttctttgaatttcactttaaatttttttcacctgctttgaaaaacgtgattgttcattaagttagccacagtgacaagtgtataaaatttgaataaaatgttcctggtatgtttttatgattcccaaatgcattttctttctcctttctttccctcctttcttttctttctttccttccttgcttcttttcctttcaattttatttaaagattttttaaatgtatgttacaccttacaaaatcatacatttatctaaggatagtctgaaattcttggttccaatgacatttcatttgtgtatggtactttctttaagctgcttgttgttgatttccaggcacttaaaaaagagaatactgtttgttaagttccaatatatttctgtgttaaaggtacaatggttaatgttatcatttccatgagtgaaaggggttgtctgttttattttctaccacatatattcccagaacttagcacagtgcctggcagaaaaaaggtgctcaataaatgtgtgttgaacgtataataaggcattagagcttataccttgaaaaaaacttaatgttttaaaaagtcatttaattatcctaatcccacaagcttcttaaatgttcatccatttttcccaaagtcacgtgctaactctttactaattctgtctaaatggctattgcaatgacaggtatcccagggaaggaaggccagtcaaaataacaaaatatctttaaaagaatgaaactgtatttcattcaagcacagaaattataactaaactaataaaaactgtttcaatagaagttctctgattatgtttaagaaataggtaataatttattacttttttctcagttgatatttacaaaatacagttgacccttgaacaatgtgggttttaactgcatgagtccacatatacatggttttttcttcaacgaactcatatcaaaaatacagtattcacaggatgtgaaccctgtgtatatggagagccaacttttcctatatgtgggttccacagaactgactatggaaatcgagtagagtgggtcctggaaccaattccccccgtgtatactgagggaaaactgtacttaaaatcaatcctctctgagaataaaggcaataaataaataaatatgaaaataattctctcaagtatgttaaaaatagtcctagaaaatagaattccagaattagaagggaccttagaaactatgtagttcaagtttttatccagtgtaagaaattcttagacagtacccctctgtaatggcagaacatgctatttttgtaggtagtctatctcattgctgagaagttcttcctaaacactgaggcaaatcctggttgtctgtaattttcctgtacttgctcctagttaagcctctgtagccatacagaatcaatgtactttctcttccatttgaaagtgctctatgtatttgattatatcaaatggatgtcacagatttgctattgatctatcatgtaattctataccagtctatactacctggtgtctgggaaatttcaagtaaggaatcagttggaaaaagccatttggagattaaagagacatccacagctttctctctgatctgccctctctctaggaaatcacctcccatgactcattgctcataaggatgtggatatgaaatcatgctagcaaacatccctgcataattgacactggctattccctatgtagtaatttgtttactatgttccttttttcctcctacatatgttggaaagcaaactttaacaaggttcctttctgaattcttataagttccaagctagtttcttttgttaaggattaaataaaatttccattcagctatttgctaaggaggtgaaattatgtttttagtgtttggaatatagcaggtgaatcaaggtgaattaatacgccattgaaattagttgcgaaaaccattctctttatcttagttctcattatagatgtgtaggtcagtaaggtttgtgtcataatgtaggcatcaactgtattattttctgtgaataccgacaaaacatttctttagtaacaaatgtaatcaggcaacataccagatattcagtattcttcccaagttgattgggcattgcttccagtttctgccagaagagcatcaccacatattacaagaagcatagccctccactctataacctttgatattttgcccagaaatgttgagagttggaaatcaattacaatatagcaaaaatgtatgagcatcagctaaagcttcatctttgcttccttttttctctctgaaaaattgagtctggtgattcttcagtttttacatgtgtgctatagagactcctaaaagagcaagcaaggaaaggaatttaattgctaaatgcacttgagtagatctcagataagaacaggtaatctttgaagttataaagcagcaagagaccaataactttttctctaaccaatggtttcgatatttggaagattgacaggcttagagacactttcttattccagcaaaagaataaatgtattgccagctacctccccaaaggctgtcaaccaagtatttgttcaatatatttatcatggtttattattttaatttatgcgtaggtatctgcattatgtcctgaataagtcatgtgactgaggaccatcagtggctagtttgagcatgagtgtaagttgcatgtggtagttttgtaggataacacatttttaggattggaagaaacagaacttttcagtttccaactatattagactaggaaaattatacacttaaaggaacaaactggcttgtccaaattcacatggctggttcataggaaacacagtggtagaactctttatgtgactctagttagaagtccttatccaaaaataatggaaaagaccaccaaaataatttcttcaggtttttataccaaatctgaaccttgccaaataagttgtattaaactaaagatttcttgtatgtaggtcattatttaatacctttaacagtatttcacaaggaaaatgcaaacaaactaaaatgcttcagtttggaagagacagacaaatgaaaaaaatttttattgagaattttaaaataggtaagcaaaaactacaaatagaaaacagccagagtatacatacatattcagtttaatctcctagacttcattccatttagaaatgtgggaaattttataatacatatagtactcagagatatttttgtgagaatgcattgtgatttggtgtgtatgcttacaactaaattgtaataatccaaaggagtctgctatctatctctaattccttctgcttaagtaacatgtaccaacccttaagcagtggctaaggaaaggacatgacagaactcttgatcctccttttttatgtccctgggcttcttcctgccaggttttgctgaaatatctcctctttgccttaagactgttattgctcattcttatttgttgtttattttttatgtgcttgcccaaaaattggtctgtgttatgacttttttcattctttcccttcctattatgttgccgtttactaccctcctacatcagaactacttgccttccactactttgaaacaatattaacaacatgatgtgtatatctacacaactttctatatgcataagcatacacaggaaattttgtttgttttacacaagtgaaattatgctatgtacacttctctgcactctcacttaatggtacattttggaaattccttcaagtcatttggtatgatacatataactcatattaaaaaaggtatagtgttgtgagctctgggtatatcacaatttattcaaccatttccctggtgtttactgactccatacatttgataatattattgacccaccgtgttctttctttttcttctgattctatatagtttatgctctgactgacccactacttctagctcttgcttctagttttccttgcattgccctctagtgatttcttatatttaggccttagttctatgaatgaattgtaagcttcttgaagacatacatgtttcgtatctaatattagctatagtacaaaacaaaatgtgtccacaaagtaagagtgttagattgataaattggccatggtggagtagaagttttagagctgtgaatctagactagggaagaatagaagaatctcagagccttaattaacttttctgttgtgttgttatttctgccaaacatctaaattttttccaaatccaactgagagtatatctcttctatgaagatatttaattctgtgaagtttttagtctctaataacttatgttgtcttagtccattgctgctgctataacaagataccttagactgggtaatttataaacaagagaaacttgtttctcacaattccagtctcacaattccagaggctgagaagtccaaaatcaaggctgccagaagattccaggtctggtgagggcttgctctcagcctcatagagggaaacttcttgctgaatcttcatatgtcaggaggtgaaaaaagggacaaacttgctacctcaaatacttttataagggcactaatctcattcatgacggcagagccctcatagcctaatcaccttccaaaggcaatacttcttagtaccatcaccttggggtttaagttccaacatgtaaattttgaagggacatatacattcaaaccatagcatatggcaccctctcagatcattgatttttgtctcatccccctgctgactcttaggcaacatggttgatttattggcagaatagaaagactgcaggggtttttagatcgggggtcattcctaatctcaggtaactctgcaactgctgctaatatctggaaccaggaggtatctcaaatgatatatcatctaatttatatattgaagatggctgggattaaagaattccttagtatgcagcccaataccacaagcctattgtgaaataggtgatccttcttgaccttttttggtgtagatgccctcaccatccaccaaagcccagttcattaaagcttgggcaactcttctgcttagaacccttcagtggttctccaaaacatccagattaaagtgcaagttgattaatattgaaaacaagactcccacatcatcttttctcatcccacctacgtattcagcttaatctttcaacacttctgttgctgctgctggtgctaataatgatgataattctgatgataacagctaatgttttactgagtgttttctgtatactagacacatgtattttgtatttgaatcttcacaaaacccctataaggcaggtacttttgttatgcccattttacaaatggataaatcaagcttcaaacaagttatgtaacatgatgtcacaaggctattgagagaactaggaatgtttgactaaaaaatccatgttcttaaccactattccagtgctcctcaaatattgtgcacagtaatcccattgactgcttttagaaaaacatgattttcagacctcactcaagagatttggattcagtagatcaagatttagggccaagtaatatgtgcatttacttagcacctccaggtgattctgatgtattaccgccgaccatttgagaagtactattctgtaccaatgcctctcaaattttaatatctgtatgaatcaaatcacttggtgaccttattatccctgctgatgctgaatcaatagaattagggtagggcctgattttctgcatttctaacaagcttccatccaggaggatgcaaatattattggtccacagattacacttgagatagaagtcctatactacatgccttagtgataaaatgcgagtttagcataagaatgaggtatatttcagttaagtagtgtgttatacaaatagatatatccctaaaaaactcagacacaaatcttttctgtcacttgaattccattttcacattgactttcaggatcatttcagagttactaccattatttatttttagtagatctctagtagcctaccacttcaactttgtcagtcaagtacttagtaagtgatgacctcttaagcaaacactcaagtaccctagaagagcttactagaaacagaaagcctgtcatgagtcctctaataaagtggatattctttttgttatataaatacgaaatttgaaaagaggaaaagcaaatgttagatttctagatctgaaaaggaccggagaaacaatttcattcaaactgaattttacaggtaagaaaaggcaggcaagaatgggaaggtagtgtaactaaatttacacaggggattagtggcagagctggaactcaaattctagtcttgttggagtttttatttatttgttcttgttggttggttggttggttgtgttttgaaagcatatccttaattccatcttagcttcagtgttggagatctgtacttctaagctgtatttaaggggaaagggcaacaattacagctgtttttcctaagtaaataggactctacatcggggttagcaaactttttattttctgtaaaaggccagatagtaaacagtttagaccttgtgagccataaggtctttgtcacaagtgctcaattgctgtcatagtatagaaacagccatatataattatatataacatattaatatataaacaaatgagggtggttgtggacactgaatttagaatttcatataatttttacatcatgaaatattattattttcactttttaaaaaccatttcaacctgtaaatatttttttttttttgctcataggccaatacagaaacaggcagcatactggatttggctcaatggccataatttgctgacacctcctgtaaattagtttagttcttccaaacgctaatataatttatcctcaagttgagcaggtagttcttgaacattacatagaaaacaagttagctattcaaagttcactggtaggattagtggcattgcatgaattttgtttactggaaaaatgtaacagtcagaaagagatacacattagcttatgagtggggatatctgctttgctgaattatttctaatctccagagaggaaaagtaaagcccaaggcgtaggcataccataaaacaatttgtttcatgatagccatagtagtctttttgactaaaagggcattgaaattcttttaaagacttctgtgaattggctgccatgctctgtgttactctctggtgggtataggaaatttgctgaagtcttaatatgtcctattcctttaattcgtggcagggaggcaggaaaatgaaaatagtttgaaagcaactgaagtatagatggcacttggtcaaataccaaaggtttcaatgaaagtcgtcttggttcattgtcagatcatcccaaagaatcaagaaaaaaaaaaaagaaaaagaaaatgtcatattagcatagttgttttgcaaatgtcggctttaacaatgctcaggttacaaagttgatgctctaccacatatttatttattttaatttaaaaaaaacacagttggaaattcaaccagaatgttgtcaaatgcattgagccttttaaagttttattgaaaatggtggttaagctgcttcctctcaaaaagttcatttaagataatttcgccatttaaaaggaggtgaggatccttataataataatagtgatcaaactttgaatgcagagttctttcaaaaaatagattttcaggggaaaaaaaacacaagaacaaatttaaccattccagtatgatagtttcacagactgcccagcttttggataaccacctgcaacagaaagatagctaagaaaagaggacaatgtgcctggatggtttcccactctatttcctttccaaaacaaatgagttcccttatataaagttatcctataagagaaccaaggaaagtattcttgttagggatgtatatgaaagaaataattaaaatctgagtctatttaccagaagagattatgttgtttcttctattctttatattgtgattaaagtagagagaagacatttttgggcaaacttactagggggagaagtgcacaatttgaagtttcttggtttctcaaagatggaacttaattgaaatcaatatgagaaaaagcaaaaaatagaaagtgctgttctgaacagaagaaacttgaattagctaaaagtgtgatatgtgtagcgttccttgcagtgttgaaatgtattcaataaaaatgtttctatgaagtaacatcactttccctatttcactggcaacagttgagattcggaatcaccaccgttgtttcttttatagcatccactggtaaatctgatgatatctataactgtctaaaaattataccaaaatgttgaagtggagatgatagatttcatttttctcagttaacacattatgagaaatattctgtgtaaatataacctctgaatcaaattcttttttctgtactgattttcataattttagagagatatgtaacattatttttattgatttttaatagactatggttgatagcaccttagcattgtttcttttccctcttcatttctaatttttgtcaaatggcacattataagcagataaatgtacttgcaacttaaggaaattcaactttaatattttctgtatggtaaaaataatttttatataaataactgcttcaatttatctcttcttaattttagcatttaagtaatgcatctgatgtgtgtgtgtgcacacatgcacacaccccaaatgtctttcaaatgaatttgctcacagaaccaacaataacaataattacaaatattataatatttttgttttagttcaggctgctataacaaaatactttagactgggtaattactaaacaacagaaatttattgcttatacttctggaggttgggaagtccaaggtcaaggcaccagcagatttggtgtctggtgaggacctgttcctcatatatggggacttctatgtgtccttgcctggcaggaggggcaaactccctcaggcctcttgtatatggtaactaatctcattcatgaagaatttaccctcatgacctaatcacctcccaaagactccacctcttaacaccatctactttagggattaggtttcaacatatgaattttgaggggacacccgtagtcggaccatagcatttttatagtataccatcacagaaagacctgcaggtattttcttatcagaaaataagacattctatcacttttctattttagtaagatacattatagctttgtgtttgtaaaattgtctttctaatctcagactgcattttatttccatttgctgtttgacctcttcagcttttgtgatttctgatgccacagactgcttttattaactttaaacatttacttgtgatgccagaacaattcaaaattgatttagtcatattagctaattatctgatcaattcagtgagcaaattcaattcaacctcttttttgatagaattagccaatggcttaaatgaaatttcttatcaaataaataaaagttgtagaaccagtagtcatgtagacacagccatactatgagctttcttccttaccccatgttattgaactattgtaatatgttgcacattcattcattcaacaaatatttactcattgccaattatgagttgagcactgtgctaagttctacagatatagtaagtatctctctctttagtatgtttacacacagaattattcaagagtagtcacttagtttttcctactctatcaacattgtggttttaatagccatgtagggttcatttagttcaggtacttaatactactgtctacaggagccagatatctgagggtgaggagagactttatgaacaataaaaagtagatgattatggaggcccaaactctataataaggactatatacagtttacaaagtctatacaatgaattctaatatcagcttccatttgttcttcagaaaggagctagtactagtcctggccaattatggatcttcttgtgtgtgccttatgtttgtacctaatctcagagtctgatctctacctttttcttttcttgtaagatccttcattctataacttaatcgttggcccataactccagaaattactgtgaaattgctgtattcctgcatctccaactagagtttgctatctctgtggtctcactacatggatcaaagttgttctgacggtgataaccaagatgacaaaggagtgctactttggaaaagccatatcttacttggattcagagctacaaaaaaaaaaaaaaaagatgcccacttgcaacattgctatttgtccatcccattttctgagtaatacacttaaacatattcaggtaatagtagttactatttaatatatttaatatgtatgcattgccaaaccttgtggaatatactagcatgagaaatctcatcctcatccttttacttcacttgttctctaactattgtagtgggtgactggtggttcagtagttagagcagccattaaatgatctggtgtgtttataagattctcccacaaaaacttgtaactattatttagtttcaatttttcaaaggctgaccaaacatcaaaattagttggctgtttatctagattaaaataaaaggagaatgtcaaaagcaaatctttatgccattcaagcatttcattatccatttgcaggctgcatgatagggaaagcttcattttgcaatagcataatacagataattgctaatgaaatatatttgacactactaatatatgatggtagaatgagactggagaattaaaatgtaaggtccttgagaatgtgagctgtatcttaaatcatattttccaaccctagtaactgcacagtgatgggcacataaatgctcaaaaattattacgtgattcaaaaataccaaaataattatgttgataattggatcctgctctagcttaggggtttcataaggaagtttgagaaatagccaccttttatagtcttccacaaggagatatgttatgcagatgcccagatcccccaaagacaactgcctttgcacactgtgtcaagtgggatttagggttttgaattactggttgtccttctgctctactgaaaccttaagcagaggttctaaaaacataagctgtagatttgggactaactctgcattttggcacttgggattactatcacagtgaaacatgggagagaagagttccacagatggccaagcaggcagtatcattagctttaatgaaatcagctccatgtatgcccaataaagcgtgggatgaagactaatcacaagcatcaaagaagatagtgttttgtgactttgtgcattatcgaatgtattcaagtgttaaaaagatgactattcattgcacttgaatatgcgtctaggttaatttttttttattgaaaggaaatttcattaggatagtgtttattcacattgatccagctgacttcagaatatggttatatatttttctgcatccaactgctattataagacccaggcttatattagattttctctggtattaattttgcttactttgacctttatttcctgttccacctgaaccctcctttctggacagttgcgaaaggatgccataaatatcctccacaaaggcacgtgtaaatgtgatcatattttcgtgagtctttgctatgtgcagtgcacaaatgctatgaaataaatgagcacttggatgactatagtgagtcacaccattaagagggtgtgctcaagtatagtgtttgttgatatgcacaaattaattctaaagagtgttatcataatttgctcatggtatatgtattcagattctttggaagaactgaagccatcattagaaaattacagtattatctcaatattttagttgacaggaggttgtaacaacaaactttcccattgtcttctaactcctcttcattgtatcactgactttgtgtactgcatagcaagagataagaggagcaggaatagagaatgggtaggactaatgtgaggaaattttctggagaagtccatttcaatgttagcttgtaaaatgagaaagatatgtgtaaggaggcagtagaaccaaattaaaatgccctgctacattcttttatgccttggcatgaagagatcttgggcagagataaagctatacaaattcatatggataaagtcatttccctatcagaagccaccccatgccctgccaagtaagccaagttaggaatgtggtatctgagtcattgtgtgctttctgatgggagaatgaagacttatgagaagagaatcttgatgaaaggagagggcagaataccagatgtcctaaggcaggtagagagagtagacagcactgtaagaggatggcctgtctttccacatataaagttgtgttgtccaatgtaatagctactaactacaggtggctatttaaatttaaataagctaaaattaaattcaattaaaaattcacttccttagtctcagtagtcacatctaacatgctcaataattgcatgtggctaactgctgctgtattagcacagatgtagaacatttctaccatcacagaaatttcccttggacaactctgttctagagcaatgagcagaaataactatttgacacactgggggctgggaggtctctagagagctatgagtgctgacataaccagaaaactattttttggtgaataagtgggaacaccaatggtatcaaagtgggaatcaacatcacaaacaggtatatatttcaccatcctggaaaataaaaatgcaactctgtaatgctttccactggaagaataaatatgaccatatatttcaatgaaggtgattgagggtttcttcttcattttttaaaaatttgtgttgatttggtctgatgtttttaactaaagacacctaaatgacttaattgttaaactgtcatctattttagtctcatttcctatgtgaaactagttgtcatactcccctcaaaatataatctaggccaggtgtggtggttcacacctataatctcaacaacttgggaggccaacatgggaggattgcttgagcccaggagttctagaccagcctgagcaacatagtgggacctcgtctgtacaaacacaataaaaaataaaaattagtcaggcatggtggcatgtgcctatagtcccagctactcgggaggctgaggtgagaggatcacttgagcccaggagatcaaggctgcaatgagccatgattgtgccactgcactccagcctgggtgaccgagtgagatcctgtctcaaaaaatatgtatatataatttattcataggcaaggattgtgatacagttgttcccagtaagtccttattgaattaaaaggaagctgcctgcctatgcttggtcagatgacagccactagtattaagtctccctttgcaccattcctggctacctcaactgatcaggaagaaaatccatttatttcaaataaatttgaaaatattatatttgcttgaacaaatttgtttcaaatgctgccttacaggaattaaggcattcatttattttttcagtcttttattcaataatggagcacctttcatctttgaggcactatcagcaggccttgtggactttatgaggttaaattagtcactctttgccctgaaggtatttataatccaatgacatataattaccaaaaaaaaaaaaaaaaaaaagcagaaaatgaaaaatcaccaaaaagagaggtaaaggcaaggtgttataagaaattagaggaagaaagaactcctttggggttgggaaactggaaggagagctgctattgagtacctactatataccaggtttttagcctatgtaattccactgttatgcctccccatgttcaaaaggttcattctgttattgaaatcatccatttttagtagtagctaaatatgaatattcttagagtccagtgggtagtggatagcatttcttgactttgtaacttgcagaaagtcagcctcaaatcagcatttgggagtaccttacctcttcccctttccacctctctgctgtcttcctagagttctggctccatcatgctagtggcctatatggtggaagcctgtgagactatcattcctggatccatgctggttctttcagacttccacagagataaggttacatgcctttagattcatgataatgaggcatctataaagagaaataaatctctctcatactaatggtgataatttattgtgtaaaactttgccttggggtgctaaaaagaacgtttaccatacataaggggtaagattggaaaggaactatagagcacagcacttccgcctgctccttctcccagcattcacatgtattatctcatctaatcagaaagattttatggaagacattgaggaatgtagatattgaatatggtaagacactgtgtgtaaaaggacaaattcaagtgccaagtttgttgttgttgtcactgcttgtttgtttttttgttattcaatcaagcatattacacagaataaatcatatatagattaattctgaacagtgagtcattgagtttgaaaaaggggggagaatgtggaagggatcaatgggacataatgctgcagaagttggtaggaagttggctaggttgaagagggtctgaaatgccaactaagtggcttttcttagtttgggatgctaaagcaaagtaccagagactgagtggcttctaaacaatagaaatttatttctcacagttctggacactggcagccagagatcagggtgccaacatggtaaggttctgatgagggctgtattccaggttgcaaattgctggcttctccttgtgtcctcacatgttggaaagagagctagcgctcatgtctcttttcataagggcactaatcccattcatgagggctctaccctcatgacctagccatcttccaaagacctgacttccaactactaccaaattgggattagatgttcaacatatgaatttttaagggacacatccagtccattagaggttggaaattattccatagaaaacaagtagccaaaccgtcattgaatgcgactccagctttttaaacatgatgcatattgcttgttctccctttttatgaactaaactcacattcacacagacagatgtcatctaacacagtgggagaggaggatgtgtggtagagctgcctacttggttcattcagttaccatcaggcatcgaatggttcacatatgctaaggggaggagagagaaacaaaagaaataaaattgatgacctccgacctgaggaagtttatagttcaattaaagaataggttgtggctacatttaacatgagtgaaaaacactgtagcagaaaatgttattgaatactccatagtcattctccttttaccttcctattagaactccaattttgttgttggcagcaacctgccttctcagatttgcttacacctaaggtggctgtgtaacagacttctgcccaatgacatatgctgagattaggcactacctcttccggctttccttcttttcttgactagaatgcagacattaggctggaagtggaacaaccagcctgggaccatgaagtgacaagtacaaagttggcaatcaaatgccaaagatagaataaaaggatataatgaacctggaacgtgaatggcattctggcacaaagcagccctggtctgtttacttctggcttttttgttatgtgagatgaaaaaatcatccatttgcatcagccgctgagattacattttctgttactactcaaagccaaatgcaaaccagttgatacaatactcatggaatagccaatcccagagtgcaaatgaatatgcaaatgcaaagaccctaaggagagtttatggaaaaatttttcagctaggtgtttgaaggattaaatgaataatttcagatgttcaatagcaaatgctaatgcagggttgtaatataaaattatgttcatgagacgaaagcatttaaaggaaaccaattgtgaaataaattagtattaggggtatgagaaatggatgtggatatgtagaggtgaagaggtgccagtggtggggaggagcatcagaaatcatggggcccaaacagcaactagaaaagcttccaacctcgttatcccaaaaagaggttgcaagggaatgacctggccagaatagaagcccttgccctgatattcacatccttatttattctgataaatgaatctataatgtgtctcaggccaagcctaaatgaatgccattctttttcattagtaagttatttaaaatcaatgttttcgttaaaagaagctttcagatgttactaatttaaatctcattaactgcttactttattttccagagttcaatctaagctgcatctttcatttagattttaagctataggctatatgtaattctacaaaaatgccctagatagaaaggaaggagtatttgaagcccacaggtgaacattagtttagaaagcttcaagcattgcaagtctttgaatgaggtttacctttataggctacttaagggatgtcaagcagaaataactggtggtatcatagcttacaatgctggggttgggggctgagatcttttctccatcttaaatttgcaactcaaaaaaaatttggttacaattttttatgtgtagcactaaaggcacactactgtgttccagagaaaggcaacctcagatctcatttttgatgccatgtttcagaatatttagttttaaatagagcccccaaatgacattataaagggcatgcagcttaaggcaagctgtcatagagactaaaaatttaatacagttttcctctaaaagtggttggctacaagcgtaacagtggcaccctattattttctttgcataaaattaacatatcacaaccaatagttattttcaattatgtggcatcaaatgaatcttaagagattgaaataagatccatggtagctttggaggatttctgcaattgacagtttgacacagcatggcttcagattatgtcaaaactgacaaaagcatgtgtagcctgcttaaaagaatattttttcaattctgtcttgttggaaatacttgccatgaagtaataataatacctttaatatgcaaatgattataactgcatttattacactgtcaaatggaaactcaaataccagctctttgttttacaacccagcacatcacacaaaataagagaaatgactgctttcatcatagagttcataagtggaagaacaaattctcttttccctgaggttgctttcattttctctcagatatgttctttttccacaactctgaaaaaaaataagaatttagttgatcactgaagcattctgacattcagattttctccttagtctttatctccatcctgatgatcctatatgtgtccaacacttttgcgaagaaaaattgcacctttgaaggggactttacagtaaagtaccccatataactatctttattcttatccattgtttgatcttactgctcatttttaaaaacttcccaggggtctcattttttcctcatcacttaaacaggaataatgttttgtgctgttcatttctccagcaacctccacttcattcaccttggctcatttcattagccaacagtccctgaagcactgccatcttccactccttgctggagaggccctgcctggatgcggtggtttttccaccattaggcacatgcggtgggaggggtggagaagcagggggaagtagtttcttcgtatcttcagtgaagatactttaaatctgtgacatttttttttttagctttcacattcttttttttcttttattattattatactttaagttttagggtacatgcacgtaacatgcaggtttgttacatatgtatacatgtgccatgttggtgtgctgcacccattaactcgtcatttagcattaggtatatctcctaatgcatccctcccccctaccctcaccccacaacagtccccagtgtgtgatgttccccttcctgtgtccatgtgttctcattgttcaattcccacctatgagtgacaacatgcggggtttggctttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaataaattgacaaatggggtctaattaaactaaagagcttctgcacagcaaaagaaactaccatcagagtgaacagacaagctacagaatgggagaaaatttttgcaacctactcatctgacaaagggctaatatccagaatctacaatgaacacaaacaaattcacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaactacaatgagataacatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaactagtaataccatttgacccagccatcccattactgggtatatacccaaaggattataaatcatgctgctataaagacacatgcacacgtatgtttattgcagcactattcacaaatctgtgacttttgaaagatgcttccagcatatgggccttctctattttctcacagagacactttaattcagaacattaaatacttaggtctccatcataggtgggaattgaacaatgagaacatatggacacaggaaggggaaaatcacacacaggggcctgttgtagggtggagggagaggggagggatagcattaggagatatacctaatgttaaacgacgagttaatgggtgcagcacaccaacatggcacatgtatatatatggaacaaacctgcatgttgtgcacatgtaccctaaaacttaaagtataataaaacaaaacaaaacaataaacaaaataaaaaaaaaatacttaggtctcctagtgtacatcctgtactccatagattacagtcagagtctcctttcaacagatgggtgtgtgtgtgtgtgtgtgtgtgtgtgtgtgtgtgtgtgtgtgtgtgtaggggggtaaattcattgtctttcctctgttttttcacttcccccatttgcttctgccaatctttcctgtgctcttggctgatttcccttctcccattggtggatctagctacttactaacaccaatacttcatcattcccagtactttatttctttggattattctttactatgatttttcctcccatctacctatggtaggtaaatgagcagacttaccttcaatatgggaagattctgggccaagacattttgttctttcttttcactccgttgaatcacagttcaaactcgtagttaagatgtaagtcttctgcttaaacccttcagtgactccctgttgtttacatgataaaagtgtagctccttagcctggtaaagatgttcaggactaggccttagtaactatcttctgtctctgactatcactcaccatcttcttactttgctttttagtcatgaagaattgtttctacttttcccatgtaacccaagtgatttgatgcctctgtgtctttgttcacagtgtttcctgtatctggaatatacttttgcttattgtttggccaataatccatccccaagtcctgcctcccatccccaatgcctgccaattttagtagtacatagtaactgctaaaattgtattggttgaatgattgaatgaatgaatgttttttgtacatctctcaacttttctcagggattctttcactgagtatatccacacaccctcttcaccagtccaaggagctagtcaggtacctcttcttgcccccaaatcaccctatattccccgccatttataacacttactataatgctgtgagcttctctaaaggcaaggaccatattttattctgctgtgtccccaacacatgaaagagggcctggctgaggacggatgttcagtaaatgatttttgaacttaaatgtttcttgaacctatttcctattttggtgaataagaatcagcaaatcccttgtcaagtaaaacctaatttctgcttttctaacaccaaaccagtctcctgaagccagaagatctcttaagtcctttgaatagtgaccactattttagatattaaactgaaatagagcatgtaaaatttcattatgaaccgtacagtgttatactgatgagttgcattattatctgttttgtacatgtcaaatgaaacttctcagaccacttccaattaaggctggggccctgtactttcctacttcttccttcccctgtttcctgtagtccctaaaaaccctagaattcccctgcaatcggtagttgagtacacagaaggaggcaggttggttaagaactgtcagagttgagattatttactaagaatagcattagcaggggtctaactttattagattcaaaattgcccagctgctaaggtggccctgcagactcaaagtaacacttaacagattcaccagataatcccagcatggccacttacttttaatctgctttccagtctttcagagagataggaagtccccctctatgtccctgtggatgtcgaatcatttatttggggggcctaggtttactacagtgatccagcctgcactaatgtcagaatcctctcctttgctactaaaactatatagtacctctcactcatatcctaaaaaatccaatctcggctgtgaatgacattaaccctgttctaccctgctatggtttgaacgtttgtgtcccctccaaaatcatatgttgaaatcctaacccccaatgtgatagtattaaaaggtggggactttgggaagttattagatcaaaagggtggagccctcatgaatgaggcaagtgccctcataaaagaggcctcagggagcttctttgtcccttctgttacatgaagacacagtgagaaggcaccatctatgaagcagaaagccctcaccagacacaaaatctgctggtgccttgatcttggacttcccagcctccagaactatgagaattaaatttctattgtttataagccactaaaattttttgtcatagcagcttgaatggattaagacctgccccttcctgcaaactaaatatatcctactctgctttctaggattgtccagggggttctattcccattcctactgaccttatgccatattcttctggctctaaatttgcattctagaccttcccagggccttgccttcttattcctgttggccaaagaaagtcttagaaaatttcagaaagcatcttatagccctggtttataagagggtagaaaaaggttttcagccctactcattccttctacctgagtagcctagagtttaccaaattttcttatatggctaatataaatatttgtatcttatactaaagaaactaccctttctggctttctagtaacttaattttttaaaaaatatagcgactttattgagatataatccacataccatgcagttctgccatttaaagtgtacacttcagtgatctttagtatattcacagagttatcttaccaaaccaaatttgcatctgtccccctggtgcagcaaaaccaaacagtgacattgggatttgcagtgagaaaaaatgagacatttattgcaggagaccaaacaaggagaattagacagctaatgcttaagacctgagcttacctgaaaacaggtaagggtttttaaaggttgggaggcagaagttataggcaaagtcataaatcattacatagaagctacattggtttggcgtaaaaaggcaggacatcttgaagaagggtattataggtcatagattttggatttaaaggttttctgatttgtgattggttgagtaggcaaagttttgtctaaaatcttggggtcagcagaaagaaatgttgagctctggcatatgggtgtgactttctccaggcccctcaggaagacatttagaacaaagaagggatgtcagggtttagtcctcagtttccccagagctgaagtctgtgtgccagtggatggcattttccatttgatgggggtctgggtttctgaaaaacaactcagagacatagttaacatgttatctttagtttctataggaaaccaaacattctgtcactctaacttccttggctattattttaagctattattaccttctcacttatcaggctgctcatttacttctcagggttagctcggtgactagaatttcccttgaaggtacagagattttcctttatttccatgcatgaggggaggacaagaagaacctaagaggggtccctgcttgtctcagttgtgtaatcattaccacaatcaatttaggaacattttcatcatgcccaaaagaaacccaggcctatattaacagtcatcacccatttcctctcaacacccctccaatctcctggcaaccatgaatctactttctctttctatgcctgttctggatatttcatatacatggaatcatatatgtggacttttgtgccttctttcacttagcataatattttcaagtttcatccatgttgtagcatgtatcaaaacttcattcctttttatggctgataatattccattgtatgtatatgcatatttatatcatgttttgtttatccattcatctgtttatggacatctacattggttcaacttcttgactattatgaataatgccattatgaatattcatgtacaagtttttatatagacatatgattttatttcttttttgtatatacctagaacgagaattgctaatttacttctaaaattaagacccgagactgctatagaaaacaaacatctactatgttctctaatgggggtggagggaggaaagctttgccattcccaccttgtaaatcagtagggtaaacaaacctaattattaaaaagagttgctcttttcctgtctttagagtaatcaaagcagagcattattggtacacaagccccacgtcaggaggtaattgttttattttttgtgtttatcaaaagtcaatgatatattgacatttgcattactagtcatcctgtttcaaagtgagtgatgaaacactcttctcctaggaagctatttttttttctccatatatggacagagctaattaacaaatggacctatggccacctccatgctgtgacacatattctatattctcaggagcctgtgcatattacaattctggtggtaagtgtaatgtcgtaactttcattttatacctgaagagcagtggttggttgacagcatacaaaggaacatatgtgaaaatgtactttactagttggattttgtgaatagtatgttatgaatttgtcatgtagtagatttcatgaaacctgtatgttttaaaaaaatttccagcattttattgatatttagaaaatctgttttggtgccaagaaatagaagtgcaatctcttacaggcaggtgcaagggtgaggaatatagtgatttatagtttctccttaaagagggtttctgagttgccatttcacatccattcatggatttaaaattgtttttctgaatcttaggcatttttaaaaggaaatctccttgaatagcaagaaaattatcataggtcttgctattatctcaatatttgtgtccccctaaaattcatatgttgaagcctaatcctcaaagtattggaattaagagttgaggcctttgggagatgattaggtcatgacagctcttttataaggattagtaccctaataaaagaagctcaaagaatcttgttcatcctgtctaccatttgaagacacagcaagaatgtgccatcttgaaagaagagagcagccctcagcagacactgaatctaccagcaccttgatcttggacttcccagcccccagaactgtgagaaataattttctgttgtttataaattacccagcctgtggtattttgttatagcagcacaaatgcactgacagaggtcaccagatgcacatgttctttggctctgtatacaaggcttttaaaaacaacaaaaattagctgctcctgtagtacgatgctcttatctttggtttctttatgggagaggatctatggaatctttttaaatgccaacatgaatttaaggtatatctatatgtatgatccccttggactgaaatttcacttgagtaacctgaggacctagaaagagtaacataataaaagcccttaaatgaaagttctacaaaatctataaaaaatagcgagaatagaggaaattgagcagcagacttaacatctagttcaagtcctagtctgctgcttattaggtatatgacaatgaatatgttgcttaactattctttgccttagtttcatcatctgtaagtaggggtagtaataatagtacctacctcatgatgttgtggagatcaaatgagaacatgtatattaaggcggtatacaaatggtaaaacatggccaggtgtggtggctcatgcctataattccagcactttgggagggcgaggtgggtggatcacctgaggtcaggagttcaagaccagcctggccaacatggcgaaaccccatctcaactgaaaaatacaaaaattagcagggtgtgttaacaggcatctgtaatcccagctacttgggaggctgaggcagggagaattgcttgaacctgggaggcggagattgcaatgagccaagatcatgccactgcactccagcctgggtgacagagcgagactccatctcaaaaataaataaataaataaataaataaataatacaaatatgtgtttacataattattttaaaattgatttatattttaataatcataagaaagcaaggtcctatggtatgtggattgaggtataggggcagcctggatttacatgaatttaaattttcgtcagttaacacaagttcctttcaaaatttaggcttttgtttccctttacttcttcacagtaacatatatgagatgaagacactcatgtatcagattagttcaacatcaatatagaatcatcagccaagcagggacatgacatcaaaacaaactaaacactagttaatgaagaactagagcatgcaaatactattatcaaaagacacactgtgtcatcaggacttgattttggttattctctttggtactgggtcagagttcaacctttaattttggtctgccagtgaggtggagtgatagcaaagcggagcaacctctactttcaaggtcctgaggtacaagcctagtttcagctacatctgtttccactaggcccattgagggttaaaaatctatctgttcaaatatttcactggagctagaaatggcttgtttaaagggcccacaggtgcctttctttctctatacagtgcattctttttggtgtatctttgcttcttggtcttgttaaacatcttcattccttggtgtaaatgaacagctgtctcagtagaaaggagatttgctgtctgtttcagactagactggactgacagttcttaggctgcctcagccttaggggaaagaactaagtgatttgtctttcatggaggttaataagcacttctcttgttggttggtttgtgtataaacggctcaggctttggcacgcaatctgtcacggatcttaataaattaccctctgtttatgcacttagaagtaacacttgtattaccagtatggcaaccaaatgttgaagtaaatcaccacacgtgacaaacagaccttaaatcatttgcccaactatttccttgacctgtcttggaatgtgaggaaatggaaaaaaaaatcaagtgataggaatgttttgcatttgtggagaaatagaggaaatccactgtagttttaagggaaaatatgcatagcaactataaatccaaggagattgtttaggtgtcactatttcaaagtttgctatatattttcaagttgttaggaaatatttctaaattgtgtctacttccctgtcttgataaaaagttgatcaaagttaaataaatctttctataatgctgggaaatctcatcgtgtccctgagcatctttactgtacaactgtggtgcttggtgtctctggaccactgctttgatcatcagtgaaatatgtctaggatcatagatggagatgtaaaaggtttaggaaattgagctgaattgcgttgagcacttcattccttggaagtatttttagtaaaattactaccatgatttttttctatgtgacttgacattttttttaagtggaacattcaaaacatgacttgagagttcttttagttgtgatctggctgattaagattttattctattagaataattagagagaaaaagggaggtagagagagagaaagacataatattatattaaccaaaatggtgtctactctacaggcacatttacgatgtagaaggtttttctgtttttttttgttttttcgtttttttggtttgtttgttttagtctagagatttatcatagtagacaggagataattcaactaaaaggaaaactccacttcctctattttattgactattgaagttgggagcaagatgacaaacataaataataaaattgggatagtacccagaacctatgttgtttcaacataggctttcagttttcattagaaagtgggcaatatgcaaatgcccatcaatcaacaagtggataaaaaaactacagtgtatatatatatatatgtgctggaatactagtcagccataaaaaggaatgaaataatgacatttgcagcaatctggatgagattggagactattattctaagtgaagtaattcaggaatggaaaaccaaacatcacatattttcactcatatgtctgaactaagctatgaggatacaaaggcataagaatgatacaatggactttggggacttgggggagagggtgggaaggaggtgagggataaaagactacaaatacagtggagtgtatactgccctggtgatgggtacaccaaattctcacaaatcaccaccaaagaacttactcatgtaaccaaacaccacctgtaccccaataacctatggaaaaatggaaataagtaaactatggtatcactataaaaaaagtgggcaatatgattacacgaaaaagtcttattcccagaaaaaatattttttcaggtatatactgctgaacatgaatgcatacaattcttcttatgaaagaattttcaggtggttgactctctttctatttgtagtgcactgaatgtgctctatggcccataaaaataacaaggaaacttcttattatttgatactgcattattctaagttgcctctgcatagcaacaacttcttcctttgttgtttggtaaattctcaaatcaaattaattgagacattttatgtgccctataattcatttagatcatacatggtgagcattacatgcaaaatcttctgactatccatatgtagtttacatgggccttattcaaaatcacttaaaagtctagtcagaaaactttcaaattcctgaatatcacgaatctaatttaatgagtttgaatgtcccctatgaaattcacattgagatttaattgccattttaacaatattaagtggtgggacctgtaaaaggtgattaggccatgacagccctaccctcatagtgggtatatataacaccattatagtgggagtgagtatgttattaccagaatgtgcttcttataaaaggatgagtttgcccctgttttgtctctctcatcctctgtttgctcttctgtcattggattgtatggcaagaaggtccttgccagatactggccccttgatcttgaatttcctactcaccagaactgtgagccaaaacactattgttcagtgtaaattaccagtctgtggtattctgttatgggtgcacaatcatactaagacaatcagttgattgttttgtttatttagcttaaatgctgactgcaagattttttttttcttgagacaaagttttgctctgttgcccgcaaatttgacgtgtgtgtgttagttctctttcaacatatattaataccagattgactttgaatagttcttccaacttggagttcttttgggaaaatgagcaggtctctgtaaaggacaccttgtgaactagattatgtgctaatggtaaataccattttaacatagctaacatttattgaacttgttttatattacagccacatgacgtatataaacttaattctgacaacaactcagtgaggtagacattgttttcattacttccaatagatgaggaaagtgaatcacagggtggttaaataaattgctcaagtttgcacaggttcaaagtggcagacctgtaatacagactcaagcactctgactttagttttgtaaagcaaaaaatatccgagacagattttaatcaatttaaatagaggcttattttgccaaagtgaaggaccatggcccatgacagcctcaggaggtcctgagaacatgtgtccaaggtggttgggttacagcttggctttatacattttagggagatggaacttataggcaaagacataaatcaatacatgtaaggtatacattggtttgtcccagaaaggcatgacatcccaaagcaggggcttccaggtcataggtggattcaaagatctcctgattggcaattggttgagagaattaagctctgtctgaagagttgaagtcagctcgagtgaagataaggggtgttgtggaagccaaggcttttgtcatgtatatgaagcctccaggtaacagacttcagagagaatagatggtgattttctcttatgggaccttaaaagggtgtcagactctccaaaaatgacctagtaagggaaagagattctttctctacagaatgcatatttcccccacaagagacagcttcgcagggccatttcaaaataggtcaaagaagtatatttgggtgtaaaatattttgatttccttcagggcctgctatctgtcatgtgatgtgataccaaagtcaggttagaaattggtatcttattgctacaaatattctgttttatcggtattaagatctctgttttaatgttaatgctggtcaattgtgtctaaactccaaagggaggaggctataatgaggtatgtctgaccccacttcctgtcatggcctgaattagtttttcaggtttctttgggatccccttggctaagagagggatcccttcagtcagttgaggggcttagaattttatttttggtttacagtatctacactttcaatcactgaatcatatgacccagcaatgccaccatatgttatagtagagcaccattatatcagaattgttggttgatcctcttgtgccctttagcctgtgtcccattttgtcctctcctatccttggtgccaaacacctatttcctacatttccttaccatcagggcatgctatatcctgtgcagatggctttggtctttaatagtagcatcttgatctcctaatagaatcagagttgtcaagtttgttttgttttgttttctcctttattgtgtttaactctctgtttgttacactctattatttctttctattgttcctgtgtctcctccactggatcctcttttcttgttctcccttttatttttttcttcattctttctctttataaatgcatttataatcatggctccagtgaatacctctgagcagctttctcgccaacctctatcaccagctgtaatcatttttataagctcttttctctctaaccatgtactatatcctgccatgagctcacttagcctaaaacaaacttatcaccctctttaccaaaccagtttgacactacctttaaaattttaatggcacgattcagccttaaaacttccaactcatttgttattcaaccttcttgttcctttatcttgtcaatcatcaagtcctgttgatccttctttggtaatatatctcatccattaattcctttgtattcccagggcctgaatattttccaggcctcattatatcttgcttgtaatagtataataatctaactagtctcctggcttccatggtgcttaccccctagtgtctttccccatttcatatcctcatcatctgttccactgagggtagagagaaggaatataactataataaattaaagttaaaataagtagaaatagaatagtttgaagtcagaggagcaagctgtcattgttggttgagataatcagggaaagctttaggaaggggatggaatttagaatttatataaataaagaggtctgaggagggcatttaagattggggaaaactgggtgaacagaagcttgggatggaaatgtaagaagtttggggatacttagtaggcctggctgagctggaccattattgtaggaaaaatgaggttgaaaatatagtctgggctctgattgtagggatccttggataccaggcaaaggaatttaaaatgtatcatgtagaaaatgggtagagacatgatgaaattggcatttcaggaagatgaatctggcagctgtgtgtagggtagattagtgggaggagagactacagagagggggcctggttaggaggttgtaatagggttcagatgtgagttaatgatggctttgaatagaacgacagaacagaactgatgagatggatgcagatgtgcaaagcattatggaaggaaatttgataaggtttccttgagaggctgaatttgcaggcagttgggagaggaaatgggagggttggactctgggtgaccaggagaatatgtatcaaaatgttcccatccttcaagcttcagtgcttcctcctctaagagtacttgtcccaacggagcactgtgagcaagccactttgactgtaatagatgctcaaatagaattaaggaaaagcccactccagctggcagtgactttgcatgctctaaactcctagacacctattgactctacttttagtaagcacttagcatacatgatttctactaaactagcttttaatttgaggatgttttacctctacagtgagagagatcaggagagttttgagggcagaaatcatgctttattccttagattcccacctacctagtccagttttagacccatactagttgttaaaaatattttccttgattgtttcctttcatcctcttagggggcttggattgatcatctcacaggtatactttcctatccattattatgctgatgagacttacagtttaaatacattaccacacctgagcctcaggtacttatagaaacttttcatgtcccatcttcatagtctcttttccttttccagtgcagtttactgagtctgatcacgatcacgtattttgtgtttcagtaggtgcttgttaattgttggtttactttaagattcctggctgtggtataagctctgctacatagctaatgcagctttagttccatctgcatattttagcaacactacacaaagtgaatgtattggcacaaatgacagactttgttggtttaattttgtaaactgtttaaaatttggttcatttcttttcatttgcaaaatatttttattcaagtgtattatatagctattcatctcagaagaaatttgctattgcttgaaaaatacagtttgctttatgatcccaatattataaaggttcagagaaaagaatatctctacaaacaaaatatttatttgatctcgagacccttctcaaatacattttattcgtatctgatcagaatttctagaaacatacaattacacgttaccttaaattggtaagatttaatgtatttgacagtaattcccattaaaggaaactgttgcaggactctctctcctatgactatattagagccctgaattccaatgccagatctgccctttaatttctttgagaacttaggcaaggcacttggcattcctgggtctctttctcccatctataaagcaagagtattgaacaagatcacaagatcaccttctatgctagcattaattttggtttcgagttagcaaaaaaaaaaaaaaaaaagatctttcctttttttaaaaaaagcatatgccatgaaaatttcaagaactaagggcagattatgccccaacatacacagtcctcatagaaattggaatgggggacaggaaagccatcaggattggaggttattttgtctcaggatctggctaactacaaagctctctctctctctctccttttccccacatatctgcaatattctctttctactgctgacttccttgtatcttcagcttacatatggcccagaaaagttctatcttcaagtcccccatgtccttctaactcagccgctacaattatcaggctcatcctctcaattttcaattataaaattcaagagagaaaataattgactcaactcattttttaaagccagatcttgtaaaacatagattggctggtcaggctatagaatgaatgcatttgtaagaattgttcacaatggtccaattagttgtggccagtggaggtgggaggttgattcatttggaactgaaatgagagttaaggattgcaaaagttatattctagaaaagcacttagacagataaacaggtactctgaattgcacctaatacatcttccatcactgaaattctgttaatcaaaaagtattatttcttattgaatgacaaaagagatggtgctctaatggttaggatttcaggaattagtcagcaagtaggagagattttagttttgttattgttaaaatataaattccaatgtaaaagtaagatatgcttccagctgttattatttatctttagaatgtatgagttttagcttcctttttgaaaaggtgagcattggattcatagaaccaacttgtttaaaaaaagagtagaactatggggcacggaggaaaagcttcatctacagtaaggctgttttttacatcttaaccttaaaaatctaggcaaggacccaccaggcgccgtggctcacgcctgtaatcccagcactctgggaggctgaggcgggcggatcacgaggcgggcggatcacgagttcaggagatcgagaccatcctggctaacacagtgaaaccccgtctctactaaaaatacaaaaaaattacctgggtgtggtgcgggcgcctgtagtcccagctactcaggaggctaaggcaggagaatggcgggtaaacccaggaggcggagcttgcagtgagccgagatcgcgccactgcacgccagcctgggtgacagagcgagactccgtctcaaaaaaaaaagaaaaaatctaggcaaggacctcaataatgcatctcagtcttcacatgtccaaaactgaacttttgattcttacctttccctcatctactccttgtcacttcttttctttccccaccaaatggcaattccattcattttggtgcagacacgaaacctgagttattttttatttctctatttctccaataccccacatccaattcatcatccagttcttgaaaatatattccaaattttatcatctttgccattgctaccttgctagttaaagctatcatcatcttttactgggactattgcaatagtctgtgtgatggcttgttttgggccacataataaaatacgtaaagtagattttcagggggtggcttgaataggaaaagggaactcttttagagagtcacataacatatgggttctggtcccatttcttctattaactagctgtgcaaactggggcaagtcagttcacctctctggaacatgaaggggtttctaatggatctctttctgtctcggcattccgcaccatacttgccctcatcaccttgcttctgaattccctgctgtgctttctactgaccatctggagggaccctctcttcacagcatccagtgctccaggctggtgactgtgggaaagggagttctactatttatggtgctcactgtgtaccaggcattataccaggtgctttatgcacgttatctaatttaaaattctccataactatatgaagtaggtattattttattcccattttggagatgaataaattaagctctagatgcattaaacagcttactcaagttgtaaagctaataagaagtggatcagccttttccaggctgtttgtaaaaggaatatcattctgttttctagaacttggagcttcgagggaagttttgactataaaggtcaagagtggagatgaggaaaatttcaagtgctgatgttattcccattcagattgagaagccaagcaaactggaaatcctcatctgtttctgaagattcctacagaagtctttccccacctcctctaccaccaaaacaggaaacaaggcagggagacagaaagaatgggataggaaatgagatatgaaataggatagggaatggcttggtttttctgtaccaaatcccctatgggacactctttttgtatagaaatgaactaatgtgcactaacttggtggaaatgggataagaggtcctgaatctcataagtttccaaacacattctggaaacacattgctttccacacaaattactgtaatagatggggaattttaagttccaaactgaaacagtggaagaaccatttgggggcagacatgtaaagcacttcaggctgactccttctcttcactccacataggtagctgttcactctgctttctgcaagacttttcatgctctctgacatttggcttaatctgataccagagaataggtgattattttgtcatcaaaaaagtagaaacattgaatttgaagggaatttaaaattcgtgtagcccaggcctttttcctgagaggaaacagattacatgggttaagtgacttgcggttactcagctaataattagatacagctgacttaaagaacccccccccccactccaccccatttttttgtggttgtttgtaacaaaaatatttgctttcacaaagcgtaatctattggggcctgacctagtgatccaatctgaggcctgtatgatttgaacatttgataaacactagagctcaaagaaagccttcaccaacttttgttgcctggatttctttccctcaaaagttgatgagaatccatataactgatgaatttctttgcagtccgtttacgggtgtgtgattaaatcccaggtttctcgtggatgattctgagcttgcccatgctttaaggactcattgatccctgcatttattctacagcccaatacaagcagatatggaaattgtcctggcatcctggatgcattcttccatgttatttttattatattatatgatgaaattttgtaaatatgtttcctacatccagggatgcctgcacaatttaggggcactcaaaagaagaatgagagaatggacttagaattatgtgtaatatatattttattgtgctcatatatttagaggccttccccatttcaattgtgcaaatgcttgaaaaagtttctctggaaaaaaaaatatattaaaacagtttacccatctacacttcatttcattctccccaaaactaatcatctagaatttaaaataaaccataaatctaagagagaatgtaggggagagggaaggagatagaaagaagagggtattgattgagaggttgattgatttttattgtgatttatctgaggtcaccaaaaaggcatctaggtttctcattttctctgcttttaaactggacaagtctacccatttaattcttccaaatacaaggaagaaaactaaacagaatatcttattgaaaatttgcgcttctggtcaagacatgaaaatatttgcaatggtccatctggattgtaatctctagataggtagacagtgttcctttgaattgtgcatggtggcagggcacattggctcacacttgtaatcccagcactttggaaggccaaggtgggaggattgcttgaggccagcagtttgagaccagcctgggcaacatagtaaaacacaatctctacaaaaaataaaaaacaataagctgtgcatgggagcatgtgcctgtggtctcagctactcaagaagctgaagccggagggttgcagtgagccatcattgtgccactgcactccaacttgggcaacagaatgagaccctgtctcaaataataataataataataataataattgcgtgtgcttaaaataactcactacttaaattgctaatctgttttagaaagtacatcaacagattactgtgtttttttctcattcacttgaatttaaaattggatttttggtaacaagatatgaggcaaatgggtacaacaactgtacagtataaattgctccaggtgatggtgccatagcaaaattattacaggcagattcaagatacaaaaattatttatttgacagcaagcagaatgacaaattactcagaggctgtgtacatgtgcttctataattgctcataaattattatggttcatgttaaaattcaacgagtttgcctagaccacatggttttattttaaataagaaagtggcaaattattagcaattgggaaatgtaatctgcagtataaaatcattacactggaacgtggtaattttgtgtgcaactttttcatttgctatcgcctatctgtcaaaatcttcattttgtaacagtttttaagattatggagcttgcaacagaaaaatctgccactcgaatctcactaaaatattatttgccataaattagagttaattataaggtggatataacttggaccctctctgaggggatttagttactggatggcataagatacttttcctcatgatgtggctttcctggctttggtcctaaaagcggtgttatgggagacttcaggtgacttacctcttcatagcttcttgaactaagtttaatgattggaatacattttcttagcccaggaataaatgtctagtttttcaacccagtctatgcccactcaccattgttagatgacactgtaattccagagttacataataatataaactagttgtcatacttacgctacaatggcaagagcacttgttatagagtcaaacatggagttgtaacttactgtatgacataagtaggttgcatagctcctctaggcctcagtttcctatataagttgtaataccgtgaactctctgtctaccatccatgactgctgtgaggaagaaaacaaaaagccatgggaaagtgctttgtaaataaggccccatagaaatggaagacattaattttttgctgaactgaaaatcaattgctttacaatattattcagagtatatgtggtgagggaaaattttggaacttaaaaagcactcaaatcaggcacagtattccagggcatgttatgtatagtggccacaatcttctaaagagaaaataaacacaactttccttaagcatttatttctgagtttcaaataatgttaggacaaagatgtttcatcatttcatgtaactgaattattatatatttttaaaatgcttaataagagaaatataatgagtgcttttttataagcatttatacatacacacgcacttacgtacacatacttaggaaaacgtggatactgtgtaacaccatgtatggagggtgtgttagtccattaggtcttttataacaaaaatatcatagactaagtgtcttgcaaacagcaaacatttatttctcatagttctagaggctgagaagtaagatcaaggcaccagcagatttggtgtctggtgagggtctgttcttcccattcctcatagacagtgccctctagttgtgtcctcatgtggtagaaggaactcctaatcacctcctcaaaggccgcacctcgtaattccatcatgttgggagttacaattttaaaatatgaattttggagagacgcaaacattcaaaccatagcagagggacagttaagcaattgtcttggggtccctttaacttctagatcagctattgcaaaactatgacccaggggctaaatctggctcaccagctgttttgtagttttactggaacacagtcatgctaatttgttacatactgtctatggctgctttctcactaccgtggtagaattgagtatttatggcacactatggccaaaaaagctgaaaatatttatcgtgaggccctttacagaaaaagtttactgattcctgttctatgctttgctgaaaaggctgctcaaaaagcctccctcgcttttgccatttcaaatgaaatgcacatttcccccttgatgtgcaccaggtttgtagttacttattttgccaaaagaaagaatacaaaagggtcaactgacatgactccgggttttgcttttggtttcttccatttatcttctcaactttccccataatcaataagaatagtagataatcttcactaaatggagttttcttgaaagtttggaaggattttatttttcatgcaagtattttgggaaggtgaactgtattttctagaacctttgatatctctgctaatatgtcgtgcatattttacattgagttagcagaatctgcaagtatgataccacaacaaatacattctgtgctttttaccttggtttctgggagctcctgtcatttctgtatctctaggtcttgagagtgtatggctgaacaacaccccattcctaagaagatggtcatttcaggctcaaaaaagagagtagctacttatagttaggcttggccctaagtaggaagagactggcccaaggtcctttcctatgtaaacttgtctgtcatgtcactgaactttatctaaagacctgccatttgattgcaccccctccactccacctgagtactacagaggagagttaagagaactcttccaaaggttatctttatacagtagcaatactctctacaaggtatctcagcagctgacgaattagacatttattttaatgagttgaagacattcatgtgttcttgtcaacagttaaaggtaggaaaaaataacctaaaatgatttcaattgcctttggaaaaaaaaaaaacaagcagaaatcttgtattatcttggaattcactgattctgagctgacagcagattgctcagtaatcgggctgtgtctcagaagcagtgatttgattgagttctcatattcttctttgaatgagagatgttggtaagatggaaactggcctgagctgatcccaaaacttaccagactgaattatggttaaatgtgttgagagtgaccaatgtgttgagggcgaccaatctgttgaagtttgcccaagactgtctgtatttaaaactgaaagtcctgcattctgggtaacccttcagtctcaaggaaactggaacaagttggttaccccagggggactatgagataaaataatagctcgaccttgatactgtgcaaagaaatgtgaataagataggtgaaataccagttagtgacagaagtgagaaatgctattaagcaaaaggaacagggcaagaacaagagctctcttaagttattgcaatggttagcatacttcaggggctcctgacttaaccatatcctcctttaagtactttcaattcatgctctatatctgctatggattgacattatagcatagtgcttaaaacctcagccttgggaatcagacagtgtgggtttaaatcctggctctaccactgataagctgagtgagtttgaacggattatatacactctctgcctttatttcaccatctgtaaataaggttactaacaacagtagctgccttgtgaggcttagggagagattaaacacgtcattttaaatcactttgaacagtttctggaacatagtatgtgcttagtgttagctactattataatatttaaatcctgttttattcttctttgcacatatcactaccgtgtaggtgtctcataggcacctccagctcaatgtatctaaacctgaactcttcatccttgtccccaaactgctccttctcctgtgttggctctttcagtgaaggaaggaagttactttagattattctggaaggaaggaagttaccttagattattctgcaaaccttagattattcttgattcttttctttccttcaccctctacatacaggaaattatcctttgtactccccactgaccattcatttattctttattatatattcttccttttattataaaacatttgagtgccacccactgttccataaaaatttgggagcttaatagtgttgccactgaagcagaaacctaaaagccatgagccctttccatagttctccacatgcaatctcttacaagtctgatctacctccacatcacttatatccctatctactctactgttctctttgctacttccttggttcaccttcacttttttatctcaactatggtgacaatttcataaatgatctctgtgcttctagtcttgacctcttccagtctttgtttcacgctactaccagaatgatctttgtaaaaagctaatcattagagatccttcaatggctccacatggctttcaggataatttccaaacttcttgacttactatacaaggcctttaaatgatctgtctcctatttacttcactggtatcttctaacatttacccatatgctctagccatatggaaccacttgtaatttcctgaatatgtcacattgtttcaggccttcatgacctcataattgtagtttcctttgcttgggatgtcctgtcctctgtattcatctagctattggctcctcatttttcaaaatttagttcaagggccaattcctctgcagatccctctttgatcttccaatctggctcagtagctcccaagacacctcattctttctttcgtggtatattgaagatacctctggtatgcttaatggttaaaagcatagccttgggagcagtatccttgaatttgaatattggctctcacacttaccagtaaagtggccttggatgggttacttaatcctcagtgtccttgtctattatatggagaaatcatattgataaaaactacttgcaaggattagataagttaatacacgtaaagtccttagaatagtacctggcgcatggtaagcccattgtattatctattaatatcatcaccacaagtacttatttaataatcccactagaaggtaagcttcctgagacaaaggcccatatattatttgacagtgtagccccagggcctattccagtgcctgacgtataggtgctcgataaatgttgttgaaaaatgaaggaataaataaatgaaataaagaaatggagaactgaaatgccttccccctccaaaagcaattaacttcccaacccaccaagcgccatttagcttcatatacctgcaagagggagagactagtgactttagctggtccttatttttacatttgtaacatctactgtgctatttggaggaaagtatgcaggcttggctccattttcaaatgccagaagtttttgccttcactatcactttaaaccttgtgaaaataatcaaaagatgatactgtcccctattgcaaaagtgaaattctagcaaatcacaaaagaataaacggtgaaaagtcttcttaatcatggagctagctgtgctccatcctgctcattctggacacttggagagatgatttagagaatttgccagattgcagattaatcagaaagcacatgaactaaggtgagtgacagcacagtaagaagaacatctctgcttcacataaatggagacaaattgacttacatttgaggctgtacagttacacaggagaagtcttcttggttgtgtttttaaagtggagtggggaaaagccatcaatttgattggcaactcttgtataataaaaacttaaactaactacaagaccatttttataatgccaccaaatgttatcagccttattataaattattacattactttcatctatttctctttgtcatcgttactactctgtgggatttgatcttgcccttcttcaaccagataactaggcaagctggattaatggtccaacttctctcatctcttatctgaacctacaatcaaggagtccccagatcatcaactgaagtagtgagatagcagtttgaactctgatattcagatatagtgagatgggggaaagggttggcccaacactctgtgatgaagagatgggaatatttatcattttatgaccaacaattttctggccctgccaaaggaatttctgcctaaggaatgatttcataactctgagtcagctatatgggctgagatgagattttcaggagatatttttacctttacttggtcaattttgtttttccttcttcagacctgtttatcatggacttgttccatttgcaaaaccacttttgcattgtagctaatgatggcaaagcacctggtcgatttggttgattcagtctactggtgagtcactttaacaggagatgactccccgccattcccaaaaaaaggcagttctttgaaaacagctttggaagggctgtaaagctaagagagcatagcaatgcctcctccccccgcccacccccccacatacccacatccatgtggcttcacttgcagtagaagtggcacagcttcattgcaaaactgtaaagctggggaagtgtgtcttcaggagaggcagggaaagaacatggactttggagtcagagataccctgttttgccattttattatagttgttattattatcagttgcatgattagtatttacagagtatttgtaggtgccaagatctaagtcaaagtcttttatataatttgcatttcattctgtaatgacccatgagaaaggcactattataattccccttgtataggtggggaacctgaagcacagagaggttatcttaattgttcaaagtcgtacagccaagtcaatggcagatcctgaattcaaacatcggtatatctgattcttaacatttttcttctgtttctctaacaaatacatgaacttaatgaagtaatataatcctgagtttaacaaccattatgtcagagatcggctacagtgatgccaacacattgatccatcagcccttgggatagccagacaggcctgggatggccagccacattggtctgctagaagtcttgtcattttatcccaatgaggcaatacattttatagttttttatgtgtacgattacatgaaaaatttgggcagcaaaatttaacttctacgagtgtcagtgttttcctctaaatgcggggctattcatatgttttgctaaggttttggtgaggattaaatgagtcattgtattagccagtgttctccagagaaatagaaccataggaggtgtgtgtgtgtgtgtgtgtgtgtgtgtgtgtgtgtgtgcacgtgcatgtaaagagagagagggggagggaaggaggaagagagagagagagaaagagagagatggattaaaagtattggctcataagattatggagactgacaagtcctaaaatctgcagtcagccagctggataccctggagagccagaggtgtaagtttcagtccgaatgtcagcagtcttgagacagaggaagagccaatgtttcagttcaatctgaaggcaggaaaaaaaaagattgttccagccctaaagcaatcagacaaaaggaattctctcttactctgacttttttttttttctattcaggcctttaatggattgtatgaggctcacccacagtggggaggtcaatctgctgtactcagtctactgattcagatggtaatctcatccagacacaccctcatagacacgccagaataatgtttgaccaaatagctggataccccatgggcctgtcaagttgacacatgatattaaccatcacagtcaactaacatgatgtttgatatgtggtaaggacttaacaaacgatccctcccatcaggtccccttctttgatgtttataacaactctacactgtaaacagagctactctttattttacagataagaaactcatattatacccaggtatcttcaaatcttctatccttttaactataccatataaccttcatgccactttttgtcgaatgatgttacttaataaggaccagagagcccctatgggccaaatactcctttcctttttccttctttcagctctacccaattaaaagtcactatccagagtacaatttattcagcaggtttgtgctgggtgatgatagtgggtattggcttaatttgataaaatagtctatgctaatacataataatgatatctctgctaggagttttgtcatttctagagtacaagacactctaattcagtgaaaaaaaaaaacaaccatgatccctgaagtctctaaaaggtggtacaaagcaagtaaagcacttttggttgagaaactttcagtttctttctttcttttttttttttttttttttttttttttttgagacagagtgtgactctttcacccaggctggagtgcagtggtgcggtcttggctcactgcaacctccacttcttggctcactgcaacctccacttcccaggttcaagcgattctcatgcctcagcctcccaagtagctgggattacaggtgcatgccaccacacctggctaattttttttatttttaatacagagagtatttcaccatgttggccaggctggtcttgaacttgcgacctcagatgatctgcccgctttggcctcccaaagtgttgggattacaggtgtgagccatcactcctgggcccagattatttcaaactgaattagactttatggatggtagggatttggtggagtgggtggggaggtaggttctgcttgttcctcctataaattgagttggtcctaggtagtcaggaagaataggctttttatgctgtagctttgaaagccaatggacatcaacaaggtgtccatctcaggtaccttctcctagccacctgataatattaaaatcaatgtcatgaaggatcaaaagcaaatagccacaatttctaacttgttataaaaagcttccatgcagcttgataataatgaccctctaaaaaaatgtaaaacaaagggagagagtctttggaatcatttgtatttgtcagctaaaaaacagtgggcaaatatcatgataataggaaaaaaatacaaatgagcatataaaaatatttataatatcttaagatgagattatcagaatagttaaattatggttgccagtatgaactgaattatcacttctgatattatacattatttccaataatatagatgatcattccttatattaaatatttcaaatgttataaattatattaccaataagaataatcactgctaaagttataaatcaaattgtacttactattactaatattgacaataactaatacactagagctaactagatgatgttagatactgtttgttctaagtacctgacatgtattcattattaaatacaatgaccccatgaagtagtcacaagtgtcatttgttttgctgacatggaaactgaagcacagaaatgttaatatgacttccccaagaaaacttagctaagccataacaggagtagtaagtggacctagttccagcacccaagtccttaaccccatgctatactgccagtcaagaaatttcttttctagccttttctagtatctcactccatttaagaatctgtagaattaggcaaagagtagtgtaaaaagttcaagaagaactagacttcatgaggatttcgatgaagccctgcttctttcatttttaatttttgaagtaggattcagaaaagtttagacactggccagaagtcacacaacattagtcaaggtgcagccagagattggagcctgtgcctaggttcccccaattatgaaggtaacaggcagcggtaaagggtggtagacttcccctggagatgttcagcttatattccttcatggagttgttgagccagcagactgagataaaagatgcaataggattttaaaagaaagttcagttttgggaggagtctaagaccctctatgaggccccacctctgctaataaaaggatgtccaaatcttttgagaattcaccattttggtctcaaaattgaaagaaaatggccctatttgatcctgggagttgtggcatctatggaggcagacaacacttcgagtaggtatccccacagtgtctctacagaacctgtgacagagacctctggggcccatggtaggagaagtttcccaggatgtgaatgcagaagagccatgtgtcactgaagatggtcacacacagggatagagagaataggactgtggaaatcaggaagaaggtggggtatgtggtaggtgacagaaacagcaggtcccccgttcaaggccagcttgctccctttggctctcaactccacatccccctgtagcatagggagtaaggctaggtttatattctgaagggcagtcttttccccctgccctgtattttggaggtctatggaggcagttgatctaccttccatcatatagaatgtggcacagctgggaacattgatcttaatatccccatttgttcctgtccaggcttcaagcctgctaaactcagtacggactcaaatagtcaaaaactgcatgttgtgggtgtgtgtgggagggtggtgggggtgggggtgctggacagaccttattaaacacactcccattaatctctacctcaccttacctggcccgcttacctgcttatgtcagcccagaacatatacacccagaagagtggagactagtgctggtggaacagggaatgcccctccatgtccacctctaccactggcagttcatgcatcagaaaatctttccagaggagtcacgatgtgacagtgtcaaatcatagattcctttaaatccaacccttctctggctctagatggagtgagaaaagaatcagctatgcttggccagtcttgggtgtatatttggaggaaactcaatggtcaaaatgcccccatggcatgtgtggaaggcatgagggtaaagggtttgaacagagcaaaggcagcaagggcaagaggctgagaacattatggacaaaacgaatcatcctcctgaatggatgaggagaggaactgatatgtggggccccctcaggggcctgataacctgtggaggagaaagggaaggaggttggggattaagaagttatattagttttctattactgccataacagattatcacaaatttagaagatttaaataatacccacttattagcttacagttttgtatgtcagaagtctaggagggcttacctgagttctctgtttagggtttcaaaagtcaagtgtcagccaggctcagctcttacatagggcttctggggaagactccactaccaagctcattcaagttgttggtagaattgctgagattcttgtctccttgctggctgttagccaggagctatgctctattcctagttgagtttgctggcattccttctcaagtgtcccccctccatcttcaaagctagcaattttacatagagtccctattgtacctaagattttttctgacttccctctcttctgcaactcgagaaagctttctgcttttcagtgcccatgtgattaggtcaggcccacctgaataatctccctattttgtggtcaactgagccatataatgtaacattaccacagaagtaatatcctgttcacaggttctggagatgagaatgggggcatttggggggtcattttagaatttctgctacaagagtgtttatggagttggagggcagggacttagtatttcactaggaacaccaagctccaaagactcaccccatattcttagccaaatcatggtctagaaccttaaactttggttggagagataggcgtagggataagatgatgggcataccctgttaatggtaatctcttaataatttgtggtctaggtggtgatgttgggcctcagaaactgaactacaatgactaggggtgaggacagaaggtccttaagattctgggacttaagattttcccatccccaagtcttctaaaaacagagtatgcagagctgtcctccccacctggccacctacatggaaatattattcacccctctggaatttcatgataagacctatgtggtagggacatttctgatgtctctccaggctcactcatgtctcagtcacattaaacaacctagcgatatgatgaataacaactgcgggtttgcccgtggatggttcaggacagagccaggagcaatgcggaagccaacaggaaaatgaggtctgatatctaactctggttttctagagggaggagagtttccttggagaagggaaagaaagtagccaggcctctgttgtctggtgggaggaaggtacactgaatctggagctcctcatagcagtgttcttaaccttggcagtctgggttgtgttactgtcaaagtttctgcaggatgcccatgctcaatgacagataaataattaacaagaggaggctgtggcctggcctaggtagttgtgccctggtaacccatactcccttggttttaccctctagagctttctcacccagccgtctgctagcatatggagttgatgttgaggtgttatacctagagttctaactgctgcttctttttttttttttttcttgtttgagacagagtttcgctttgttgcccgggctggagtgcagtggcatgatctcggctcactgcaacctccgccgcccaggttcttgcaattttcgtgcctcagcctcctgcgtagctgggattacaggcacccgccaccatgcctggctaattttttgtattttagtggagatggggtttcaccatgttgcccaggctggtctcgaactcctgagctcaggcagtccacctgtctcggcctcccaaagtgctaggattacaggcgtaagtcactgcacccagcctctaactgcttcttaagcagacttccaaccaatccttttttttaggtctcatctttaccctcctaccacttctagagggaacccctgcctctaatcctttcctatgaggagctgacaaattttcaaatctccaccccattaacaaatctcccttgttccttctctcaattcctcattcaccctcattcatcatcatcattcatcctttcataacccattccctgcttccccacggatgaagactcactccattctcttggcaatcttccaggccatatcagttgagctggaccttatccaagtatatattggacacatgcaggctggaagtcttaacccgctgtttgatcttgaatattggctgcataaacagacataaacaactggctgttgacatgacatttttcctttgagcagggagggcagggagggtggatgaagattgggaggatggtaccacagctggagagaaaagggctgttgtcatccacttactgagtacaaggaagagtatctttctttacccttttgcctttttaaattttgcttactctttttacctgggctagtaggaagctaagagccatattgaatgattaaaaaaatttttgaggaaaatttattgtgtaccaacactatacaagatgcttttggcctgagctatttcatctgagtctgctgccaacataaggagggacaaattaatccccaccctcaccctgtacgctctggctgagtcccgaacatcagcaccttcaatgtcacccactgctggtgcctttgactgttttacacatgagaaagtggggaactcttcttcttcactgatataacaataagatcgctataatttgaataaaatactagttatgtgtgataattattcctatcaatacccatgaaagtagtagcggttaagagaaaggaacctggactcaaactggttgtgggacctcaagcaaggcatttaacctctgtctcagtttgctcaaattaaattgggtatatttataacatctgtcttataaggttgttgtgaggattaaatgagtcaatgaatgtaaagcacttaaagcagtgcttaatacacagtgaggagttaagaaactgtactattattatcatcattactatcattattactactatttaccagcttataaatcacttaaacttgacaaaaaccctgtaaggtgtaaatttctccctaatttacaagaaactctcattcctcacagtagcattaattccaattatagtactaacaaatgcaaatctcaatcctcacagtagcattaattgcaattatagtactagcaaatgcaaataataatagaaataacagtgatgcttcataattatgtccattttacagatgcatgccaagattatcaggagtgatattaattatgattatgctatcaatagagtatgttactgatattccaaaatcatcttaatttaacaggtaagagcagataaaacaattattcttatattggtatccattattaggatagttaccaaaataacattagcaataataataatgataacgttaactaggtaatataattttgccatttcccagagtggaaaacaccataccagcagtaccaggaatggcagttactatggttttttttaaaaaaatactgtattcaaatactgcaaataactgcattaacattttacctcacttattctgattctgacaagatgaaagggtaatatcaggattcctttaacagcatataactaatttgttattaactatatttattagtaaattattaattaaaactgtgctgtacttactgtaatacttgtaatgattatgatatacataacaatacataatatataatgatattgattataacgattaatggtatgaccatttagttatgacctgaattataataattgatgctgtaaaggtgaaattattaaataatataataataacgtaaacacaaataataatgggtgcagagtaattatactcagttaacaaaaagtaaagcgtaatagaaactttcctggtagtacttcctggttaactaatattataatattatgatattaatgtaaccaccaataatagtattaaggatatactagaattaggcccctttcactgcagagacagtcagtacatgggcacagttaaatatatttaatcctctaacatcaacctaaatgcatatagtaacatggaatatcctgtaactacacccatttcccagagggaaaaaggtgaggccagcatactgggtagttattagggcactaacactacagagacacaagttatactcaggaagtatgctatatgtggccatttcccagcaggaaagtctgggacagcttggccatgggtgatgccccttgatcagcctcataatgccatacttctcattcaccccaatgcatgcccccagtcctggccccgagaagctttccaggatcaccggcatcctgagagccccagtcttacctcagccttcatccacagagcatgctgccttccgaaggtcattgtcaactggcacctccactgtgccagttgcataagcacttcctcctcaagggcacctactgacatgtactcccaggtaccccacagcaacaccaccccatccacctgtggggagagaaggggggtggggctgcttctgggggcaagcaaggaggagtcctccctctttcattaccacccctccttgacattaacctgggtgaggccatagttcaccaggtggactatgtgaatgaatttgcagggtggaggaagtgctcagggtctgggagctgctgcttgagatgatgaaggaggggttttaacccactgatccctttgtccaatcagatctggaattaatccaagaatcagtaaatttcccttactcccaacctatttgaacagatacatgaagaacactagctatcagtgagtcatgtagctatctgagggaacagtgtatagcaggggtcttcaacctcctggaccacagactgtggcctggtaccagtctgtgtcctgctaggaaccaggccacacagcaggaggtgactggcaggtgagccagtgaagcttcatttgtatttacagccactccccaattgctctcattactgcctgagctctgcctcctgtcagatcagggacagcattagattctcataggagcacaaaccctgttgtgaactgtgcatgccagggatctagattgcatgctccttattagaatttaatgcctgatgatctgtcactgtctcctatcacccccagatgggaccatctagttgcaggaaaacaagctcaggtcccactgattctacattatggtgagttgtataattattttattatatattacaatgtaacaataataaaaatgaagtgcacaataaatgtaatgccctagaatcatccccaaaccatctcctcccccaatccctagaaaaatcgtcttccatgaaaccagtctctggtgccaaaaattggggactgctgtgtagaactaggcatggggcacagccattgcaaaggcctgtaggctagaagctgctttactggttttatgaactctctgaatggccctagaatgtacaaatttgtgtgacaaataataaaaatacgtaccaactaacaaagcttttcccaaccctatctggctctactccctcttttaagtataattacaattttatataagaaatgtttatgtttataatattttatataagaaatatactaggatgaatcatacaaaattgtcaatatttgaactttctaaacaatttacctttcttgatacataacaactgtgtgtatttatggggtacatgtgatactttgttatatgcataggctgtgtaatgatcaagtcagggtatttaggatatccatcacctcatgtttttatcattttgatgtgttggacacattttaagtccacacttctagctattttgaaatacaaaatacattgtttttagctatagtcaccttattctgctatgaaaaattagatcttgtttcttctatctaaccatatgtttatacctattaaccaatctctcacctcgccccacatacacccttccccaactctggtaactatcattctacttgctacctccatcgagaccaattcttttagctcccaataggagtgagaacatgtgacgtttgacattctgtgactggcttatttaacttaatgacctccagtttcatccatgtttctgcaaatgacaggatttcattcctttttatgaccacagagtatttcattgtgtatagataccaaattttctttatccagtcatctgttgatgaatacttaggttgattccatatatttactattgtgaatagtgctgcaatttacatagcaatgcaagtatccctttaatatacggattccctttccttaggataaataaccagtagtgggattgccagattgtatggtagctctgtttttagtttctttttgttttgtgttttttctttggtaaattgccatactgttttccataatggctgtattaacttacattcctaccaacggtgtataagagtttccttttctctgcatccttgccagcatctattatatttttctttttgatgatagccgtcctaattagggcaagatgatatctcactgtggttttgatttgcatttccctgatgattagtgatattgagcatttttcatatatctgttagccatttatatgtcttcttttgagaagtgtctatttgtgtcttttgcccacttttcaatggagttatgtttttttcttactgagttgtttgagttccttgtgtattctggattaactagtctcctatcagattaataatttataaatattttctcccattcaacaggttatctctttactctattgattattacttctactgtgaaggagttttttaatttaatcaagttctatttgtctacttttgttcttactgtctatgttttagaggtcttagccataaattctttgcctagactaatgcccaggagagttttccttaggtcatctcttagtatttttagtttcaggtcttacatttaagtctctaatccttgttgagtttctccttgtatttggtaagagataggaattcagttttattctgcatgtggctatccaattttcccagcaccatttattgaagagggtgttcttttcccaatataagttcctgttggctttgtcaaagatcattcgtctttaaatatgtagttttattcctgggttctctcttctgttccattggtctgtgtgtctatttgtataccagtgtcatgctgttttggttactgtggctttgtaatatattttgaaatcacgtaatgtgatgcctgcagctttgttctttttgctcaggattgctttggctatttcagctcatttttgggttcatatgagtttttgggttgttatttctaattctgtaaagaatgatgtcagtattttgataaggattatattgaatctgtagattgctttgggcaatatgtttattttaacgatattaattcttctgatccatgagcataggatgtttatctatttgtttctgtcaccttcaatttctttcaacagtgttttacagttttccttgtagagatcttttacctccttgtttaaatttattcctaggtatttttttttttttgtaaatatagtgagtgggattgctttcttgatttttttttttgcctaggtcattattgatgtataaaaatgctaaattttgcacaccgattgcgtaacctgtaactttactggattaattgatcaaatcaaagagttttagtggagtctttaggtttttttagatattagattttatcatcagcaaaaagggacagttttacttcctcatttccaatttggatgtcttttttttttcttctcttgcctgattgctctggctaggacgtccagtactatgtttaacagaagtggtgaaagtgggcatcctagctgggcacagtggcttacacctgtaatcccagtactttgggaggctgagactggcaggtcacctgaggtcaggagttcgagactagtgtggccaacatggtgaaaccccatctctactaaaaacacaaaaattagccaggtgtggtggcaggcaactgtaatcccagctacttgggaggctgaggcaggaaaatcacttcaacccaggaggtggaggttgcagtgagctgagactgcaccattgcactccagcttgggctgcaagagtgaaactccatctcaaaaaacaaaaacaaaaacaaaaaaaaaagaaaagaaaaaaagaaaaaagtgggtatccttgtcttgttccagattttagaggaaaggctttcaacttttccccattcagtatgttgtcaactgtggttttgtcatatatggcctttacctttattaatttgagatgtgttccttctttgcctagtttgttgactgtttttcatcataaagagatgttgagttttatcaaatgcttttttctgcatttattgagacaatcatatggcttttgtccttcagtctgttgatgtgtcgtatcatgtttattgatctgcatatgttgaaccatccttgcatccctgatataaatcccacttgatctcagtgtattatctttttgatgtgctgttggatttcattgtctagtagtttgttgaggatttttatgtctatgttcatcagatatattggcttgtagttttgttgtgtccttgtctggttttgctatcagtgtgatgctggcctcatagaatgagttagggagaattccatcctctttggttttcttggaatagtttcaggaggattggtattagttcttctttttatgtttgatacaattcagctgcaaatctatctgttcctggggttttcttttttgggaaactttttattaatgatgcaattgtgctactcattattgttctattcaggttttctatttcttcctgatttagtcttggtagcttgtatgtttccaggactttatgtatttcctctaggttttacagtttgtgagcatacagttattcataatagtctctgatgatcttttgtgtttctgtggtatcagttgtaatgtccctcactttatttctgattttgagttttctctcttcttggttcgtatagctagtggtttatcaattttgtttatcttttcaaaaatccaacttttcattttgttgatcctttgtattatttcttagtttctatttcacttagttctgttctgatctttttatttctttccttctgctaatttggggcttggcttgttcttgctttttagttccttgaggtgtattgttaggttgttcatttggcatctttctacttttttgatgtaggtgtttactactataaacttcttagtacttcttttgctgtatcccgtaggttttggtatgttgtcttttcatttttatttgtttcaagaaattttttatttccttcttaatttcttcactaacacagtggttgttcaggagcatttgaacaacttcatgcatttgtacaacttccaaagttcctcttgtttattttttgttttattctattgtggtctgagaagatatttgaggtggttttaacttttaaaaaaatatgttgagcctttgttttgtggcctaacataccatctatcctggagaattttcaatgtgatgataagaatgtatgttctggctgggcgcagtggctcacgcctgtaatcccagcactttgggaggccgaggcaggtggatcacgaggtcaggagatggagaccattctggctaacaaggtgaaaccccgtctctactaaaaatagaaaaaaaaattagctgggtgtggtagcgggcgcctgtagtcccagctactcgggaggctgaggcaggagaatggcgtgaacccgggaggtggagcttgaagtgagccaagattgcgccactgcactccagcctgggcgacagagtgagactctgtcaaaaaaaaaaaaaagaaaaaagaaaaaaagaatgtatattctgcaggtgttagataaagtcatctgtaaatgtttgttagatccatttgtttaaggtcctatttcaatccaatatttctttgttgatattttggtctagatgatctgtctaatgctgagattggggtgttgaaatccccctcattcttatataggagtctatctcttcctttagatctaataatattttctttgtatatctgggtgctctggtgttgggtgtatatgtattcagaattattatatccttttactgaattgatccctttatcattttataatgaccttctttatctctttttattgtttttgacttaaaatctgttttatatgatgaaaatgcagctattcctgctcacttttggtttctgtttgcatggaataccttttccatccttttactttgtctatgtctttatatgtgaagcgagtttcttgtaggcagcacgtagttgggtcatgtattttttttatacattcaaccagtctttatcttttaagtggaaattttaatttgtttataatcaaggttattattgataagtgagtattcctgtcattttattaattgttttctggttgttttgtatgtgtcttggtcttttgtttctctcttactgtttatcattgctgtttgttggttttctatagtggcagcagtgggacagacagatggataggatcttggactcctggccagcatgtgtggcatcagcaataatagtagtggtgatgggacaacacttggactccctggcagcactcactattgttagcaaggatgggaggacagtctgcagcccccagctgggtgcatgcaggtgggtgcaggtagtggggatagtggcaggctgggtgggctcatcctcgggtctctggtaggaatgcatagatgccagcaagggtggactgggcatggtggtccctaggtgcctgcatggcatcctcggcactgtggcgagtggagggtggtgtttcagactgggtgggcctatctctaggtcccccagtggtgcacatgggcacagattgtgataggcagggcaggatgacccactgtggtgggtgcagagagcctaatgtcagagtgcatgaagcacacagtggttctgttgctgtaggatgggcggtggggagtaggcgggggggcaatggttggtgttacttggagcaactccaagccagtgggcagctttcaggctttggagaatatttgttgtggcctctggtggcagcagcagcagcagttgtatgcagggaaagcctgtcctcatggtgtgttagtgcacagcagccatgctactttggggatagaggttgctgtcaatggcagcatccccaggcaagtgggtggctttcaggccctggggagcacatgcttcaacgtctagttgtggcaggagtcacaggtgtggtggcagcagtgtgtggggagaacttgtcatcaagtcacatgctagtgtgcaatggccctgctgctggtgtgggcagggtttctgtcaacagcttcagataggcagctctcaggttttagggagcatgtgctttggctctctttgtcccaggggcagtctccctgacatgttacactgctctgtttcctggagtataggaatctgtaggggctagaatgttgggaaccctgccacactgccaggcccagctggcattgcaccactgaagctctccaggtgaatgcagctggatgtaactggggctccaggggtttggagatgcagggactaatgtcagcacagaatccagtctcttgagggctggctctcaacatggcaccatggcacagtttcttaggtctcaggggatgtctgggatccaggattagctagcaccctctgtggagcaagctgtcacatggtctcctggaagctccttacattagtgccaggttccaggaagattcagggtctctcctatggctagggttgcaggagatcatggtgggaatgtggactgctggggtcactcacttacccttcccccacattggagagtctctccaggcttccagcctatcctagccaagcaagcggcctcactttcctttccatccttttcttaggtgtttcctgtcacttctttgttgaaattcagcattctctcttaggtgttctctttgaagtgtaattatgtactattttggttcttctttgtggaggaggtgagtgtttgatacctctagtaagccatcttgaatccttcctgaatatttgcctttttaacttaaaaaaaatttcatataattaaactattgcagttgacatataaatgtaattatatatatttaattataacaatatgtattatatacattatataacaacataaaatatttgaagagcacatgatataaatacatacacatttataaattatgaatataatatgcaattgaatacatttaaataatataatttataaaatatgaatatgttgtacaatctgtaaaatattggaatataagttattataatatagcatataccaagtatacatatgataatggtatatagtattattactgtatactatacatgtattatttcgtagtattatgtaaaatgaatatgtttgaaaatataggttagaatatttcataatgcccttttactgtcatgaagtgaaatttataggtaatatgactcacctatgacctaaatttgaaaaaaaatgtaatgaatttaatataaagatgaaatataagtaatttagtttgaactaatatgtattatatgtaaaggcttgagaggtacagtagaataattaacaaaataagtatataattaacataagcagtagtagtggtagcagtaggaataggaaagccttactgagcattatctgtgtgtcagtccctgttctaagtactttcaggtgtgtgatcacctttacgtacactctcttagacgtcagttgactggaacacatctcagaagaaccttcagttaactgacatttattcccacctacaccctctcccttgtaagacaagcttttagtcactaatatctttttttcaagatacttatctatgtatataagagcctaaacttgaaataaatagtggttatctcaaggcaggggtttgatatgaggaatgaggataggactgtgtgtgctgaataaaggagacattagctatatctgcaatgttttatttctttaataaaacaaagctattgaaagtgaattggaaaaaagttagcattattaattttgaatgatgaaatcctgagaatttttaatattattcattttagttctctgttaacattgaaattttaaaaaataataaagaaaatcaccaggagactttccaagtgatcacatatgcagcttatcttcccaaccttgaaactcaccaactcagataatccattttaccggtactgggttagaacttgtctggtttagcaccttcatttctttaaggagtagaaactggctttccttaaattgggtatcttgttaatgaggcagaggtggaaagataactcagattttctgatctccagccagctctctactattttcagtaccttggcatttgggtccaggatgatgacctcaaaagcctgacatatcttcagtcaagccacaaggattttattcgcttcacaattctctacttattgggacagaaaagtggattcagatgttttagaaaagatttctgaaaatccaaaggttaatttccagctaatgtgaaaattagttaaccaaagcagttcactccactagcccttaattatgtgagttatcgcaggatgagaatttatggattcagcactgtatatccacaggttccacatccatggattcaactaagcatggatcaaaaatattaaaaacaatataacaataaaaataacccaaacaaaaatagaatataacaactatttacattgtattaggtattataaatactctagagataatttagagtatgtgaaacgatgcgtgtaggtcatatttcaaatactacaccattttatatcaaggtcttgagcattcaaagattttattatcttaatgtaggggagagggtcctgaaaccaatcccctgtggatactgagggctgactataaacctgaattcagtaagacctcctaagtttctgatctaggaggtactgaggggagatgaagagtaaaaagaaagaaagaaaaacatgagtctctgaccttgactaaagtgcaaatcaataaggtaggaaaaccaagatgccatttgacacctacttaagctcagagcatgactaggatttggttgggatatgcatggaaggtgggaaaaatggtatgaggatgaagacaggaaagagctggctgagcaaaggcccacagcataactgctttctgacaaggttggataaggtgagacagggagggaagtcagcctgtctagagcaggaagtttctcttggagagtggtagacagacacttcgatagggtagggctgatttgaaagggtgtgggtggtagactttgtgattttgactattcagcatggaatcacgagttctggagtacagttgtagcagagaaattattttgttattcctgtttgttagatgctagctaacccaattaaaaaatgagcaataactgaacaaacatttctgaaaaacacacacaaatgaccaacagatatatgaaataatgtcaccataactaattaccagagaaatccaaattaaaaccaaaatgagacatcaccttacacctattaaaatggctattaccaaaatgataaaagattgtgttggccatagtatataattttaatgtagcaaacccccacagtgtgaacatgcctccctattcagcttcctctctgatgactgtctgccatcatgctatacttcaccaacccttaactgcttacagttttgagtacacactctattcctcacctttgtacctctgctaccacagtcctcttcatctggctgaactctatctggttctttagactcagcttaatcaatatccaggagcctacgcttaccctaaaatgacttttaagaaatgcacataaaaaacttgtaaagcactgatacatagaaaaaaaattaccataaactcttaaccctaatgtgagcattataactgtttgattattttccttccagccttttaaggcctattttatttaaacaatagagattttattgtacaaaattttgcattctgttttttatttgatttgacattatcctttgagcattatcccatcattaaaaaaatatttaaatggccttataatatattccaccatgttggcttacttcaatacatctaattattcttctattaaaaaaaaacagattgtgttggcaaggttgtggaggaaagggaactcttgcacactattggtgggaatggatatttgtatacacacacacaatggaatactattcagcctttaaaaagtagaaaatcttgttatttgcttcaacatggatgaacctggaggatattatgttaagtgaaataagccaagaacagaaagacaaataccgcatgatcttacttatatgtgggatctaaaaatgttgaacttacagaagcagagactagaatggtggttacaggggtggaaagtgaggaatgggataatattggttaaagggtacaaagtttcagtcgaacagtaggaataatttcaggatatctattgcacagcataggagctatagttaatatatacctgaaaattgtgaagaaaggcgatcttaaatgttatcactacaaaaaaataattcatgtgaggtgaaggttatgttaattagcttgatttaatcattttacaatgtatacacatagaaacatcatgtcatatatcatatatatatacaattttatttgttaattagaacttaataaagacaaaaaaagaatattgaaataatccaagcaagacatgagaagcacttagatagtcttcagtgtctttaagaatagaaaggaagggaacagatttgagtaacttcagaaatggcaaggcttaatgttttatggaaagggtaggaggtggtcagtgagaagagaaagtcaagattcagggatgactccacactttttggcttggatgactgtggacatgagaggtggggcagatttggtaggggagagaagctcactgctgagcatcctggatttgaagggacagtagaaaccctgttacagggtttggtgggcagtgctactaccctgtctcccacaggcacattagcattaacatcagtgcatctgattgtcttggctagtgtctaattcccaaggagactcatcaggcctcaggaaatcagaagttgaggagctggttgtaatgcctcaccatggcttcactttcagaatgcattggaggctcattcatgggataaagatgaaaagagtgatcttgacaaagcattgcacagattctataatgagagggaaatgaaaatggttgtcagcccattattaagtgtaataactaggttgcaatgagatgaaggacttcatttaggcagatctttcccattgatgaatagtagggggtaaaagtgtgaaagggaagcatataatccaattcataaaatatgtaaactgaacagaaatttctggaaaggtatttttaaaaacttgaggcaataatcattcattgtatatatagagctggagtgggaaatctttctattgatggacaatgatgcacagatgaaattttaaaaatcagtatttttttccactgacagaactttattttaaaaaaaatgacaaaagctctgtctgtacttctaggctaggagaaaagaggcacaggtgtagcaacaggggcacaggccactcacattttagagagtttgacttgcttgtgcctgtggagtgcccatttgaggcagacggagtccactgtgctgggtataaacaggaagaaacttttcttagatgggggcatatctgagacagaaatagaaggcattcaactcccacattaaaatattaggaaaaagagcacaacattgtattcaataagtaaaatatacacaaatgttaaaataaacacaactatatttctgtttttttaagaggaattgactgaattttatttatttatttatttttgagacagagtcttgctctgttgcccaggctggagtgcagtggcacgacctctgctggtgtgcagtggtgcgatctctgctcactgcaacctctgcctcccggtcccaagcgactcgtgcctcaccctccagagtagctgggattacaggcatgccccgctaatttttgtattcttagtagagatggagtttcactgtgttggccagactcgtctcgtactcctggcctcaagtgacctgcctgtctctgcctcccaaattgctgagatcacaggtgtgagccaccgcacaggctcacacacaactatattcttaaatataatggtaggatgggataatcattcctagatacttaattttaaataaattgttatgggtcagataaagttttccaaggtctagatctgacctttggaggttacgtcaagaacatgaattattaataattaattactctgtaaacactgtgtataattcatagataaataattagcatacattaccttacggctattcttcccacaatggttattatttgggaatatgatgtccctcacctggaaatgtctactcctggagaggcatgaactctgtggaatacatatgacaatttggatagcaccaagcaaattttaatcttttactagctcatgggctgggatgaagaagagtataggaggcaggatatagaacacataatgactaagattataagttctgtgtctaacttatttgggttagagtctgaattctgccactacaacttgagtgaccttgagcaagtcacttaaactctctgagctttctttttttcttatcagtaaagtggaaataacaagagtccctccctcccaaagttgacatgagaatgaaaggagaaaaatttgtgcaaaacacctagcacagttcttggatgttctattctaagggctcaatgaaactcatagctgctgctgctgttacacttttctgtgctgggtcattcactgggtggggggatgggggtgtagcctggttccccagtttgagcaagatcgcagctgtattctcaacttttggcttctgtcacctacaatggtgcatccccataggtgtgctgtgattcttctcaagcaaccagcagttggtcaatgataaatccttagttttaaagcttatgtggggaaaacatgtaaaacaaaaacttggacagctcgccctctagtggtaattttatgaattgccccccaacaattgcccttttagctcacaggaaaactgatagtaaaaatgaatgggattaagtttacatagttgaaacacctggtttaacaaatgaatttgttaatcacaaacacataataagctagtatagggtacacatgcttgcatattttctcaagtgctgattagccattatacctaacaagggatttccaatttggggaaaaaaaaatccagaatcagcaattctatacatagttatatatcctgtcccccaataaataattgtacatagtcattagagtctagttttattgcactcaatgttctttttttctaaaataatgttataattgttgataataacaacttatcctcttacaggtatgtataaacttttcacagggttttgtttttacaacagatagatgcggcaggatttgccttcctggttgtactgaagaggaagtaggaggcttatctataaagaggccaaatgagtttgcttgggacacccagggcactttgcaggggactgcactaatttttactcctaggaatctcctcctggcaaaataaattgcatagatgctggcatgttcctttctagtctttagatgctccttctttggaatctttatgtcaaactccctaaacatacattggttgtacagatcagaatgaaaatgattaaaatagagatacgagttttatacaagtggctttcttcactccattataattgttttggagaactcagatattaaagcattttgtttgtttgtttgtttgttttgagacggagtctcactgtgatgcccaggctggagtgcaatggcacgatctcagcttgctgcaacctccgcctcccaggttcaagtgattctctgtcttggcctcccaagtagctgggactacaggcatgcgccaacatgcctggctaatttttgtatttttagtagagacaggatttcaccatattggccaggctggtcttgaactcatgacctcaggtgatctgcccacctcagcctcccagaatgctgggattacagctgtgagccactgcacccggccgatattaaagcattggtacccacaagactaaaccaagagtaataactttttgagccttatagaaatctaagtcaagggagtagtgatgagaatcttaaaaacctgcaattgttcttttaaatactgaaattgctattcataagacttgagtgaacagagaaaggataatataggaataggaggtgttttcaaatccagggacaagaatatttataatcatactcactgattgtgaaacaaagggcagacatacattcacttatactttcagtgggttcgttccgtagcaagcttcagtccaactgcagagtttcactattcaggggaagtagtgaaattcccttccttcaatgcctccattcacatttgtggctggtcagggagatacagttatcaaatcacctgtgggagaagccaagctatctagtcaacagtcttctcaggagccctgcaaggagcttgcttaaataggtaccactggaattgtgaacagtatagggctggatacctcctgtggattgcaggcttgtgcagatgagatcaagcgcaccagttggctccctctatgggctactcagttccactgcggccccaattgatcagtagcctgcacctttgtcagctgcatcacagatgtattcattcagtatttgccaaatatgtatggagagtctacatgcaaggggctctggaagtatggcatgtgattgcaaactcctgatgacagaaatctgacttgcatgcattacttttaatggcacttggcaaattcagttatatgtgacctttcatctcttcttgcccttttgtgactttctgacacctctaagctcttccctcttaacgtcagtgttcaatccctccatgttgactgatcacctgacttttcaggcctcttacctcagcctatacttcttagttgcttccctagtcccaaatctaaaaataaatgtgctacatccttttctacctccttttgtcccactcttggtttattaagaatagcaatccaataaaaattaatcataccaacttgttggaatctagtaggggtctaatactctaatttaggtttaaggctacaatgccttagctcatggaaattgatttctactgatgagagtgtagtgtgggaaaatatttggtggcacgtaggcattcatagatccgtgttatcatacctctggtccattttaatgggaaaattccctgagatctcttgaaatatgttgtaaccttacactgcaaatactaagggaaaagaataaatggggataacgtttagaaattattttctccattattgtattgctgttctctggctattgactaccttataactaaatactctgatacctaaggcaagggaacagaagaaaagagaccataaatctattaagtcaaatacatattgctcacatggcccttaaagggaaatgaattatcagtgtacgctccaggtctgcatgataaaactaattgtaatggcaattaaatgtcttacactgccattgagcatgctcgctgtgactctggagcagatacattgattaccttcagtacttaccatgtcccatcacaaataggccaaagcagactgttaacattgtaaaagtgtagaattatgcaatagatcacttagaagacttagaagagataactaaagagatttgggaagcaaattgaaatagcatttcaatttttttttctatcaagtaggtaatgatagagtttgatgctattttgcaaagccaaatttgttaattcaaaaatatttgctgtgcattttaggattaggggaaaacaaaaactgaaataatagtttaaaaaaatattcccgtggggtttattttgtttctattaaccaacttttgaaaaacaagctgtgagaaaatatttattttctaacatacttatatcattacctctcagttgttttaatgcatgcaaacagtatcacagataatttataaaaagaataatataaaatccatttaaagatgataaaacaataaatattaaagttgtatttgatccagaggtgtatcactagtaatttataatgatccagaaagttcagcaaattcaagtttccttcttttccttcttgaaagttttgcagtgacaaatgacaagtaaatgatccaatagcaaggagtgaatttaaaagactcctgagagacaaccagtgatcagtacatatttagtctaaaccactgtaccttcttagctttaacagtgtacagtgatcatcagaatccatagtgatgaatctcatacctctgaatcctcgaagaaagtttagatgcccttcactatcaatttaaagggagttatttatttgtttgtttgtttatttctaatgaatacttcacatactataagaggagttgaggcagtgtgtaataacagcccacgtgcagcaggccagtgaaagccaaagtcagagagagagatcagaaaccagagttcaaaatctttcttgggccataaaaccctttgaaaatctgaaaaaaaagggctatggaaaatttccccagaaaagtatacctgtgcaaataggcacattgttttgccaactaccttgaagcccatgcaagcatcttccccctgggtgtccttgaaccctagttcaataatccctcatatagagaaagtgaaatcctgaggtaagatagttattacacttaaacattgcatttagctctgagcttcctgtcaactgaagttaaaagattaaacacgctgggttagagttctcaacatctaaaaaaggaagcagatcagttcacaaaatcataagtgaaacatataattttaaaatggcaatgtttatacatttctctgagatgattgttttttaaagggtaatcaagaaaagtgaaaggatacagcgtattttgatgacattttttgaaaataagcaaattagaaataaaatagctatgctaattatattgaccagcatatgcgattggccacagcatttcatttttaaccgttctggaaaataaggaatttactgtacatgtctttctttaatggtagatttgcctacctaatattatttgattacagctgacagtaatataatatattcccatgagcactcggcagctaagcagaaagggaggcctaagggtataaagagaaattgacctatgattaaatatatgctattaataggtcataccatagaaaactggcatgtatataacagcaaataatcactttaggtgcctactacttccaaccagagcatttactttctcaaaggcaaataatagcacaattgttattgtcacaattataggcataggcagtatagggtagaggttaagaacacaatctggaatcagagactggtcttccaccacttattagctgtgcgaccttgggcaaagtcatttaacttcttttgtctcagtgtcttcatttgtaaaataagaagaaaagccttcatctcaggaccgcttctaggctgtgtagaggtctcttggaaatatttgttttgtggggctcctgtctatataaacaattcgagtcacctaaaaccagtatgtcagcagcatcattctagtagtccaatttcataggctaatgtgatggatagcagaagcaaacaatttgcctggctactctgctggaattaggacctggccatggtgccacaggacaaccctataggcatgagttctggagctccttgaagaatctggtccaccccaagcagaaggtggctgtagaatattggaagataccccaaaggcacaagactggagcaggggctgtgcttactaaggtctaagcaagatacaagtctatctcataggattactgggaagattgaatgaagtaatctatgtggagcacttaggacatgttggtgatgattactgctcacactattagtgtcaacaatgctcactgtatcttatacctcttctgattttctttcagtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaaggtgagtgttgtgtgaaaacattgcccaatcacatggctgatagtcttttgagtgggacttgagtacatgtaggtatgcctcatgttgtataatggatatgttcttgaaaggttgcagtacatgtggagcttcagtaaattccagttctaattatctatcagaactacatagcaaattcctattagattttcataaaataggattcccatttactgtgtgtgcttatttaatttagaaaattttgtgactcgggccgggcgcagtggctcacacctgtaatcccagcactttgggaggctgaggtgggtggatcgcctgaggtcaggagttcaagaccggcctgaccaatatggtgaaaccctgtctctactaaaaatacaaaaattagccaggcatggtggcaggtgcctgtagtcctagctcctcaggaggctgagacaggagaattgcttgaacctgggaggcagaggttgcagtgagccgagatcgcgccactgcactccagcctgggcaacagagcaagactccatctcaaaaaagaaaaaaagaaaataagaaaattttctgactcatttcttccctcactccacccctgccgcatggtcttatattaacaattagttttgcatacagctagttgactcaattatcttgatatctggccacgaaaatgatctaaaatatcattttggccatggtcttgcctttcttgttgatgaaaaatagtttcaaatgcgtctagatttctcagcaaatgtactactgctgaaatccttcatagaatttgcaatgcaaatttgagtccactgtgtctaaataatcaacatcgagctctgtaaatacacagtcatcctgagtttctgggtactatagtggaaagatatcacagacataattcttgcttgcaagaagtttacagtaaaaagcaatatgttttttcccttagggattctacagtatgttctcccttccccctctaccccagtgatagaatctaggatctagcatctagcatctcaaatagagactggattaggtattgaagtaggtagctgagacgacctttaggccacctttcaattctgcaattttgggagtctttggtcttgctcaccagggacctgcactctactatttgattttaactccttggaaatgcagacctttcctatttttgtgtcctgtgaactttgatgccaaagctatgtcacttcctcatcaaaagcacttggaagcccctggcgaggtctcattgttcaaaagcccaggagaacaaggtggtatataaatagagagccttctggatgctctaagaatcacttttatgtgtaggggaagaaaatggagtgatgggggagcaaatggtgagtttagtctctgtttgtggtaggcaagatcttcaggatcttgggagaacagcagtcattctgatcacacccttagtgttaagcggtattttctcctacttgggcagctcttggcaaaattgagaagcagatgtaattcagctttagtgactgacactatattccctagggtgctgctactctttccttgcttatctcctctccatcccacactgtcattaaaaacccaccaatcaaaattatctctcttctcctccccctgcaccatttgctttttgtttgttgttttcacaaatttaaagttttatttgcaaagcatcagtccactatgtacaagtgctaagcttacaatgaattattaaacaaattattgctacttccccaggcctgctaatgtcttcagtcttgttacctcccctcttttccattctccgctctaaccccattcctttactcctagcaataataacaacttagtgatccctacatgcatttcccctactgttttaattatacaaacatactgacatggctattttctcctcattgttttataaaatgaaaggagggttatagatttctctgcattttcttagcttagtaaaaatacatggtataaatctctccaagtcaactgatagctttttttttttacttttattttaggctcaagggtatatgtgcaggtttgttatacaggtaaactgcatgtcatgggggtttggtgtaaagattattttgtcacccaggtaataagcatagtacctgataggtagttttttgattctctccctcctcccactctccaccctcaaggaggccacagtttctgttgtttccttctttgtacctatgtgttctcattgtttagctcccacttgtaagtgagaatatgcaatatttggttttctgttccttattttactaaggataatggccatccacattggtacaaaggacattcttatttacagctgcatagtattccatggtgtatatatatgtaccacattttctttatccagtctaccgttgatgggcatttaggttaattccatgtttttgctattgtgaatagcactacgataaatacatatgtgcatgtgtctttatggtataatgatttacattcctttgggtatatacccaataatgagattgctgggttgaatggttaaatatataatattgtatgttgcttaatattttatgataacacaagtcagtcaatcatttccctattgatgagtatacactttgtttccagtattttgtccctacaaaaggcgctgtaataaaaatccactatttgcttttcaataaactttaagaagtcttcgatttacgtagttattgcaaagataatatagagttcctgtacactttatatccagctttcccattttattaacatcttacatgactatagtacatttgttacaattaatgaaccaatagtggtacattattattagctaaagtccatatattcttcacatttcttcagtttttccttaatgcctcttttctgtttcagtatccatctctggtagcgcattgtatttggttgtcatgtctccttaagcacttcttggctgcatcagttcctcagactttcctcatttttgatgaccttgacagtttgaggtgtactggtcagatagtttgtagaatggtcctcaactgagatttatctgatatttttctcatggttagactggggtaatatgttttgaggaggaagattacaaaggtagaataccatcctcatcacattgtatcaagggtataaagtatcaatatgactcataactgttgatgttgactttgatcacctggcttgaggtgatgtttataatttttcattgtaaagttactttttttttcttcctttccatactgtagtctttggaagaaagttgttattcacagtccacacttaagaagaaatatctacataaattatttcaaattcttctgcatggaaatttgtctctccctttccccacttacttatgtgttccatcatttatttgtatcagtatggactcatttttatttatattatacaccggcttgtaatgcaattctacttaattttcttgctcagattcttccacctttgcccgtgggaagctctttcagttggctcatttgtccctttgatataattctatcattgtggagtggtggttgtatttttttttttttttagcatttccttacattgtagaaagatgctccaggtttatcttatatattttgtgccccagttctagaattagccatttttccaaggagtcctgtttttttaatggataattgcattagaaacctagatttggttgctaggtatgctcattgctattggggtgttgttgcttctaagtcttctcagctaacagtctatttgcttttaaacaaagccatagattgtgaaggagtactttagggatagtggaacttcccaaggtccctgaagtcctttcctataggtggctctctctttcaagtacatttcagattggccttttttatgtctattttggataccatatgagtcagaggttctcaactcacatctagaccaatagaagataaaagaattccactaagattggaacataacttgtgactttttaacttttgtgcagcaagccttagggagctattgggactgatagagataggtggaactgttgaatattacctctcatgtgtgccttagtaaggaaaaaatgtttggaaatcactgttctaatagaatcaaccaggcttttatcaactcagagatacataaatctattccaggtatataagtgaaatagctagcatatgtctgtgaataatgaacctgtttttcatatctagtagtggccactgacttctactatgtgccaagtgagaaattccgtccatataggtgattttatgcaattgccaagagtgacatttattgtgaaaagggctcttaatttgacaatgtcagtattcacctaaaatctccagttagataccactttaaggtaattacgaatgacttttctatgttttattgatctcattaaaagttactctactgatgtcactgtgattaaaaatgaagatatgaaatatttagtaatattctccacccatgtgaatgacagcaagaaaaatttactgtttgtgacctttcagtggccacttggctaatgaataatttttaaatttttccttggccagactcaagagtgattagttgaatttcccagcataataatgggctggtaatatgagaatggtagaggattaaatcatattgtgagagacggtgccaatcgaagaatcacaccaatattttcaatggaggcatgaattaataggataaaaatgataaaggtaatcttatttgacaaaatctcacatatcattttctcaacaacttggaacaaggggtgacttaagctgtgaatgaagatagatatagtcatataatcctgcattgaattcacagatattgaaaagaatgattggccaggtgcggtggctcgtgcctataatcccagcactttgggaggctgaggcaggtggatcacatgaggccaggagttcaagcccagcctggccagtatggcgaaacccggtctctactaaaaatacaaaatttcgctgggcgtggtggtgcacatctgtaatcccagctactcgagaggctgaggtacgagaattgcttgaatcgggaggcagaggttgcagtaagccgagattgtgctactgcactccagtctgggtgacagagtgagactccgtttcacacccacacacacacacacacacacacaaaattaaatataattgaacatctgtaaaaacctaacatttagggataattatggctgagtgcagagaatcagttagaggttcaaaattattatgaccatttacctctgcaacgaggtaaacataacaaggagttcccttataaaatgggagcataatcccaatatttttggtctctaatagtcattgaaagaagtgaggttctcaaaatctgaatgcctcacaacatctttctgaacagttccttagtatatgtctagccaggaggcacaattgctttgatttcaaatgtgaataatcaattcacagttgaatgattattactccagcaaaacagcatcagaagaaaagttgagggagtggatacacttgaaacgaaaagcatagcatgttgctaatttttgaatctgtatggtgggtacatgaggattcatcatattgccctgtgtattttttatcatgtttgaaatagtccataacaaaaaaaagaagaaataaatgtaagtatacagtaattttacttgattttattgtcacttaaatgatcctggcctataaatacctaggtatcatatataagcgagtatttttatttcagtcaacaaacattcattgaatacatatcatgggactcactttatggcatattgcaagaagacctgtgtctttagaaaagaaagtgatgctctagtctacatcagacacaaagaaatggctcttagcaccttccactctcctaccctacttcccatcgcggttacctagagattttcaaggacagtgaacatatctcataattcaattccaacttaactattgatccgtgaaaagttaagtgtcaacaagtcggttacccaggtagcaatttccaggagagcaggtagtttcttgtcagaaaaatgaaagcctggatcttatagaattaattgacctcagaaaagatcaagaaagtgtagcaggatcttgagacagcaggaatttcattcccgaaatgaaatgtaattagttatttttctatctgtttttggttataagcaggggtctctgattccattatttttatggcaatttgataatctacttgttaataaaattatataggaaaatttttacatagcaaagaagtaaccattttactttattttcatttcattagcattaaattagatatgttgtaatgtttagaaatataaccatactattgtacattaactatgtaatttcaacttcattcagtttgtttactggaaggaagcagatgcttacagtttagtcagcaggagtacctgctttgtaagaattaataggttatatttgataaccacaaaagaagaattgatctcaaatagtcactgatgagttggttaacactgttatttatatatactttttagtttaatcccttgtataattacacaatcttaagtgacttggttttatggctatcttgctcagaatcaaggttttaacctaatgcagggttgtaaactcaaaatcttttcagaggtcaagaaggtaatgtaatgagtgtggcaggccacctgaaacattttggagtgttggaagttgtagcaatcccctccataatctcatttcatgcattctactctattgccactacctcctatttttctagctcatttttttctataccttacctccaataatctattgattccacccaaccatctttctcattgatctcacatgttttccactgtaccttgttctcttcccatctagcatagttccaattcagtggatcaatcattataatcactcccatatacaccctcttgattctcttaaccctttctcccttcatcttactcgcttgtgaaaaccacaacactgtttaaacctaactgtccatctatactatgcctgcatccttgcagctaaacttggctgaaggaaaatatataataatgttgactggtttcacattaaattcattgtcatggacctcaaattgacctttaatgctaccaggtagttttattttatattcttagaccattcagtctcccatctgcctagatgactattttatatcatctccactcctcagatctccaatatctcctcccccttgcttccagtttcacagagaaaaaaaatgtagtcaggaaaaaaacttccactacatctgcccacctactggcatctatacctacatattctgccttccagcctgttaccacagatgaactggccttgcttctatgtaaggcaagtcacttcatgtgtacaccagattctatccctatttgcttacccaagaacatcacctgagcaattctcctctctctctcccatatcatgaaattttctatttctactggatcatttccatcagcatgtatacagatcagtatttatgccatctaaaaaaaatcctctctactccactttcctgacagccactattcccggtttcttgctcccatttggaaaaagctactttaaagaattatctggttatggtatcatggttgtttatataagtccaaacccttcaaactgtacccattaaatatatgcagttatttgtgtatcaattatatctcaataaaactatttataaaaaaaagtgttgtctgcattcagttttgagttcctctccacttattctctagtaaacccattccaatcaaaattttaccttcaaactcttccaaacctgctcttataaaagtgtccaatgaccacaacaatactaaatccaatgggcatgccagttttcagttctcctattacttgacctgtaatgtcatgtggcatagttgatcactcccttctttttgataatgcattctttacctgacttccagagaatagtactctcttggctttcctcatactctatcagttactctttcataagttcttttcctggctcctggtattctttctgaccccttaatgttagaaggcactagggatataggcccaacattgccagtttttctgatgttttgaaagctgaataattgtgtgaaatttctcaatttttaaatttatgggatcctcctgcccaaaaaagcccatactcagattcaaccattgaactcagttctcatactctaaactaataggttctgactccaacattaacctagagagcgatggtatagtcatcttaaagtaggactgcagcaggttttatctgtatcaaagtgaagcaggaaaatcaacactccaatggcaagatagattaaaggaaacccgccactctccctagagtacatttgagcattcagtagtagagtcatatggtgtccctttatgtggcaactggcccaattccagcttaatcccttgtgtggctattggagtcttcaaaaaatgcactgatcagtataggggtccttattgctagctacggtgtactgaaataggtattctatcaagaggattctattgctataaagtgctgcttctcctccaccttccttcctgtcaatgatcaaacagcaactctttaaaagggcagaggactgaagatgtgcaataactctagtcccaggcatgaaaagtaacttcagtgaaaatatccattcaatgcttatatggactaatattgtgcctatcactatggcgaacccaagagaaaattatgacacagcatctgccttttagcagttactaaaggaggaattactaagagttactgaactagctaggactcttctatacctaacactgtggtgcaatcttctatattactattaatactactgtgtcctattaggagtatggtctctggagctggactgcttggagtcaaatctcagttttattacttacgaattgtgtgaccttgagcaatttatatgactactcaggttcaaccaggggactcacagtttgcaaactctgaactattggttctgactccaacattagcctagggagtgatggtatattatggctgtgtgacctttgccttgcttttcctcacatggaaaataaagacccatttggttattcaacttaaaatattttgaacacttgaattaggtgttgagtaaatgcattgaatgagagattaaagtaatggagcttccattctagagttgggaaaacatataaataatgcaatcacaagactacactgggtaatcgtaattctacagtggtgagagtgaagaagggtcatgttaggggagtgactgactgagaggccactttcagttaggtgatcaagaagggcttcacagagaaagtgacatacaaactgagacctgaatgacaagaaggagccagtcttgtgaaaatcttggggcagagtattccagtcaaagtgaatgccatgtgtaaaggtcatgaaatgggaacaggcttgattcgagaaagctaaagaaagggctgggtgcagtggctcacacctgtaatcccggcactttgggaggctgagacgggcagatcacctgaggtcagaagttcgagaccagcctggccaacgtggtgtaacccctgtctctactaaaactacaaaaattagccaggtgtggtagtgcacgcctacaatcccagctacttgggaagctgaagcaagagaatcgctggaacctgggaggtggaggttgcagtgagctgagactgcgccacggcactccagcctcggcgacagagcaagactctgttaaaaaaaaaaaaaaaaaaaaaaaaaaaaaaaaaaaaaagtgctaaagaagggcagtttggttggagtgtggtgagctggggaataatgctactagataaggctggaaaagcaggcagagaacagaggacagatgctgttgcatattgtggaccagaataaaaagttgatttttaaattagtaatcagagataaaatgagtatttatttttgttaaactggagagtaacatgatccaatttccatttaaaaaatgattactttggttgcctggcgagaatggactacagggggagaagcaagaagaccaagttgagaagcaattgtattagttgaggagagatgtgatggtagcttggattgtggtggtagctataaaaatagggagacatgaatgaatcccagatatatattgaaggatgagctgataggacgtactgatgtcctggatgtgagaaaaagctgaataaaggatgactcctgttgcttttgactgaagcaactgtgtgaatcatggtgctattaactgagagagaagacctggagatgaacaaagatcatagtacctacctcagagaatgttgatgagcacttatcaccaatactgacatagagtaagcactccatacattatctcttatttctacttttactaccaccaccactgctactactagctataattttttagcttttattatatgaaagtattgtgctaatccttagaataattcaggaggtaggtcatattattgaagatgataaaactgatacttagagaagtgaagaacttgcccaaggacacatgggtagtaaatgatggagctgggatttggaaaggtttgactccagagctcatacacattatcagttttctctactgtcttctcaattattatctgttttcactgttctttatagtaatctgtatttgtatattacaacaaatgagatatggttatttacattaattcttgcctatataaagttctgtgcttctgtgtgtttttagtttcatcagtgaacattattgtctggtgatgaggatagaattttattgattaaagatggataatagaaggcaatgaaatagagattccaagttcatgaaaagtgatgattaagttaaagcaagaattttcagagaactagtcttcttgttttaccaagtttaaaatcctttgtgatcacttttcagtttacatatgcagaagtgcttaaaagttgttttccaccaaagaatagagatgaattttgaagcatatatatccttaaatggctctttttgtctgtttactctgacttcaaaacctctaatatataagactcgtgatgaatcaattagagaaacatatacatcagtatatgacaaagtgctagaatgaatataatcaggtgtcataaatgtatggttatctttttcaaaaactcattgcatgacactacttccctccattcaccttaaagttgaaaatgttcatggtggaacacaaatgagatctcattccttcctaactacagttttgttttgtttttgtttgtttttaataaaagcgatgtttttcagccaatatccttttaggtctcaggtatttattattcattaaacaaatatttattgagtacctcctgtacagagggtactaaaaaaaaagcaaaagtgaatgatagggctcctgacttataacaaattaaaaggggaattaggacatgtatacaaatcacaatcaaacaagcataactcccatgtggttcatcattaaattgtatcctagaaaacatagtctagcaactaaacatattttttaaagtctgaggatagatttaacgtagtcccttgaaaaatatcaaaggtaagcccatttgtaacccacagcaacaaaaatcattgtttgacattactatcactcctagtatctcttgtatgtttcagctgcccagaaacctctctcattgctcctcttgttacctgctaaaaaactcttcctggaatgcatcccctataagtttcttctctttttgccctttctcatcctctagcacttttttcctttcaagaagctcttttttgccctttccaatgtaatttaattaaactagcagtgcttcttgcaattcttcagctctttctgcccattactcctattctgcacaataaaatctcaggaactaacctgccataccaaggatctttgtaaaagttgttgcatttaaaaagaccaatgcagtgaaaaagagaattatgtttagaaggcaagaagaagggaaaagctgcaaacacttaacttgatggcttttattccatcatacatgagggaaagtgatacgtgctataggaaagataaagtaatagtacagtaaaaagtaggaaaaatagcttttgtcttatagaatcgtgcttgcttcagatggctcttgaggatctaaacaggtggtgatagtagaggtcttcccaggcagataaaacaatgtcccagggcaaggaggtagtaaaacatgggccatgcacagggaaaaacagggaggtaaatttggtcggaacctggatttatcgaggcgtttttttctgagtatgaacctaacaataatacttgctttatgaaggtttcagatgtttttgaaacatgagattttagacattgagcaattcttagaaaagaagctaaaagactcaactaatgagcaccttaacttgcagtcaggtaataaggcacgttttttgcagatgatgtttccacagagaaaatgtatatttaaaggaggcaaattcccttctatgacctgaccttcattaaagaaaggcagtgctgctgactaaagcgttgttagtcttagcatgtactccaaccagttttctcacaggtgttgataaattcacatggaaccatccccactctctcaccacaccgaagagtgatccaccttggtaggatggctcattaatattcgatgggtatagtctgtatctataaatatgagacagagaaaagctaagtgagaggggtaatgtatatttccaccttggggccttgatcacattcaagcaagacccaagccaatacaaatctacacactcgtttccagaccagatctcactcttcaacactaaggcaatatacacttacctgagtatagagatatagtatatacatttttaattttttattcctgttaccctgatcccatcagtgccttccctttacttcctacaaggaaagtggcttgaccatgtttcatatttacattattatcttttactcttgagcaagagatctctcctccttttaagctcaatctaaagcttgccacttaagcaccatgcacactgtccacacacagggcagcctttccatacatactgattgttgacttattggctgaaaccctcagatcagtagggtccagacgttttcattttgctcacatgaatctttttttagtatattgttttaccaatagaaatagatgacaggaaggcaattttacgaggtgacagtccaaataataatattggcaacgccagtattttacagcagggtacaaagtcacagaaaattctgatttttaagcatttagggaagcttctatattaggtaatgtcactatatacacactctgctcaaattttgactttgatcccacatgacatgaaacaaagataaaaaaaatcactgctgtttctaaataaaatatagtttaattttactttccattattttagagacaggtatagccaagtttgacttcctggcatgtggatgggtgatcagaaaaaaagaggtcaatgaaggcttccctggtttttgcctttcaccacttcacttgttgttatctcaaatggcaagcccagagaggaccattacagcttttctagaggtaaaactcactgtttttgaccaaggcattggtccccatgaaatatccatccccttccctcacccatcagagctgggcctttctcccagcagcattgtttttaaagctgtcttcctctgtaactgcccatctcactaagcatgcttactcaagggctcaaaggtcaggtcagattgcttctgctgggtttgtagaggatattcagtgatggaagtagaattaatttttatgtattaaaacctttcctctggacttacagagaaaaaaactttaataggcataacacaggaaatcatgaaaatgttaatatctttccataatcctgccaaatataaaacccaaatccaagcaaactgatttaatgttttactgaaaaaaaaagttatgaaaacaatttgtacgaccagagagataagtgtctggttcccttcctggaattattcaccttcctttctagtgccccctcctagggtcccactgctctcccctttgattttctttcagttgggccctaccccaatcgtgttttttatgcagcttgatgatcctttcctccccctcctccagtctccaccccatcccctaagttattcctaaaggtaccactgtcccaccaccaccctgaccttataggtccttactaaccctcaggtgccttgtctaacagacacaaaggcaggaaaccccttgggttcccacccccttaccacacagtgtctgctctccttttcccttctgttccagaggaagaagtggcctttccaaacccatccacctagtaaattaacttctttatattgttttgtatttctgtgaacatttaattactttactgtcacaaaacacaagaatataaagaagtaaaggccctctatctcatgccccctactctacctcactccaccctataccctaatgtcccactgcctaccatcatttgacccctgagcctaccctccctaggttactcataatgattttgccctctagtggacattcggcaatatctggagagatttttcgttgtcacaatttgggtggggtgggaaatgtacactactactgggcatccagttagttgaggctagggattttgctaaacaacctacaatgcacaggatggcccccagaaataaaaaagcatatggccccaaatgtcaagcatgccaatattgggaaaccctgccctagaaggatatagacaagcccgagaacatttttgacgagtacaaactctttaataactagttagggaactggccccaagtcctgaatgactgtcatagattcaacaggaaacaaactaatgtcacatctagctgctgcagagatgtcccagggccatgacagcttcttagtcactaggtccacatgccccaggtgatgtccaaggctcctccatttgtgtctcaatctggttcaggtctaactcctctccatccttccacctgttagctaaaacatacatgtacccccgatcaacacagcttacagtcatcaaagggatagaaggagaccaacctgccacccaccttttgaccccacccactcctatcctcccccacctcacccctccctctgaaagttgatttcccactgggatatgtttctgttctgtttcacatttctaaattcactaagagctttgtagctagattttcctcctacatttatcatggtggtgggttggaagagaaattccctcaggatgatggcatcgtgcttttgcccatggtctaaaccaggaaaccctctgagcactatcagttgctgactcacctccttggcagtggcaggagttctctgttcaaatctgactgtccctggttctgctcacttgggattgaggaggattctgctgtcatgagagctgtagagtcatagcagtcctcgcctggagctggtgctggcatcctctgtatgtagccctgaaggattccctcaggagtagcaaagcactgccatgtcgatttgagtcaatcataaacctggggttaaccccaggcctgttttgattgtttgtcatgatataactcactcagatcatgaatgaactttctatccagttcattcctagagactcctggaatgcaggaatctccactactcaccataccctgatgcaactccccagctggttcgaacatattatttgatggtctcttatttgcaactgctctcctggtaccaatttctgacataaaaataatctgatggggaggcaccaagatgaccgaataggaacagctctggtccacagctcccagcgagaacaatgaagaaggcaggtgatttctgcatttctaactgaggtccccaattcatctcaacaggactggttaggcagtgggtccaacccatggagggtgagcagaggcagggtgaggcgtcacttcacccaggaagtgcaagaggccaggatctcactcgccaagccaagggaagctgtgagggacaatgctacccagctgggttactacgcttttcccacagtttttgtaatctgcagatcaggagatttcccttgtgtgcctacaccaccagagccctgggtttcaagcacaaaactgggcagctgtttgggcagacactgagctagctgcaggagtattttttcaaaccccagtggcacctggaacccaagcaagacagaaccgctcactcccctggaaagggggctgaagccagggagccaagtggtctcgctcagcaggtcccactcccacagagcccagcaagctaagaaccactggcttgaaattctcactgccagcacagcagtctgaagtcaacctgggatggtcaagctttgttggcggagtggtgttcgctgttactgaggctttagtaggcagttttcccctgacagtgctaaggaggctgggaggtatggactgggtgaattcaccacagtgtggcaaagcggctgtggccaggctgcttctctagattcctactcactgggcagggcatctctgagggaaaagtaaaagcccctgtcagggacttacagacaaaacccccatctccctgggacagagcacctcagggaaagggcggctgtgagtgcagcttcagtggacttaattgttcctgcctgcctgctctgaagagagcagctgatcctgacaagagggactctcccagcacagcacactagctctgctaaggaacagactgcctcttcaagtgggtcccggacccccatgccttctgactgggagaaacctcctaacaagggttgacagacacctcatacaggagagctccagctggcatcaggttggtacccttctgggatgaagcctccagaggaaggagcaggcagcaatttttgctgtcctgcagcctccactggtgatacccaggtgaaaagggtctggagtggacctccagcaaactgcagcagacctgcagaagagggacgtgactgttagaagaaaaactaacaaacagaaaccaacaacatcaacatcagtatcaaggagccccacacaaacaccccatccaaaagttatcaacctcaaagattaaacgtggataaatccacagagatgaggaaaaatcagtgcaaaaatgctgaaaattccaaaagccagaattcctcttctccaagtgattgccactcctctccagcaagggcacaaaactggatggagaatgagattgacaaattgacagaagcaggcttcaggaggtgggtaataacaaactcctctgagcaaaaggagcatgttctaacccaatgcaaataagctaagaacctgataaaaggttacagaaactgctaactagaataaccagtttagagaggaacataaatgacctgatggagctgaaaaacacagcacaagaactttgtgaagcatacacaagtatcaatagccaaactgatcaagcagaagaaaggatatgagagattgaacatcaacttactgaaataaggcatgaagacaagattagagaaaaaagaataaaaaggaatgaacaaagcctccaacaaatatgggactatgtgaaaagaccaaacctatgattgattggtgtacctgaaagtgacggggagaatggaaccaagttggaaaacacacttcaggacattatccaggagaacttccccaacctagcaagacaggccaacattcaagttcaggaaatatagagaacaccactaagatactcttcgagaagagtaaccacaagacacataatcgtcagattctccaaggttgaaacggaaaaaatattaagggcagccagagagaaaggtcaggttacctacaaagggaagcccatcagactaacagcagatctctctgcagaaaccctacaagccagaagagagtgggggccaatattcaacattcttaaagaaaagaattttcaacccagaatttcatatccagccaagctaagattcataagcaaaggagaaataaaatcctttatagacaagcaaatgctgagggattttgtcaccaccaggccctgccttacaagagatcctgaaggaagtactaaatatggaaaggaaaaaccggtaccagccactgcaaaaacacaccaaaatataaagacctctatgaataaactgcatcaactaatgtgcaaaataaccggccagcatcatgatgacaggatcaaattcacacataacaatactaaacttaaatgtaaatgggctaaatgccccaattaaaagacatagactggcaaactagataaaaagtcaagacccatcagtatgctgtattcaggaggcccatctcatgtgcaaagacacacataggctcaaaataaagggatggaggaatatttactaagcaaatggaaagcaaaaagaagcaagggttgcaatcctagtctctgataaaacagagtttaaaccaacaaagataaaaaaaaaaaagacaaagaagggcattacataatggtaaatggatcaatgcaacaagaagagctaactatcctaaatatatatgcacccaatataggagcacacagattcatgaaacaagttcttaaagacctgcaaagagacttagacttccacacagtaatagtgggagacattaacaccccactatcaatattagacagatcaatgagacagaaaattaacaaagatattcaggaactgaactcagctctgaaccaaatggacctaatagacatctacagaactgtccacctcaaatcaacagaatatacattcttctcagtgccacatagcacgtactctaaaattgaccacataattgctagtacaacactccctagcaaatgcaaaagaatggaaatcataacagtctctcggaccacagtgcaatcaaattagagctcaaggttaagaaactcactcaaaaccgcacaactacatggaaattgaacaatcttctcctgggtaaataacgaaattatggcagaaatgaagaagttctttgaaaccaatgagaacaaagagacaatgtaccagaatctctgggacacagctgaagcagtgttaagagggaaatgtatagcactaaatgctcacaacagaaagctggaaagatctgaaatcaacacactaacatcacaattaaaagaactagagaagcaagagcaaacaaattcaaaagctagcagaagacaagaaataactaagatcagagcagaactgaaggagatagagacacaaaaaacccttcaaagaatcaatgaatccaggagctgattttttgaaacgattaacaaaacagatggaccactagctggactaatgaagaagaaaagagaagaatcaagtagacacaataaaaaatgatacaggggatattaccactgaaaccacagaaatgcaaactaccaacagagaatactataaacacctctacgcaaataaactagaaaatctagaagaaatggataaattcctggacacatacaccctcccaagactaaaccaggaagaagtcgaatccctgaatagaccaataacaagttctgaaattgaggcagtaattaatagtctaccaaccaaaaaaagcccaggaccagacggattcacagccgaattctaccagaggtacaaagaggagctggtaccatttcttctgcaactattccaatgaatagaaaaagagggaatcctctctaactcattttatgagggcagcatcatcctgataccaaaacctggcagagacacaacaaaaagagaaaatttcaggccaatatccccgaagaacatcgatgtgaaaatcctcaagaaaatactggcaaacaaaatccagcagcacatcaaaaagcttatccaccacggatcaagtcagctttatccctgggatgcaagcctggttcaacatatgcaaatcaataaatgtaatccatcacataaacagaaccaatgacaaaaaccacatgattatcttaatatacacagaaaagtccttcaataaaattcaacacccctttatgataaaaactctcaataaactaggtggtgatggaacatatctcaaaataataagagctatttatgacaaacccataaccaatatcatactgaatgggcaaaagctggaagcattccctttgaaaactcacataagacaaggatgccctctcaccactcctattcaacacagtgttggaagttctggccagggcaatcaagcaagagaaagaaatgaagcgcattctaataggaagagaggaagtcaaattgtctctgtttgcagacgacatgattgtacatttagaaaaccccatcgtctcagcccaaaaaccccttaagctgataagcaacttcagcaaagtctcaggatacaaaagcaatgtgcaaaaatcacaagcgttcctatacaccaacaatagtcaagcagagagccaaatcatgagtgaactcccattcacaatgactacaaagagaataaaatacctaggaatacaacttacaaggggcgtcttcaaggagatctacaaaccactgctcaagagaataagagaagacacaaatggaaaaacattccatgctcatggataggaagaattaatattgtgaaagtggccatactgcccaaagtaatttatagattcagtgctattcccatcaagctaccagttactttcttcactgaattagaaaaaaaaaaactactttaaatttcatatggaaccaaaaaagggcccgcatagccaagacaatcctaagcaaaaagaacaaaactggaggcatcacactacctgacctcaaactatactacaaggctacagtaacaaaaacagcatggtactggtacctaaacagatatatagaccaatggaatggaacagagacctcagaaataacaccacacatctacaaccatctgatcttcgacaaacctcacaaaaacaagcaatggagaaagaattccctatttaataaatggtgctgggaaaactggatagccatatgcagaaaactgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaacaaccccatcaaaaagtgggtgaaggacatgaacagacacttctcaaaagaagacatttatgcagccaacacatgaaaaaatgctcatcatcactggccatcagggaaatgcaaatcaaaaccacaatgagataccacctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatgtagaactagaaataccatttgacccaaccatcccattactgggtatatacccaaaggattataaaacatgctgccacaaagacacatgcacacatatgtttattgcggcactattcacaatagcaaagacttggaaccaacccaaatgtccaacaatgatagactggattaagaaaatgtggcacatatacaccatggaatactatgcagccataaaaagaatgagttcatgttctttgcagggacatggatgaagctggaagccatcattctcagcaaatacaggaacagaaaaccaaacactgcatattctcactcataagtgtgaggtgaaaaatgagaacacatggacatagggaggaggacatcacacactggggcctgtcaggggatggggtgtgaggagagggagagcattacgacaaatatctaacacatgcggagcttaaaacctagatgaagggttgataggtacagcaaaccaccatggcacgtgtatacctatgtaacaaacctacacgttctgcacatgtatcccagaacttaaaaaaaaaatctgtccacccactcaagttagctaaagaaaagaggttctgtgtaaaggggattttcatgtagcacaactgtaggaagtgaaaagtggttgtgctgctgctctctccatctctctggagtcacaggatgattcctctgtgcctgtctgctccctggaaccacgtactagtgactcccaaagacacttgcctctggaaagcacccagttctattcctccacagccagggccaagcctcagcagtggcctcagcaaccatggctccggtcctggccccaactccaagtggcctacagcttcattgctcaacatcatggaatcggcctctctgttcagagtgtctagcatgaaaaatccatttggctctggatgggccaaatatccactcctgctccaatcatctaaggcctagatgcgagtagagggtggggtgttatacacatggttgcctcttttaccagacactagggcagggagagagcgagcgagacatacacaaataaaagctgcagcacttctggggtattgagtgcaagtgctctggaatacaaagggggtcaccaaaacatgtctgtctccatgtgtctctctctccccaccccaatctatacctcccctggccaccaccccacttctacacctctttcacaacccctactttcctccccctcctccagtcaccacccctatctctgaagttattcgtaaaggtaccattgtctcacctccttcccccactcttcccagccttcttcccctaccaccccggcccccgccaccacaagcctgccctctgaaaattaattcgccatcgagatatacatgcttcggttctattttgcatttctgcactcaatgaggtttttgcagccagattcccttcccacagtcgaagcaagtatccctccgtgaaaaattcacagcgttacaccaagggcagtcccagtcccctggcctgcgatatactggaggtctttgctgatgaggttcggagtatctcctgtctcttgggtgctcctgatggtctattctgtggggccccccatcagaccacaggctagtatcaaaggcctcccagtcggaaggcagctgaggcggaactggtgctgtgactgttgcttgtggaggggatatagtgggtatgtctgagaaggaggaaaaagggcttgagtatgagtatgagtatgaggcagggagctggacaggaagaggttctgatgaggctctggaccaggggttcgtggttccagagaaataagatgtggctgtttcgaccgaccggagatctccctccttctgcccccaataggtgtacttttcctgatcagcatctccaaggagctgcaggaggattctctccagcttctctgtggtctccatggaggcagccctggcctccacgtgggggaactgggtctccatgggggcagccccagcctccacagggggagccatggcctccacaggggcagccacaacctccaacatcccctctgctcttcttctgctccttttcctccagcagcaccagcagcagccaccgccgcctcttcttcctcctcagctgctccttctgtgcaaacccctccggcagtggccaggcctggccaccctgccccctgctcccactcatggggagacaccagctcctggagagaagtgggcagggctgaggtgtgttctgggggcaaggcgggagcactaagcagggtaggacggagctaccaggtgggaagggcggggcagggcgaagccatggagcagggtggagaggggtgggaatggggcagggcagtggtactgggcagggaccagttgagggatcttactgcatggagcggcttccaactcaccttgtctctctctttctgcacctccacgaggctggtctgggccattcttagccgggaggccgcctccttgcgttccgtctcctgctgctccctgagcttcttcaggtctgatgccaaggcctgtgcggctgatttgtgcagtttggcgaagccgtgcagccaccgcaccctgtgcctttgtagctgtgcctgcctgtgggcaaagcgcactcccaaggccaggctgccccaggtgcaggcctctttgacctcactgggcacctcgctgtcctccagtatggccctcagcttgtcttccaccttctcccaggataaggatatattctcaagatagaactcggggcctttcgtgtgcctggccattttctcgttgatgaaggccaccacgttgctatgccggaacccgctactggggtcctcaggtctcaaggccatgatcgcctaggggtttaacggtttcactagccctgtgtggatggagcagccaataggttcctttcctcccccttagcccctcccctcatccatcttctcccgccctcttgtccccgccctacccgctctgacaagaccgtcctaatgaccccctgaccggcttgtcctaccctaggacacctcccaccaggcctcacctcttcagccagggccagaggaagtacaggccaaccccgctgtcttaacacgcccgaagagagaggaagatctctctccctcctaaggttccagggaaaggaagactcagggccaacgtcggcttttactctgggactgttccaatttccagagataccaggagtggaagggagtgagtgaggaaggcccctgccactccattgggatttaagggaacctgtcacatggttgggagcccttaaaggtcggaagaaacaggagtggtcagaaaagacttagaaccaagaaaattaagcccttataatcaagtcaaaaaagtcccatgtatccctccctcttgacaatggtttgtcccatgccaacggctagtagggacccccctagaggttgaagggggaataatgggtatgttctagaacacgaaaaagcccccaacccatgaaaattctgcagttcattttccagactcctaaatcctagtatacaggttagtgacctttttctgaaacgggcaagatagcaggcatttgaggctttgtgggcaaaagattatcccaactacttgtagcacaaaagcagccataaataatacctgaagaaatgaccatggccatgttctaataaaagttcatttataaaaccaggcagttggcatgatttggcctgtagatgtcaaactcccaatctagattcacatttcatacatgtcctacagacacatacaatcagaatgttcatgatatgactcccccttttccctgttaaaagaaaaacgttagacaacgttaacagtttgtttacacataaacaacaaccaaaaaaaaaaaaaaagaaaaacgagtcatgaatttgtcagtactcagaaccagaagagtttcagagagctattcccagcaacatgagaagtgaatttttataggctgagtttggacacaaaagagaaaaatcacctgattggctacagcaaggcatttgccttatttggacatggtcttgtcacttgactgcctgtaattagctggagcctggctagttgtgtttggctgaaattaggctgtcttttatacagcttatgttaagtttcagtctgtttacatgctaagttagtttgcggtttgttagataggaactcaaagtatggaaacagcttcaaactaatggcctcttgcttattttaatatatgcaggagatgattcccctcctaaattcctatgttgtccaatacagaaacctcaaaatcaaatttttaagttacctacccttcataccgacccttaaaaacaagtcaactaagagacaaaatcttgttgctgtgacctcagaaacttctaagacatccatgcccacttagggaatgtccatgtttcttctcaaataatcttcctgtctttaatttcttcataatccctaatcacttcctaatctttcctatgatcatgtttctcttaagcttaaaatcatttgatggatccttgtggcacactccttgtcctgacattagaatctcaccccaggataccattctaatttaactctctccacaatgttatccaccatcatttatgtacctaagggactaagccatacagggatacactgattttggcgttttaagttattttcccttctgaaaaatcagagcattcattttttattatatgggcattatgttctattctatgaactacatttaaaaagacaatatttcttctctaagggtcctatgtcagataattagagaggaaaaagacaataaatcaagcattaaaatattacctaagaaggtagttaaaccccagaggcataaagtcccaccatttaaatgctgtttttagatgctgttttgtgatttctttccttctcagcttgtatattttatttatcagccatcagtggaaagggttcatgttttggcttattctagagtgacttctacagaaagagcatccagaagataatgtagaaaagagaatggtgaggaaagggggagagactggagtcaggaagacccattagggagatgctaaagcaattcaagaagtaaactaaagcagtggaaatagggatggagagaagagtgtagagagccatttggtagatagaatgcatagggatgtcagggacaaggatgagggaatgctgaggataatgcccaggtttctggtataggggactaagtagatagccctgttattgactagttggagaatgaagaagaattttttgggatgagttcacctttagacatattaacattaaaatacctgttggggccatgtgtggtggctcacacctgtaatcctagcactttgggaggctgtggtgggtggatcacctgaggtcagtagatggagaccagcctagcaaacatggcaaaatcctgtgtctactaaaaatacaaaaattagctgggcgtaatggcgcacgcctgtagtcccagctacttgggaggctgaggcacaagaatagcttgtacctgggaggcagaggttgcagtgagccgagatcatgccactgcactccagcctgggcaacagagtgagattcagtctcaaaaaaaaaaaaaaaatacctgttgggcatcctggtggagatacttagtaggcagtttgatatatgagtctagaacttaggagagacatcagagctgaagatgtagtattgagaggtgaaagctgtatttacagcagcggttgaaataactcagggacagaatatggagcaagaagagtagagggctgaggacagcaccgtggcctgccttcatggatctcctcctttctacagctgtgtgctaccattggtgattttatagttgtcccccttactcctttgtgttcttgtctactaagttcagaacatcttttaccttatctcttttattccctctataatactttaaacatgaacttcagtttgtgattagttgtctctttatactgccattctcccacttccgcttataaacacttttaagaaattaaaagtaaattgtttcttttagcagcctggaggagggagaaagtgaagacagagaaacctgttaagaggttccttcaacagtgcagacaaaacatgattagggcttgaactgtggcaggacctcgatgagatgtcagataacaagagatttttgacatacagttagcatgacttgttaaccaattgtattaatatatgagaaataaatatgggtgttggagcggaaaatgattttgaggcatttgacttgagaaactaggttttgtgacaagtgatgcctcaaatcgtaatagatatgaggaaaaatagactatagagaggagataataaatgcagttttggattgacaaatgcctttgtgatagttatattgaattatagttgaatggctgtactgggctggaagttaggtgagaggacaaaactagagatatgtattataaatttgggtgttttcagtgctcagtttgtggctaagaccttgtgcttcaataaaattgctggagatgaaggttggaaggagagaataagcaggacaaaaaaacagaggaaggaatcccgaggtcttggaaagggtagcagatacctttagggataggataagggagaacaagcagtaggagtagtcagagaagtagacaatcaaaaaagggagatattttagacctaaggagaaatttggaaggtaaaaagagtgttattagtttcatataatgcacagaggttacataggatgagggtgaacaaaaggtcattagatttagctaataagatatccttagtgattcaagtgacgagaatcaatagaatggtgaggcaggtgccagatgataggagatcacagaatgaaattagaggaataagtagaaattttgaatactgactagtctttcaagatctctgacacagtagagaattctaccaccaggagtcagaaaatagatcatggaagcataggatatgacagcttatttggtgagacaactaagttatacaattttcaacacaaagacggggaaaataatctgatatttactgtatgaagaaaggtaatcatatgtaaagaaaactctgtgttttgcattgtgacccaggaaataaggccaaacctttgtgaattctatgatagtaactatgaaataacatattgacagatgcaaaaatatcagtgtaatctgatatttacagagaaagagtgaggaagtgagaaatagttattagagtcagtgaaattggttggggaaggatttctggaggagagttatgttcttgttcttaatagaaacatcagggttctccaaagatttatgaagacctttctgtttgtagcatgatgtgtctcagattaccattcttaaaattgtcttcatccaaacaagaaagcaggaatcactcatactatgatgtggacaatggtggtgtcagggaacctttcaaatttaccttcgttattaccttacctttatccacatcctcaatcattggtagtcagattttgaacaagctgcctgtacccttaggtggcatattgcaactgcctttcccttaggaatggtgacatgagctcaccactagaatgatccacaattcttagttatatgtaaatggattgctacatatatatgtactgtatacttttttcttgagtaggtttctaactttaatgtacagcctccaaataaattatagtttgctttgaattcaaggtgaagaatattttgatgacaaaaattttattttgagtgagtagtttttaaaatatacataatgtttactataaccttgtccacaagctacttttttaaaaaacaattacaagaagaagaaaacaaaacatctttgattcactttatgggttgggttgggaatcggtagatagcatgataatagtggtgataatgttaaaggaaattagtttttattgagtacttagtatatgccaggcactgtgctatgagctttaaatgaactatctcattgttaggagagaattctccatggggcttttgcattttttacatgtctgtgagcagagtatcctttgccctggattatcttttcaaaggtgtatgtatagaaaacatacttttattttattttattttattttattttatttttttttctgagacagagtctcctctgtcacccaggctggagtataatggcacgatcttggctcactgcaacctccgcctctcaggttcaagtgattctcccatctcagcctaccaagtagctgggattacaggcacccaccatcatacccggctaatttttgtagagacagggtttcaccatgttggccaggctggtcttgaactcctgacctcaggtgatctgcctgcctcggcctcccaaagtattgggattacaggcgtgagcccccgtgcctggccagagaatagccttagaagatagaaatagtgtctatctctagagcaaaaggcaggtttgcttatagccttggaaaatacagttagtatctgcctctggaacaaagggccgacatgcttatggcccattgtaagaaatttgtgtttcttaagcttggggttcttctgtaatacaacccaatacttctacaagtatcacctgatcctctttgtattatcctatgggaattgagtttgtgtaagcaacacaaatactgatactttggctactgtcattgctccaattaactgtttattatttctgacctaggattctggtgtcttctaccagcttccatgaaactggcaggctaaatttttagtgcataagtaaggtaaaatttcagaccctttgccattctttcttttcccttttttttttttttttttttttttttttttgagacagtgtctcactctgttgctcaggctggagtgcaatggtgtgatctcagctcactgcaacctccgcctcctgggttcaagtgattctcgtgcctcagcctcctaagtagctgggattacaagagcataccaccatgccagctatttttttgttttgtatttttagtagagacagagttttgttacgttggccaggctggtcttgaactcctgtccacaagtgatccacccgcttggccacccaaagtgctgggaatacaggtgtgagccactgggcccagcccccgttaccattcttaacacttgcataataaaacaaccctattaagttagctgcttttattattctcattccacgcataccaaaaactgagatttagtcacccatgcaaagatccatagataagacattatagagctgggatttgaacccaagtctaactctaaaagctgcattatcaagcagtaagctactcaagtccttggattaaccttttatctgactgcatcatgaactataagaaagttatgcttaaataattctgggttgcagattaccagtgtcctgtcaaaggctgaatgttcatgtcagcaggagataagaacagttaaaaaacacaggaaggggaacatcacactctggggactgttgtggggtggggggaggggggagggatagctttaggagatgtacctaatgctaaatgacgagttaatgggtgcagcacaccagcatggcacatgtatacatatgtaactaacctgcacattgtgcacatgtaccctaaaacttaaagtataataataataaaataaaaaaattatgatatgtttatgcccccacaaatccttgtttgtttaattaccaggtttacaccttacggaaaaaatgtacataaacttaaaacctattatattgacatatttacaggctagagatatcatctatgaatgatggcattctttgttctgttttgttttattttaaaaaaacaataaaacaaaaatcccggagctctttacaactgtacaagcctagaagtaagatgatttacttaaagactaaaagtgacaaaaatgagttcattcaatagatcctgtatccccaaacttcttcttattagcatagatatttttatccttatattaggtttacatctgcttttcaatgtatataaacagcatgacacatagcaggtgcccattaaatgtcatttgaatgattctaaagggttgtgggtcttcatagaataataatacacagttcagggctttggccatcttggtcttttaatgcattaacattgcaagtttgcagttttatgtaattatttatgcagacatctgaaagtcccctttccaatcaagcttaaaagatttttcaataaaactttcttttcttttttaatatttgcaatttaaacttttttaaataaggtaaaatatacatatgtaatttaccatccttaccattttaaatgtacagttcagctgtaataaatacatgtatattcttttttcccccttatccccctttactagaaaaccttatttttctaatgatttttgagaaatagaacttatcaaagggcttgagatcttgtttgtttattcatttgttttccttccttgaatttgctacagtatcagttgctagttcttatgttttaacgtcagtcttattcaatgactgtagatcgattaattgatgttatatgtagcaaatcaattcaccttataaaatttcagacagtaaagcttgttttagtttccttatcattagatggtctctgaaatttacaaggaaagtattttgaagtgaggataagacaatcgaataaatcagttaggaaagtttcaactatatcctgaggcattttatctagggcttttgattttaggtacaagaaagatccctaatttatttagattattttcaccagcttagtcctggtgatacgacaagttcacatatgctcaaactctaaaacaaaactttataatatgggcatgttttataaatgtgagttagaaaaggaatttggatgtttcatgtgtattttaaattatgagttttacttttctccccagagaacccaagattgatcaatattttcccttagaaatacatctgggtaaaaagttctaattatgacctaaacaagctaacattaaacctttggaatagaaagcaaggtttatttataaattttctaattctgtgctatgcaaattaacattattccttagatgttatgttacacatctgctcttctttctatcagcttcctcaagttggtacggataaccacaagttagtttgactgttgagcaatgttagcatcaagttctgagagtatccaggggctagcagccaataaaccttggttctgaactactgaccagctacgtcagcttgacaaagttctttgtcctctctgtgtctatgttttactcctgtaagggatacttaccctgcccattttccagggttattgggataattaagtaagataatacacatagaagtacttggaaagattactaacatgtgtaattgtaagttgttgctgcagtatcattgcaaaggccttttgcctacattgagcctgaatgtgttccttgtcttcctcaggatgtgaagtagggagagaaaaaataccatctccattcttgcacactcgtcagtctgcctcctcaacctcacatagctctaattgtacctaatgaaagtaacatttttaggtcccagttgcaggaaatattttaaatagaaccagcctggggcatttttcaaaataaaatctaaataatgcaagattgttagcacgaactgtgccagggctggattacacaactaataaaaatcaacctgagtttcagactgtcaggcagcattgattatacctcccccaggtcacctgaggtgatagcaggactcacatcagaccttgtctttaagttctagggacctcggtcatcctcaacgacttcatactaggacttgttcatgagttaacaaagcagtttgtcagcatctattcacatgtcagcatctattcacatgtcagtgaccacaatgagagtgtatacatactgggccctggcttaaagttgtttgtggctaaggattaggaaggacacacttcctccttcaactcatcagccatctccagggtggcttccttgcctttaacaccaccccaaatcaatacaaatgctgctgacaccatctacgttgtttatactttggagaggtcagggaacgaacacatgaatggctcttgtcttgtgcctggaaacctggctttgaggtctctgggctttgttatagaaggcatttgtctaagaagctcccagaagtaaattttttgtttgtttgtttgtttgtttttttgagacagagtctcactctgtcacccaggctggagtgcagtggcacgatctcagctcactgcaacctctgcctcctgggttcaagcgattttcctgcctcagcctctggagtagctgggaccacaggcgcgtgccaccacgcctggctaattttttgtatttttagtagagacggggtttcattgtgtcaggcaggctggtctcaatctcctgacctcgtgatccacccgcctaggcctcccaaagtgctgggattacaggcgtgagccaccatgcccggccagaagtaaacctttttaagtggagcttttactacctctttgacctccaaggttctagcctctgcctagtagttagtactcagagtgcctggaagttccttcctgccttagctgctttctcttgatacacttctttttgtgcctaagtcaatgtatctttttgatcctctcagacctacatggctctctggtattagaccttttgcccaactgacctcttccagactgtttcctgtcaagtagcacttctaacccagcagactgttttaacccactgctgccagtgtgttgtttttatattgctcatgattattatatcacatgtaaattataagtattatatattagatatgtatattatacatatatgcatattagttatatatgtatacatatatattaattatacatatatataattattatatatatcttttaatatatttaacaatgctggcaatacctacaattctaattagagatacaattgtttgaatacctactttttgatagatcctgtattaggtattttacatacattattttatttaatacttacagtgatctgaacaggtcaggtataaaaatgtaaacctgtttttactcatagttttataatgaaaggaaatccttcctcccaccttcaatggagccaccataaacagcttcttatcctcatgtttcaggtgaagaaactgagactcagagaggttaaacaatttgtccaaggtcacagaactagttgagtctagtgaggcttagtttaaagatgatgctttgttaagaaaccactatatcagattggtcctctactttagtctaccctattttctacccagggataaatacatctgggacagttagcttctttcagagcattgaacatttcacctgcttctattattgagatctctggtcaacacttctccttctgtggaggtataacataataattgaaaattttttaacaagtatgtctctttcacctgtatgagtgaacaccatggagcagatatgatcaaagtcagtaacatcaagaactgttcagaacactttggatatccagcagagatgattacctttcttctgtgttagatactttttaaataactgtgaccatttagcttccctctatcccctgcccctgccggtcattcttgtctttcagatgtagccaatatttttaattctttgccaatatgctgctgcacaaaacttggctaatcttcctcctagtggctatccacaaatacctgcaaattatccgggtcatacttatacaaggaatgtgatatttgacaagccatataccttcatctgaaggaatgtgatatttgacaagccatataccttcatctgaagaaagggggatatataccatatgggactgatacaaaaatggaaaaaaaataacatgtctctcaaatagataccttttgatgcccattcatttaatcaactaacgtttactaagcatctactatctattcatttagatcccagggatggtgtaattaacaagagcaacaaattccttgccctttttagtgcatactttaacaaataaacaaatattagaagatcagataagagcaagtacaaaggcctattgtttgaataggcttagtgtgttcaatgaacagagaaaatgccagtgtggctgcaccctaatgagtaaaggagagaatgttatgttgagctagatcatgtatggccttgtatcaagcaaggagacttggaaatatttaacactgaagtgtttaaaaaatggtgaaaaagagctcaattgattgagctaaattgatttacccttcttctctgagattactactgttgtggctttagcttcatggcatttaaagaggctgtccaatgtctgacaagaacataaatgtttctttcacttaatccccagtgggcatatcttatgacctttgtgttccaggaacccatgtagaggaagaaagaaaagcaaatcccacagtctacatagtgtgatggggttgcatctaaacatcagaattggagtgctttgatagtttccttctcagatgacacaggcctgggcatagtcaggggtgcttgccagaaattaactttaccagaagcctaagtaggagtcattcttattaacttagtttgtaaacccaagaggcatcgccatctggattcctgtgttttgcatgatgtcggggatataaaatttcaatgagtgactactaagcagtatgaacagtgccgatcatttggtactgtctgaaaattattggttggcatgctaatcccatctgttaggattgttattactcagttataaagcacttggtttgaattgccacccttggcaattttagttttgacagcacgtatcccttgatgtttaaaacagatatggtcctgaaatgtcttccataaagtaaaattgaatactccaagatttacagctgatcttcatagtgttatcaggctgcttctgatttcttcctcacacttttccattttcttttgtgtttgacatcttctggaatccagataaggtagggtagagaaaggtcatggattatacatagaaaaataaaggcagaatttgtatttatttatatttattgtagttagttagattaattaaatatgtttattgaactcacattattgagaaagtgttaaccaaagtacaagaagacagaatttttgttcaataaatacccttctgtaatgtgttagccaattaatgcccaatttctaaagtggccttatgataacattctgtgttgagaattctttataatgctagtgctggttgatacaattaatcccaactgaccagactctagtaggatttcttctttataaaagcccaaaattcaacacctggcacatcttagtgagtaccttaaaaagctgaatagttggccaggcgccgtggctcatgcctgtaatcactttgggaggccgaggcgggcggatcacgaagtcagcagatccagaccatcctggctaacagggtgaaaccccgtctctactaaaaatacaaaaaaattagccgggcgtggtggcgggtgcctgtagttccagctactcgggaagctgaggcaggagaatggcttgaacccgggaagcagagcttacagtgagcagagatagcgccactgcactccagcctgggcgacagagcgaggcgccgtctcaaaaaaaatctgaatagttaacaggtaaattaacctgtaagctaacagatatcctctgtatgttgatctggtttttagtatatattctgtatcaggaaatattggctgagaaaccaatagtaaaattaaactatccctgtagtaactgttaaaggactggccacagggacagagcaaaaatggctacagctccagttatagagagactttctcacaggtttttattatcagattttcaacatagcaatatttattgctgggaaagaagtcagactatcttacagtttggaagatgggtatagcttctctatgtagctctgtggctacctcatggccacaaatatccacattagcaattagtttcatatcttctagtcagttgcagcataaaactgctctgtgttgctttgatgtttttttctgatttctaggcaaggtcctaaatggaaaagccaatactcttgaaatatatagagcacaaacaaagttgtaaacacccaataaagccattttgttatttctctgttcctacagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggtaactcagcatggtgtcaaattcatattttacctcagtcaatagcagtcttggggatgaggaaagggagatttttttactagtttttggtattagatatttcactgagaagaatcaacagatccataactaaataattcagagctgtgactcttatgtatcactggtttttaatgcaggtgttagaagcaatacgcctttctccaactgctaaaagtagaatctccctccagcctgacagcatataagaactaatgggaagaagggtaaacatttaaataacacttgaaagaaattatttgggggacacagaaatattatttactggtgggaacaaaggcctgccattacaagtagtagtacttataaagaataacaactatcataatggtctactctgtgaaagccacaacagtgaatgcagaggagagaaatgggcccagtacaggatgtataaacactgctaaggttaagtttagctggaaataaaccacactcaaaggttgaacagaagagaattgtggccaggtgcagtggctcatgcctgtaatcccagcattttgggaggctgaggcgggcagttcacctgaggtcaggagttcgagaccagcctggccaatatggtgaaacctcatctctactaaaatataaaaattagctgggcattgcagcacacacctgtaatcccagcaacttggaaggctgaggcaggagaaccacttgaacatgggaggcagaggttgcagtgagccgagatcatgtcactgtactccagcctgggcaacagagcgagactccatctaaaaaaaaaaaaaaaaagaagagagttgaatgaaaggattatttacaaaggtttgggcaggcttgaagaaatcaataaaggagcaagctgttgattatcacccctagacctgcagtgtcaaggggaaggagcagtgtcactggaacctggcaagagtggaggaagctgccaagagatacagccttaaaggaacatatgagggtggcagataggaagggagtgggtaggataaataccctaaccatttataactcctgctctctgtttatttgctagttgcttccctctcctgccaccctcattcaaactgaaacagaagccagggggcagaggcaggagatagaatcaatagtgttctgcttttctgagcatagagtagagcagacaagcgtggataattggatctaggggaagaagcagataataaccacacaaccttccagctatgatattctagcagctaacctggggcccacggtcttgtaacagaactaagtcaactctcttctgtcagctctgaaccacagcaattgacacactgaagttttatgatgtgatggtagatgaccaggaaggttttctgcacagatgctgtgtgtactgttggaaccaaacacacataaaaggtggagcaggttgtttctataggatctgacagaccctcagttcctagggaagcttaatccctaactcccacagctgtcatatgcctttacatttggaagcctctccattttcacacctagggaaacttaccaatagacaccaagaacatactctgtactagaacgtccaggtctcaatgggaattatcttaatgaagacaatattgtgacagataaaaaggaacataatgtttattatgcacaaacatatagactacaggtaatttggtgggtttatgccatcatcaacctcatttgtatttattaagcacttattgtgtgccattcattgtagctaaacttgatttcaacattatcttgtttaaatctcagtgcaactctgtgtgataggtgctattatcctaatttaatggagaacaaaaccactgaggctgagagagatgtgacctatccaaagttacacagtgaacaaagcctgattttctattcaaggcagtgtgactccagaattcattttcttaatcactaccctctccggcaatgggcctgggactaaacccagccttggtcatatcttgggaacttttgtaagatgccatgctggtgcagtggagcctggccaaagaaagaaaaagaaagttttattttaattttatggttgaggaagggaaggtgacctgcccaaagagttagcagctgggagtgaaatccagataatcaactttcccttataagagtaattctactatctcatcttactttctgctaacttctttcttctccttttctcatatctctagacatcactatcatccttacatactcaagcaatttactgcttggcaaatgccacttctcactcttccttagaaatggaccaacaatggtgaagcaacaggcctttccagctctgcctggataatatttaatatttctataatattttacagttgataaatgatcatcataatgttagctaacatttcctaagtacttactgtatggcaagctgtgttttaggtgcatgagatagattaatgcaattcttagaactaccatataaggtaatattatctctattttatagaagaagtgactggagactcagacaagctaagtgggttagcaaaagtcaacagtagtttgtgacttgcagtttggctactagccccactcttagcccctacagtatactaacggattaggataaaatactagaatcagaagttaaagagtacctgaagctcaggatgtattgctaactcttggttctcatacaaggtttcaagtaaatacctgaagaaaatgtaccaacatattaggaaaatatttctttttcagtcagtatttggatagtctgccttgcctactttatagcccatgtattttctttttttatttattttttaaattttattttttattattatactttaagttgtagggtacatgtgcacaatgtgcaggtttgttacatatgtatacatgtgccatgttggtgtgctgcacccattaactcatcatttacattaggtgtatctcctaatgctatccctcccccatccccccaccgcacagcaggacccagtgtgtgatgtccaccttcctgtgtccaagtgttctcattgttcaattcccacctatgagtgagaacatgcagtgtttggtttttttgtccttgcaatagtttgctgagaatgatggtttccagcttcatccatgtccctacaaaagacatgaactcatcattttttatggctgcatagtattccatggtgtatacccacattttcttaatccagtctatcattgttggacatttgggttggttccaggtcttttctattgtgaatagtgctgcaataaacatacggtgtgcatgtgtctttatagctgcatgatatataatcctttgggtatatacccagtaatgggatggctgggtcaaatggtatttctagttctagatccctgaggaatcgccacactgtcttccacaatgattgaaccagtttacagtcccaccaacagtgtaaaagtgttcctttttctccacattctctccagcacctgttgtttcctgactttttaatgattgccattctaactggtgtgagatggtatctcattgtggttttgatttgcatttctctgatggccagtgatgatgagcattttttcatgtcttttggctgcataaatgtcttcttttgagaagtgtgtgttcatatccttcgcccacttgttgatggggttgtttttttcgtgtaaatttgtttgagttctttgtagattctagatattagccctttgtcagataagtggattgcaaaaattttctcccattctgtaggttgcctgttgactctgatggtggtttcttttgctgtgcagaagctgtattttctaccaggctgagcaagttttgctctgtctatagcaatataaagaagaggatacatttgtccagagtttattctggtgctcattcaaagttagaaatgtccagtgtgttaaaagaaaaatttcagccaaattaaatttaaaagattaattgagcaaagagtgattcacaaatcaggcagtcttctgagccagagtaagctcagagactccagtgcagccaagtggtagaagaatatttatggacagaaaaaggaaagtgatgtacagaaaatggaagtgaggaacacaaacagctggattggttatagctctgtgccttatttgaacacggttcaaacagttggccacatttgattggtcaaaacttagtaattggcacaagagtaggctatggtctatttacacctccacttgttatagttgacagtgtacagagaaacctttaggcctaacttaaaatatgtaagaaagcagctttaggctaaacatgatttaacaatttcccccttttattcatcctctcattttgagagattgaccaaaactttagtcattgatgtcactatcaccatcataaatgtacttatttggccttgaaacccactgaaaaatagcagaacagtgggttgtgtaaggtgtgaacaaggacttcaggtcattttttttttttgtaagggttagagtagaggataacttcttagtctggaacatcctgtttacaggagaaaaagacaaaacccagtctgttctaggatatatgtgtttccttaaagtcttagtttgattatgttacatttagcacaagtgagtcccttttggttttgtctggtctgttggggcctagtgcatgacatgagctgagtccaaaacaatggcctcccataattttgtttaaaaattcccccctttttgtcaggttctcacttaggtgagagtgtgccactctcagttaccgtcattttgggtttccaggtctcagcaattcattcataggttatgatgccctcatggtcacacatttccttcagctattggcattccaattgaatagacaacatttgccattcttgagatggctgaatgcaaacgtttaaaacttttgagagaatacagtacaccaaggggactactattatgattgtcaggaggataataccaagagtttggagtatgccccttacctagggtcaccaggaaccaaaccaactaaaatcaaatagatcaaagaatgagctaaagagtctactcactttaactaagcagtctcttcattaatctcctacactgaatctctataatacctgatgggatatatttctccacaggccacaagcaccagcagttgcacagatacttctgatacttctctgtttagccagtaagtaatctagagcaattctattatttagcataattttcacaagagaatttaaaatctgttgtgtaaccatagcctttacagtagaatcagttatagagcctatcataagggatacatttctaattattccatcttttactccacaccatggaaaaaagcacttaacaaatgatgcctttctagaagaatgaaggactcccggcaatgttgtctttaacccatgatgtagattaaaaggagtgaaccaacattctgtttctgactatcaggcaacgtatgtaccattaaagttattcacctacattgggccttcatttttcatctatcaaggcatacggttatccatgtataaggctggttatccatgtataaggctggccatttttttttctggggagaaacttccctgggtagctttaccttaagggttctaacgggtgtatagttccataagtgtggagcaaccctccctcagttgtgagattataagcccaaggttcaatgtcccttagctttgctgcagtgtggatggcaaaggaagtccttctctgatgttctcggaagatccagtctttgagttctagattgtgaaggggttgattgtcttcagttagtgaaccgtaaaaatcttttattcctggtgaaaatacattgtgacgtaataatctgttataacatcacccttctcgcaaggaaaagctttgatacaaccagaaaacatacattgaaaatgacaattgaatgaaatccctctataaatgtttaaatgacccatcaggtagctgaatgtatctgaagatttgagtgtcttcccaggaatacgggtttgacaaattaaacattggttataaactattttagcaatgtacaagtcaccacaacaatatatatttaatttggattattttatctttttcatgagtcatggaatgcagaacttttaataacaaaaactttaaggactcaggaaggacaaggcagctgccctggttctccatgagtccatacttaacattggtcttatgtcctcttgaataccaattgtttctccaatttaggtgcgtagcactgataactgatgggttatcataggtcatttgacttagaccatggagttcattcaaattgtgtatctatacaattttggtattggctgatttagcatgataatctggcaaagtgtcttcttggtattcaattaatttttgttctacttgggttagcagttatataaaccagtcttttcattgaagttccaggaattcttacccagtccaaatgatatgactctaaagttatgagaaacccgtattcaagagtgcttttcagggtcctttccaaccttctaaaagacaccatatttctaggattttgcatgcttgtgaatttttcagaaactgcatcagaattaagcaattaactagcaatgacttcaagtaaagacacagttgacaaggaaatttggttatttctgtggtctacaataaattaacataataaccataattataattgatatcatatactcagacagtagaattttagaaatcccataacattttggaacatatattaatgaaattcattaaaatataacctaaagaaggttaatgattatttctggctgggcgtggtagctaacgcctgtcatcccaacactttgggaggctgaggcaggcggatcttttgaggtcaggagttttagaccagaggctgaggcatgagaatggcttgaacacaaggggagggtggggaaaggttgcagtgagtgagctgagagcgcaccactgcactacgctccagcctgggtgacagagtgagactgtctcaaaacaaacaaataaacaaacaaaaatttcttattttgacggtgcttcccatgtaacttaatatatcaaataatcctgtttacctctcttttggatgcttcaggggccctctgtagcatcctaaagttagtggtcaaaagagacttaatttcgaaattggaatttgacttggggaagcctgtcaaatatgttaaatgtttaaaacatttgatattatgaaatagaattccatgtcaccataaatcattcattttgccaaaataatgactcaaaaattttaaagatgtaaaaacctttactcattgatagaggaaagacttagctttccaaacaatctgtctcttgtctttcccttctttctcctgtagtttattcaaaaggcaaacaaaaatctttcattattctttaatattacatgaaaatctcattcaagaaagaaagccaaatttcatccttgcattagtatactgttaatgtcaaccccaatttttaataaaacctagtagacaaatctatctaatcttaatcagttttaccataaggtgagattcacataaatcttttataacccattacaaattttcattaaatagtagatcagtgctctaagaaaacccttttgtgcttttatttcaatgttcaatttacaaaaaaactgaacaataccccctttaaatttagccaatatgttcacatgtagaatttctcttacaagtttaatttttcacaatcttccacaacttgctcaactttcagctttatcctatctaacctaaatcgtcatttaaccctttaatctaggcacaaaaatccacattcccatgccttcttataatcttttaccaaaagcctacttcactttcctcacacattttgcatgtaaaactctttcttcagtagtctcaattacatgttagaatctcaactcttagcaatttttatttttagtgaaaaacccggtaaggaagtgattttaattatgtactaggtgtggggcctaggacaacagactgaagtgcaggtaaagtccaactctttccatcatagctaggggcatggttaactccatgtgtccctaggccttatctagaatctaatggctctaaagcaggtaagtctaacaattttcaaaagtcaaaggagcagtttatgacatcaaagcatttagcaaacctaatatccgacctgcctaatttagaccaaatgtctttattttaccaataatcttataaaactgtgtttatttcccaaagattactaaagtcatgtgaactaaaagacattacagtttttatttttctgacaaaatatttgatttaagcacttattccttttaaaccaattaatcagagctttttcgtataaacatcactcacacaacacatacagacagaagaaaatccattacttgtaagaattttcatttgtcagttttaaaatagcttttctttctcccgttcagtctatcaatcttccaattactggtttcactgaactaagcaattgttgactaggcaacaaatttgtatttctaaagggacaactgttaggtggaaccacaaaaaataaaaatttatatctcataagcagagagcaagattttggtctaaaaattatattattgtttgctcaaaccaggggcaaaacaaaaacaaaaacaaagacaaaaacaaaacaaaaaaaacagtgctctcatgaaagttccatcaagagaagatggccagaaaagcatctcaaccaaaagtatgatttattatgtaaatttaaaggaatgggccgggtgctcaagcctataatctcagcactttgggagaccaaggcgggcggatcacatgaggtcaggagttcgagaccagcctggccaacatgtgaaactccgtctctactaaaaatacaaaaattagctgggcgtgatggtgcatgcctgtaatctcagctacttgggaggctgaggcaggaggatcacttgaacctgggaggcagaggttgcagtgagctgagattgtgccactgcattccagtctgggtgacagagggagacttcatctcaaaaaaaaaataataatggtgatatgatttggctctgtatccccacccaaatctcatcaggaattgtaatccccacatgtcaagggagggacctggtggaaggtgattgaatcatggagatggtttccctcatggtattctcatgatagtgagtgagttctcacaagagctgatggttttaaagtgtggcacttccttgctctctctctctctttcctgttaccttgtgaagacgtgccttgtttccccttcatcttctgccgtgattataagtttcctggggcctccccagccatccagaactgtgaatcaattaaacctactttctttataaattacccagtctcaggtatttatggcagtgtgaaaacagactaatacaaatggtaagtttctaatgtacataagcagatatccctacaaatggagatttcatatatatatgtgtgtatatatatatatatgtgtgtatatatatatatatatgtgtatatatatatatatatattttttttttacaaaagagttttaagatagtcaattaaattccagaaagatgtattttagttcaatagggttttctttttaacatagctactgtttcttagctaaaattactgagttcagggtaatgggtggagcccactaaagaatagggccaacaaagcatgcattgtatgcctagactcagcatggatagatctgtaaaaagaagcatgcctattttacctgagggcctaacttttataaacatcttatctaggataactttctttccaccttttgggtgggaaaataactaagccaaaaggttagcagacttaatttttaaaaatcagttagttgcttaagatttgtatttgccttttataaagtctttagataaaaatattgaaatatttttagaagcttctgcatgtcaataggcatccctaggtgagactaatttgggagccctcaatcaaatgcacttcagtgcattgccattcatttggaacgttccactctaacttatctttagtgagattttgcgatttcaataagactttgctgcttgaggggcctcatacttgtgcgtgtataagccagaaggaactcagttcttcagaaattaaggatcccatttttacctcaaatattgtcttttttctcagattcccttgatcaacttagccagtgtttgttttttcctacttaagcatgcaagaaaaataaaacaaaggggtagaacacaaaaatctctgtgaatttccaaaagccaaattttataccccctgcaatattgccatttactactaggttctttctgacccaatcagatataagaggcctctaactggatccaagccagttaattaccagatccaatctgatcctggacctagtccgctttctgccatgacttccaaacctagtttggatcagaaatttgctcaaagaaactcagagagctcaaaacagaaaaccatggagctttggaatccaagagagaacttaaccacgatccccagttgttccaagagagtaatggacacagtgggtctggtgggtacctcacttggtcattcaatactccttggggtcattagaagctctactttggatcccacttctggtgccatctgttaaaagaaaatcttcagctgaattaaatttaaaatactttaattgagcaaagaatgatttgcaaatcagtcagcctcttgagccagagtaggttcagagactccagtgcagccgtgtgttagaagaagatttatggacagaaaaagtaaagtgatgaacagaaaatggaagtgaggtccagaaacagctggattggttacagctcagcatttgtcttatttgaacacattttgaagttggccacatttgattggtcaaaacccagtgattggcacaagagtatgctatggcctgtttacaccaccacttgttatacttgaagatgtacagagaaacctttaggtcatacttaaaatatgtaaggaggcagtttaggctaaacttgatttaactaacgtcttaactccagggctttaatggtgaaaactattgctttgcatgatccgttttccaggtgtcttttcaaatatacagaatctttaaattcctttcgtttccatcagtctctgtgttttacttaattaactaattatattgtatcactctcatagtccgttttgagtttcctgggctgtttgaaatatgctatggtaggcctttaaggactatcattctgtgcctgcacgtaatcacagctggatgggaagctagaggtgaatcaggtggtactggaggcatgttcataaagatgcctgagtaagccaatccagcctgtctgaggaatacaaaggatatgtgtaagaggactgtatattctctatctgaactgcatcagttatcaaattgagataaggagaggggctacacttttagaaggttcttctgacactatataaataggatttagacattagagcagaatattcaataatgttagtgtttttaaaacgttttacaaatgagagataaggattcttttttaaattgaaccaagaagaacactaaacctacttaattattcactgagcaccctgttgtcacagaaatgtggagtcattttatcccatttctaaatgtcctaattttgataggatattggcaagaaaaatgcaaatacacactttggagtgaaacactcatctatgtgattagttacctcagttggtaaaagtctggtgttaataaggtcaaggctatcactttgaattctcctttttcttgtcacaactatctcaattttagatgtttgacattggttataaatggaattggttgggaatgatggatggttcagtacaaacttatttgtacaactgatcattcattcagcacatatgtattgggtgcctacctgtgcaaggcactatgctaggaactgggaatactgaactgaccaaaataaacacatttctcttttctcatgaagggagatagatgagtaaatagctctttctcaacactccaggaaggaactacatcaattgaaatatctaaaagaacagctcctacttgtaatcaatagtgtctttgtcttgagtaaagggcagcagacatacctgtttttaatcacagacatgaatctctgcaaaggaaaattacaaaactaaataagatcagctaatattttcatggtacataatagtcaggagcaatcttttgttacctaaacatcaagggtttactttcagtcctgcagcttgctgcacagaaagccaatcactgagacaatgagtattgccagggaagaaggctttaattgggtgttgcagctgaggaaatgggaaatcaatatcaaatccatctccctgatggactaaaatcaggggtttatatagcagggaacaaatgtaactaaatgcaagtaaacagaaattagggagaggtaaggaataggagttggctaacaggaagcaggtagttgcttagacaatcatgatggataaggggttgaatttctccttgtctggatgtagtgatatgttaagttttggttccttgatatcatttgggagtcctgatggttggtttcctgagaaaagaactcagataagacaaatgtgactttctcaagttttaagactaagggggcagtttctacatttattcaaaagaaaccataaacatcagttatataggacaactgggtcgatttaaattttacaaatctttttatgtaacagcacacatagaaagtgataatatggcacatcaaagtgagtggaagactggccttgagagcttcaggtgctctcagccctcctgactgatttggggctgaacaacacaaaatcaatgtgcccatatactggtagccctcacatagcactccagagtgctgtgacccactggtttggaagctctggtttaccttttcataaaatgtaatatatatattttttatctaaagatgactgagtaatttaatcttgattgtcctgggaatgcaagggatatgtgggagagagttgtatctcctctatctgaactctatctgttagcaaaaggaggtgagtctgcttattggtggttgttatcttctttttacagatgaggaaactgaaataactcacagagggtcacttatccaacatgtggccaattagattcaaacgctgaaattctgacatctagtgttctcataatctcactatgattgctccactacatgaatatgttatgcacttaatcactcacatcactgatataaacagaattctctatcaaaattgttactccagaaacaaatcctgtaatgctttctaaggactctttaatgactctgagtgttgaaagggactcaaatgaggaaactgaagcccaaagaggttaagtgacttgcttaagtctaatgaaacccatgtctttctttttttacattcattaaattttacaaaaagagaccactaaatagaatagaagtgtgtgtgtatatatatatatgtgtgtgtgtgtgtgtgtgtgtgtgtgtgtgtgtgtgtgtctgtatttaaaagctgattgttttgacaaatcgaacagtgaagaggtatattaatataaagttagtttcatcctctcttccattccatttcagccaccaaaataactaatgctaactgttaaatacttcctcactttcctctatgctaacattttcttcctctctctctccccaccttctctctttgtgtgtatatatgtgtatgtgtgcatacatatataaaacacattatttacttactttcatatatacacatatatgcaaatattttcccttctctaatttttttttataaaaaagagaacatgctatgcatatcatgcttcagctttccccatcacacacaaccgtatgagaaacatccttccacgtcttctacaggtctaattcattttgctgcataatagttgacaggacagaactaccttattttattcaatcagttcttctactaatggatatttatgcattttttttctatttttgtttttaataaccacagtgttggaacatccttgtaaacatacatgcttccttacatccatgacatacaagatggaaatgctctctgtcactattatagttttgtaggttctagctgatgcaataagaaaatgaaatgaaatatgctatataaatattggaaaagaagagacaaaataatcttaattttcagattatatgattgcatacctagaaaacccaaaggatgcaactacgacaacaacaaaaaatagaactaatgagaaacttcagtatggtagcttcctaaaaatgtacaaaaattcaacagcttttgtttttgcaaacaataaccagttagacatgtaaaggtgaaaaatgaagtgatcttgtttaaacaatgacactataaaacacattagaatacatttaacaaggatgcaaaggggcttatatgaaaataagattagcatttgcaaaccatcaatcggacaagggattaatcaccagaatatataaggatctcaaataattttgtaggaaaaaaacctaatctaatttgaaaaatgagcaaaatatttaaatagacatttctcaaaagaagacatacagatgggaaacagacatatgaaaaggtgctcaatatcattgatcatcagagaaatgcaaatcaaaactacaatgagatatcatttcactccagttacagtgacttatatccaaaatgcagacaataacaaacgctactgaggattcgaagaaaagggaacccttgtacactgttggtaggaatgtaaattactacaacccctatggagaacagtttggaggttcctcaaaaaactagaaattgagctaccatatgatctagcaatcccacagctgggtatatacccaaaagaaagtaaatcagtatatcaaagatatatctgaacttccatgtttattgcagcactatgcacaatagccacaatttggaagcaacctaagtgtccatcaacagatgaatggataaagaaaatgtggtacatatacacaatggaatactattcagccataaaaaaagagattctgtcatttgcaacaacatggatggaaccagaggtcattatgttaaatgaaataggccaggtactgaaagacaaacaccacatattctcacttatttgtgggatctaaaaatcaaaacaatggaactcctagacacagatagcagaaggattgttaccagaggctgggaagggtatggaggggttgcagagaggtggggatggttaatggatacaaaaaaatagttaggaaaaatgaataatacttagtatttgctagcacaacagtgagtctatagtcaaaaataatttaattttccattttaaaataaaaagtacagttggattgtttgtaacacaaaagatagatgcttgagggaatggaaaccccattttctatgatgtgattattacacattggatgtctgtatcaaaataactcatgtcatcataaatatataacctactatatacccatgaaaataaaataccattgaggtactattatgtaatagaaaagctaaaatcgaaaacacagatgacacccaatgctaacaaggatgtgtagcaacaggaagaattattcattgcaaatgggaatgcaaaacaatacagccacttttaaaaaacagtttggcagttcattacaaagttcaaagtaagcttaccataacatccaacaactgtgcttgtaggcagttaccaaaattagttgaaaagtttcatccacacaaaaacctacacacaaatgtttatagcatctttatttacagttgccaataattgtatgcaaccagcaagtccttcttcctttgtgaatggctaaacaaactgtggtacattcatataataaaatattattcagatatgagaaaaaatgatatatcaaatcataaaaagacatggagaaaccttaaatgtgaaaccataagtgaaataagccagtctgaaaagggtacgtactgtatgcttagaactatatgacattctggaaaaggtagtactatagagagaataaaaagatcagtggttgccaaggtgttgtggaggaaagatgaaggaaggaatcaatatatggatcacagaatatttttagggtgggaaacaatttttaggatggcaaacaattctgtatgatgctgtaatgatggatgtatgaaattattcatttgtcaaaaccaattggactgtacaaaacacagagtgcaccctcatgttaactgtggacctcctttaataacaatctataaatattcgttcatcaattagaccaaatttatcacattaatgcaaaatgttaataatatgtagaaaacttgatgtgagagtttggagggtatgtggaaaccctgtactttctgcacaattttttctataaacctaaaactaaaaataaagcctattaattaagaaaaaaaacaaaatttattataggacataaaatatgatccaaattaatgaagagacaacatgtttctgcatgggaagataccaaagaataaaagatacgcttttctgaaaatgtataagtaatgcaatttgatagaatataaattatttgaaactggacaacataattacacagttaatataaatgaatatgccagaattgccaagaaaatattggaaaaaagcattcatgagaggggacatattctatgagttgctatcatttactacaaaacaacatcaattgaaacagtaagctaaggaaaagataattgacctgtagaatagagaatccagaaacagataaaaatacttatgtatgagaatgtagaatataataaaggtaacatttcattttaatgtaggtggagggagaatgatggtttatttaaatatggtgtggacataattgaatatctacttagaaaaaaattagatctctgactcttgtaccctgtttaagaaaaattctaaatgaattgtaaagagttaatttcatctacaaaaatagtggtttaggaatgaccatttctaaatgctaccacttatttcaataagttaagtttttaaagaaaagagctttacattgatttatcttgttatacattctgactgtttttctaaaggtggaaaaaatgtcattagaaacctcataataccgcagcctgaatgatcaacacttgcttgctaaaaaaaaaaaaatggtttcccaaaatgcttggagattttgaatccctttaggaagtgtaataaaattaatctgtgccttctgtcataaccataaaattgtatgcaacccttgaatttttaatcttgtaacaagaattttcaaagacatatttatccagaaggaatgagttgcaaagctcatgaaggcttcagtttggtgtgccctgaaaccatagtcagcaatacaaaatttaagatccatttgtacttctttttgttcctagatatggcattagaagtggggaggtttttttttttttaactgtttgtaaattataaaataggtgggctaatacaataggaatgggtatttggcatgtataagaagcactgggctccatgtttgaggacttggattctgatcaccatactaccattaacatggataagtaattaaatatcactggacctcaatttccccacatataaaatatatgtaattaatagctgttatataccctagacatgttataaaagtttaatgattaaagtctttacttgagatttgctacaactatagaaatggaaaagttatgtggaagccagaaatatagttacctaagacatctcagattctaatttaaggctgaggtttttttaaaggtcaaattattatgtataatttacaaatagcaaaattcatcccttttacatgtacaatttgatttgatgtgttttgacaaatgtatacaccatagtcaagatatggaacagttctgtcactccaagttcttctgtgtccttttgtattcaatcctctcgtcccagccttagtctttggtaaaaattcctttgtttctattcctataattttccattttccagaatgtaatataaatggaataatatgatatgtagcttttttgtctgtcttcctttacttagtataatgcatttaagacccatctatgttatgacatatatcaataattcatttctttttatgctgagtagtattccactgtatagatgtaccactgtttaaccattcactaattgatgaccatttggattgttgccattttttgattaggaataaaactgttacaagcattgggttttgacgttatattttcttgctttatcaacatgatttgtttttgtcaactttgtaatcttttaacaggcatgcctttttaaaatttaacaagagattgctcttgatctttcccaaattgttctaagaatctaggcttagaaggtccttgagtatatctttaatggcatcccagggatacaaacagttcaaagcaaactaaagcttcttaagcaatgtctttcctacagtatatcttcaatgtatccagcagaatgatcttttagaaatacatatctgatcataggatgctacttcttagtgaactctaatgattctataaaatcatttagatgacagctcctttttactgagtgtttgcagggcctaacattgtgccaaatatgttcatgcattacatgactcaatcattagtgaagccttatgagataggctacacggtggcagagctgaatttgaaccctgacggtgtgcaaatatcttagaatggaatttaaggctctttacatttgaatccagccactctcaaaagagcaaaattatttggaacttttttgtctacttcaagtgttttcacatctgtgtgcttctacacatgttgttccttctgtcttctacaccctgcctgccttttatatgttgttcaaactcagctcagatgctcatagtagcccacctgcataccatccccttgcccagacccagtctgctccaatacatgaatgactcagcattgaaatttaaacatttcttctttttctttctctatttcttcttgttctagtattcccattatgcctattttacaccttttgtagttccacagttcttggatattctgttccactttttttccattcttctctctccttccttttcttgttgggaagtttctattgacattatattcaaactcattggttctttcctcagctatgtagtctattaataagcccatcagaggcattattttatttctgttgcagtgtgttgattcctagcatttccttgagattatttttaagagcttccatctctctgcttacattacccatctactcttacatgatgtctactttttccatcagaattattaacattttaatcatacttattttaagttcccaatctgggaaatataaaatttctgccatatctgagtctgtttttttttaacttttattttaggttcaggggtacatgtgaaggtttgttacataggtaaacacgtgtcacaggggtttgttttacagattatttcatcacctaggtattaagcccagtatccaatagttatcttttctgctcctctccttccaccttcaagtagaccccagtgtctgttgttttcttctttgtgttcatatgttcttatcagttagctaccacttataagtgagaacatgtggtatgtggttttcattccctgcattagtttgctaaggacaatagcctccagctccatccatgttcccataaaagacttgatgtcattcttttttatgtctgcatagtgttccatggtgatatgtaccacattttctttatccaatctgtcattgatgggcatttaggttgattccgtgtctttgctattgtgaatagtgctgcagtgaacatttgtatgtatgtgtctttatggtagaattaatgatttatattcctctgggtatatacccagtaatagtattgctgggtcaaatggtatttctgttttgctctttgaggaatcgccatactgctttccacaatggttgaactaatttacattcccaccaacagtgtataagtgttcctttttctccacaacctcaccagcatctgttattttttgactttttagtaatagctatccgactagtatgagatagtatttcattgtggctttgatttgcatttctctaatgatcagtgatgtcgagcatttttttcatatgtttattggccacatgtatgtcttcttttgaaaagtgtatgttcatgtcctttgcccactttttaatggggttgtttatttttctcttggagatttgtttaagttccttatagatgctggatattagacctttgtcatatgcataatttgcaaaatttttctcccattctgtagattgcctgtttatattgttgaaagtttcttttgctatgcagaagttcttaagtttaattagaccctacttgtcaatttttgcttttgttgtgattgcttttggtgtctttgtcatgaaagttttgcctgtgtctatgtcctgaatgctgttgcctaggttatcttccagagtttttatagtttggggttctacatttaattcattaaaccattttgagttaatttttgtatatgatgtaaggaaggggttcaccttcaatcttctgcatatgactagccagttgtcccagcatcatttattgaaaagggagtcttttccccattgcttgtttttggcagctttgtcgaagatcagatggttatagatgtgttgtcttatttctggctctctattcttttccattagtctatgtgcctgtttttgtgctagcaccctgctattttagttgctgtacccctgtagtatagtttcaagtcatttaacgtgatgcctacagttttgttctgtttgctcagaattgccttgtctatttgggctgggctcttttttggttccttatgaatttcaagtcctgtgaagaatatcattggtaatttgataggaatagcattgaatctataaattgctttgggtagtagggctataataatattgattcttcctatccataagcatgggatgtttttccatttttttgcatcttctctgatttatttgaggagtgttttgtaattcttattgtaaagatctttcacctctctggttagctatacacctaggtattttattatttttgtgacaattgttaatgggactgcttttacaatttggctctcagtttgcctgttgttggtgtatgtgaatgctggtgattttatacattgatttaacatttttctcatattttcaactttttgatgtctgccttaatttcataccattcaacccagcaatcccattactgggtatattccagaggaatataaaagtgtataaatcaaactttgctgaaactttgctgaagttgtttatcagctgaaggagcttttgggctgagacaatggggttttctagatatagaatcatgttgtctgcaaacagagatagtttgacttcttctcttcctatttggatgccctttatttctttatcttgcctgattgccctggccagaacttccaatactacattgaataggagtggtgacagagagcatccttgtcttgtgccagttttcaagggggatgcttccagctttttcccattcagtatgatgttggctgtgggtttgccgtagatggttcttattattttcagatatgttcttcaatacatggggtattgatagtttttaacatgaaggggtgttgaattttaccaaaagcctttgctttgtctattgagataatcatgtggtttttgtctttagttctgtttatgtgatgaatcacatttattgatttgcatatgttgaaccaaccttgcatctcagggatgaagcctacttgatcatggtatattaactttagatgtgctgctggattttgtttgcaagtattttgttgaggatttctgcattgaagtacatcaaggatatcagcctgaagtttgttgttgtgtctctgtcaggttttattattagaacaatgctggtttcatagaatgagttggggaggagtccctcctcctcaattttttggaatagtttctgtaggaatggtaccagctcttattggtatgtctggtagaatttcgctatgaatccatcaagtcctgggcctttgtttttctttttggtggataggctatttattattgacacaattttttttcttttttttttttgagacggagtctctctcagtcacccaggctggagagcaatggtgtgatctcagctcgcttcaacctccgcctcctggattcaagcaattctcctatctcagcctccagggtagctgggattacaggtgcctgccaccgcacccagctaattttttgtattttagtagagatggggcttcaccatgttgcccagactgttctcgaactcctgagctcaggcaatccacctgcctcagcctcccaaagtgctaggattacaggcgtgagcgaccgtgcctggcctattgattcaatttcaaagcttattattagtttgtccagggattcaatttcttcctggctcagtcatggaaggttgtatgtgtctaggaagttacccatcacttctaggttttctaatttgtgtacatataggtgtttctagtagtttctgatgggggtttttatttctgtggggtcagcagtaacatttccttcatccaattgtgtttatttggatcttctctcttcttctttattagtctagctagtgggctatctatcttattaatgttttcaaaaaacttttgaatggttttttgtgtctcaatttccttcagttcagctgtaatttttgttatttcttgtcttctgctagtgttggagttgatttgttcttgcttctcactttcagttttgatgttaggttgttaatttgaaatctttctaactatttgatgtaggcattgagtgctgtgaatctccccttaacactgctctagctgtgtcccagagattctggtatattgtatctttgttctcattattttcaaggaacttgttaatttctgcctttatttcataaattacccacgagtcattccagagcatgttgtttaatttccatgtaattgcatggttttaagtgatttttcatagtcttaacttctatttttattacactgatctgagagtgtgtttggtatgattttggttcttttacatttgttgaggattgttttatgtccaattatgtggttggctttagagtatgtgccatgtaccaatgagaagaatatatattctgttgttttcaggtggagaggtctgtaaaggtctatgagatccatttggtccaatgttaagttcgggtcttgaatatctttgttaattttctgcttcgatgatctgtctaatactcagtggggtgttgaagtctcccactattattgtgttggagtctatgtatctttgtaggtctctaagaacttgctttatgaatctgggttcccccgtggtgggcgcatatatatttaggatagttaggtcttgttaaattaaacccatcatcattatgtaatacccttttctatattttaatctttgttggtttgaaatctgctttgtctgaaattagaattgcaacccctgctttttttctgttttccatttgcttggtagattttccttcacctttattttgagcctatgaatatcattacatgtgagatgggtcttttgaagacagcatacaattgggtcttgcgtttttatccagcttgccactctgtgccttttaagtaaggcatttagctcttctacattcaagattagtattaatacgtttggatttgatcccgtcattgtgctgttggctggttattatgttggcttgtttatctggttgctttacagtgacactggtctgtgtgtttaagtgtgtttttgtattagctggcagtggtcttttctttctatatttattgttattttcaagatctcctgtaaggcagttctggtggtaatgaattccctaaacatttgcttatctgaaaaggatcttatttctccttcatttaggaagcttcatttggttgggtatgaaattcttggttgaagattttttttctttaagaatgttgaatataggcccccaatctcttctggcttgtagagtttcagctgggaggtctgctgttagcctgatggtgttccctttgtaggtgacctgccctttctctctagctgcctttaacattctttctttcactttgaccttggaaaatctgacaattatgtatcttggggatgatcttcttgtgtagaatcttgcaagagttttctgtatttcctgaatttgattcttggcctctttagcaaagttggggaagttttcatgaacgatatcctgaaatacgttttccaagttgtttgctttctcctctcttctttcagggatgccagtgattcatagatttggcctctttacataatcccatatttcttgcatgttttgttcattcctttttattctctttatttttgtctgactgtcttaattcagagaatcagtcttcaagttctgagattctttcctcagcttgctttattctgctattaatacttgtgattacattatgaaattcttgtattgtgttatttagctctctcatacctgttaggttcattcttataccagctattttgtccttcagctcctgtatcgttttattgtgattttttcccttggattgggttttttcatcctcctcaatctcaatgatctttgttcctatccatattctgaattctatttctgtcattcctgccagttcagcctggttaagaactcttatgggagaactcatgcatttgtttgtaggacatacaacactctgaccatttgagttactggagttcttgcgttggttctttctcatctctgcctgtggatgttcctttaactgcagtgtagattgagtacagtcaataggtgtttctggatgttttcactgggctgaggctttgtgcatggtctttatttgaagcttacttcctgtctctggtttcagagggggggtatgttaatgaagtatttttaatgttgaagatttagggtgtgatccagcaggtggcacataggcttattggtcagttggtacactcttgctcagttgtgtggctttcctatgtttcctcacatttggagccctgttccctctcaatgctctgaaggtgtggcttcctctctcctttgagtgctggctgtagattgcaacttggcactactgggcttctcatagtagctctggggtgatctcagtgttttatgttttttccccaacttggaagcagcagaggaagggaccttagtagtggttgtggccaaggatcatttgcttgtctcctgggagctccactcgagagaggtgcaggtcagcaatggcttagtgcaatcagcccaggatgaagggcctgtgctgtgggtccaagccaagacttccatgtctggtgacaagttgtaggggatgtgtgggacctgtgggagatggactggcctcctctccttgggtcaactgcagcttgctggtggtgtggttaaggtacttaggatatttcctccgtagtctgagggtagcaagggccgttccactacagaggtagtggcacagaggttttcagttgtccttggagactctgtccaggaagttgctaagttgcctggaggacctgcccggtaaggagatatgggaataggcacccacataacagtctggtcagtttttcttagggctgctgtagtatgctggaggcctgctttagtcagtagtcaccttgaattttctagtacctggaggtatcactagtggaggctacaaaacagcaaagatggcagcctgcctctccctccgggagcttcatccccgggagatatggacctgttgctagcccaaagtcacctgaaggaggtgggtggagaccctggttggaaggtcccactcagtgaggaggaatgggattggggacctgcttaaaaaagaagactggctacattttggtagagcagctctgctgtgctgggggtctgttctagcccctggttgccttgggcactccaaagccccaaagttggaacagctaagtttcccaaacagcaaggatgacggcccagccctccttctgagagcttcatcccagggaggttaaaaatctctgttagccagagaacaccaacaggggtggctggaggcccagtttgggaggtcccgcccagtgagtaggaaagggattggggactcactgaaagaagcagtctcgccacattttagtagagcagctgttttttgctggggaatcccttctgcccctggtcagctcagactctccaaagcctgaaggttgaaatggctaggtcacccaaacagcaacgatggtggcccacccctccctcttggatctccttcctgggaaagttacaaatctctgttggttggaaaataccagcaggggtggctgcaggcccagtctgggaggtcccgtccagtgaggaggagtaggatcggggatccacttaaagaagcagtctagccacgttttggtagagcagctgtgctgtgctgggagatcccttccaccactggtcagcttagactctccaaagcctgaaggctggaatggctaagtcacccaaacagcaaagattccccctgcccccggccctgggagctcctttttagggaggtgcaatgcccctaccggtggctagctggaattccaagtcttgttctgttaggtgctgtggacatggggcctgaaggctattgctgctcagccccctgggttcagcctctttcctaggggtatgtttggaggtctaaccttccactttgccagagctgcagctaccctttctggaaagcccaagtatataagactccagggtctcctcacatgcttgagtggctgctctgccaaggctccacatagctctgtctgttagactgaaggccctggtggagtgggttcatatggagatctgctgatctgagggttgcaaagatccgtgggagaaggtggtttcctgtggtcacacattcactcaccacttctctgcacaggggaggttctcctggctccatgttgcttccaggtgggccgtcatcctgtcttgcttttcttcattctccacaggtcaagttgttttcttgattagtcccaatgtgagtacctggatgtttcagttgaaggtattgtatttactcgccccttcttttcctctatgggccacacatgctagctgcttctagtcagccatcctggccacttcatatcttagtctatttctgatgcttgctctctcttcaggctgtttttttgtttgtttgtttgtttgtttgtttgttttgttttttgagttggtgtaccttgtaatttttcgttgaaacccagacatgatgtactgactgggtaaaaaggaactgagataaataggcctttagtgtgaggtttttagatttttctggctaagagtaaggctgtttttactgttttctataactgttggtgttagaggctacagttctttctggtgtccttgtttttcactcttctattgtctttgggtttccctagagacttcttaaataagatgtgagttgtgcagttctttaaactgtgatgccctattattagacaggagtcctaattgatgtgttggtaagatacagggtgagagtaagtgctatataatattatgactaggtctcagtgttttagtgaaccttgtctctgaactgtgaccacaagtgcttctcagcttctctcccacccactacttgagacaggaaggctagaagggctagagctggctttttttcttcttccacttcaaaggctaaaaggagctagagttggatagtttccttctccatgtcaaaagctagaaaagggtaaagagttcataccagttgctggctcgtgcagctgcttctgctcccagtgagctgtgattctctatattctcctgtctctccagtttttggggtagtagttttctttgtgacctcagttatctgatggatctgaaaatggttattgatgttcagtttgtttggcttttttcttgttgtgaggatagtattgatgacttctaagccctttacatgtcagactagaaaccagaagttaatctcagccttagaatgataactttaggttaaagtgttgtctctagactgctatagaaaattgagtcacattaactcctgatgatcattaatatatcataacacatgtataacctgaaagcaaagtactaaaagtaataaaaataatagactaatagttaatatttattgagtagttttagcatgtgatgccctatattacagggcatttacatatatcacctcagttaatctttataatcaccccaattggtaaatattatcaccacctgttttttttaaataggtgaagcaactgaagcttagattgatttagtagcatgctcaaaaacatactacttggaattctaatcaaagtgtttagtctagaacttatattcttaaccactgtgggctaccaatatcaacattaatactgtgaagatagaaagttggagaaacagagcttggaagggaagggctccttgtagttggttatcctaggcctttggagtagagataggctgaaaaggacaaggttcatacctaatttgcaatcgtactcctaattgtctcttccatctttaaactgcagacagttcagtttccctaaagatttttttttttcttttgagatggagtttcgctcttgttgcccaggctggagtgcaatggtgcaatcttggctcattgcaacctctgcctcctgggttcaagcgattctcctgcctcagcctcccgagtagctgggtttacaggcatgcaccaccacgcccaggtaattttgtatttttagtagagacggtgtttctccatgttgatcaggctggtctcgaactcctgacctcatgtgatccacccgcctcggcctcccaaagtgctaggattacaggcatgagtcactgcgcctggccccctaaagatttttaagcagatgtttagatgccctgtgggagaatacagtctccaggggaaaggagaaaagttgcctaaggggtggatgttgggtattcaaacaaaggtgtttgaggactagaggttacatggttagtttatggtcgcatagctgctttgtgcttaaacctcagaatcagaagaaatattgaaatcaatcttcctgatgttcttgccatgaagaatgaatcatgtgctctgaatggcactaaagtaaccacaaccaccaaatcaaatggatttaaaaaacacctgtaggtatgatgatgatatctcagaagtagactatgaatacagtggtaaatatttcaggttggaaactccaagatccaaatgtagctggcaacaggttactttagggttcttagtaaacagatatctcagttgtgcattctgggctttcaacccagcaactactggcacgggacatttgccacctaggaaggtggggagggagaggaaaaaagctgggctttaagtgttgacattatgttgactgggtaaggatgtcctgcaacaaactactctatgaggggatagcaaggccacaaaacggatctgattgttgaacttaagcaactctagcaagacgggctctcagcaaaattttcaagttgttcaggtttaatagtcccagggacaataaatagtagggggattacacagtgagttcagtattagggaactgctcaaatttgagcctttggtggtttgtcctggcctcagacaaccatcttgagacttgacctatgcacttcaaattctttgcctagtatgttgctataattaaacacagctggagcagtggggtatggtgatattctttggctgtgtctgtactcagatctcatcttgaattgtagttcccataatccccatgtgtcatgggagggaccaggtggagataattgaatcatggggatggtttcccccatcctgttctcatgatagtgagtgagttctcaggagatctgatggttttataaggggcttctccttttgctgggcactcattctctctcctgccaccctgtgaagaggtgccttcctccatgattgtaagtttcctgaagcatccccagccatgcagaactgtgagtcaattaagcctcttttctttattaattacccagtcttgggtatttcttcatagcagcatgagaacagactaatacatatggcaatactgtctgttcattaggaagttagtgagcaggagagaagtaatgacagcagtaagcctagcagccagcagcttactgggagaaagagtgccaataatggaaccaagagcctggaagacttctgagagtctatataggcatccagactgaggtagaatagccaacaaagtaactttgcaaaaggcgtattagtggaggcaggatgggaacctttagaaattgtctgtgttgtatgaccactccttatggtgctgcccaacaagaatgtaatgaataaacctgcaagcctctggattctggctgctcacatggtagtgaatattattcccataagcaaatttgctgaagatgacagaacttgggggagccccacattttaacctagagatgtcttaccctaaagccagtttgccttttcatctacactacattgtctctagagggatgttggtgacctgaagacaacattttcttatgccacagttaaaaaaaaataaagatcctctattggatacaaagaaccttttataaggctagatggcagcttggaaaacacatagggctatctcgatcattcccaaagaacatataaagattccaagctgttcttcatcaggagttattttataattcctatacactctttagtttttacttcctggggaaaaaaagcaaaacagtgagcagagaaaatgaaaattgttagaattaattgcatatggactttccctaaaatgacataagaaaatgacaccatttgtctttgaatgagtgtgtgggcttatttgcccacccccaccactgttgtgtgaaagcgcagcagctcagttttcattttcctttcctctcaaaatgcccagagggaccatatttttgtttaatgaccttcagaatgattctttagaaatctgaggctatcagagttggaaacaatgcgaaaataattgtggattattattgtatgacggcagtggcagctgggctgtttctttttctctgtgttcagactttcttcttcattttcccagaaaccttatatcccaaggtttaactcagaagcaaatctcagataggtgataaaccttgccagacatggtatgtaatataatttcagacaggcccttaactgttcttcaggaagaccctagggagtgaagcagccttatatctacatgctctcaatagtattacttttatttactctctgacaatgtgtgtgggtagttgtattgaacataaagcaagcatatctcttaaatattatacttgtgaattaaagcaccagtttgtgtgttttgttgtcaaaattcctgctaacatgaaagaaaaaaaatgttatgaaaaaaatgggtactcgctgtctcagatcacttacacacacacacacgtacacacacatacacatgaacacaaacacacaagcactcacagctggggattgagagtcagcacagattctaactttacatgaatgtttaagatatgcgtatggaggcaggggtgaggagtggtagatgcagatgttgtatacaccatagtggggaaagtaaaaagtgctctcaactattgttcacatcatctacctcaaaatcaatttatttattgccttaactgacagaatttacatgataaaatactttttttttttttgagacagagtctcattcttgtcacccagaatagagtgcagtggcgtgatctcggctcactgcaaactctgcctcctggattcaagagattcttctgcctcagcctctcaagtagctgggattacaggcacatgacaccacgcccagctaatttttgtatttttagtagagacagggttttaccatgttggccaggctggtctcaaactcctgacctcaagtgatccgcctgcctcagcctcccaaagtgctgggattacaggcgtgagccaccgtgcctggcaataaaatattttttgccttgaatattcagcactccctaacagctatcccctacgccttgactgatgtttgtacagcattcggctaccactttggtagaacatttgaggcgaatgatagccagaatggggcaatatctaataagtagtctgaaaaaaaattcctaaaagacaaagataattgcctgaatattcttacatacttggatattgttatatccttgtcactttctggaaaagtattaaacattcctttctagagaagtccaatcttggtagcaagattccctcacattcctatcaggagagtaagataattggcttcaaaacccaaaacttgttctgtggttatatatcactgaactcagaaagtaagtggatgatttctccaggctgttactataacaaagcgtgtcctcattttacctagctatgtttctagagaagtccttaattttttatattccttccctctctacccccacatggatttcttgattacaagaagggagattctggagtactagtattagtttttataataaggagtaattaatgaaacaattgtaaacttcattgccaatataaaatcctattatgaaagattaataatgcctaagactcccctggagtatactaagtggctaagtgaaccatgtcctcttaggactcttaggaaatatccttgtcaaatagaaggaaccaggacattataataatatttagtgactgttaaggttctgctatacctctcttgtaattggggagcctctatgctattctatttatttttttcagaatgcctctaaagacttcttgctcttggggtcaggcctttgaagtggtttgtagtgcagtagttgtgatattagaattggatacaataggacacatttgtgatttttcttggtcattgacttaactccttagttacatattttgaaaacgaaagagaataatacaaaaaagtaaaagtactaacttgctggtactgagatgtagtctgtgaaattctattttttgcttacttgcaaatattttatctgcaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacaggtaggaatcagttctacaaaattacggcaaatgagattttaagtataatttggtttgggaagcaagagttttgttcaaagagtcaactttctgtgaatttagaattgcctgcaaatcaaatagttgagaaacttgctattaataagttgtactgagtaaaagcaatatatggaatatgaaaaaagagtttagagaacaagggcctagttgctgtgtgtctgttctctgtctttatgaaaggttctgaactcttcaaggtatcattattactaaacatctcagaaaatatatagtggagccaatctagaatgttgacttaacccatttgtggaatctccttgtaggtgaaggctgattttagaatgagaatctgttagatttttggaatgaaatcttcttagactgcatccaaaatatcatttatacaaaattctccataagtgagtgatgttattgtgagcttctagtgattcttagagcaactccaaatgaagaacatgcatgtgtgttttaaatctgaagtacaaacaaaatgtaaactagtggaaggataaactcagaatattcttacttgttagagaattttaggaagtaattttcagagacataagacagaatctaataccaaaaagatatcccttacaatgaatgtgatggaacctgagaaactgtatgacaaaaaaatctacttactattgctcacaaacaaatcttgactaattttcctattattatatctgtcatgtgtattttaatctcatatatggaacctaaaaaaaagttgaatgtgttgcaaaagagagtagaaaaatggatacgggacagagagtggggaataaggagtgtaggtcaaaaggtgcatacaaagttgcagttatataggatgaataagtctagtgatttaatgtacagcatgtagttaataatgttgtatgctgaggccagcgcagtggttcatgcctgtaatcaatcccagcactttgggaggccaaggcaggtggatcacttgaggtcaggagtttgagaccagcctgaccaacatggggaaaccctgtctctactaaaaaaaaaaaaaaaattagccaggcgtggtggcatgtgccgataatcccagctactagggaggctgagacaggagagttgcttgacacaggaggcagagtttgcagtgagctgaaatcacgccacttcactccagcctaggcaacagagcaagactctgtctcaaaaatgaaaaataaatataatattgcatgttgaaaatttgctaagagataaattttaggtgctcttaccacaaaaataaacatatgaggagattgatatgctaatttgtttggactgtggtaatcagtttgctatgtatatgtataaacaaaaaacatcttgttgtataaccttaaatataaacaattaaaaaagtatgtgtgtgtgtgtttgtatgtatacacatacatatttctattgtggataatatccaagccatgataaacttcaaaattacctagacaattgcaatattgattgcattaattgacttatgattaatgtacttgggcattacttgtttaaccatctaatgccaacatcagccagttggttaatttataacatactctttctaatgttagcaatacattttttcttctattttatttttgtttaaaaaggttcaaaaaggtctggatgacctttttgagatagtgttaaaatcagtcaactaattaatacttgctgagttaagttgattgctacaacccatatatttaatttggtttttgatccttgagattcattgtttttgtctttttcaaaattctaaatgttagcacagggaacacaaaatatatatttttaataaactaatatataatatacatatatattacttcactctctgtactaataaatgatagttttacttcttagtttgattttgtagagtgccttctatgaaagtttaaaaattcttttgattagaattgcatgttcttttccctatgagctttcaaaataactaccatattgggccaattccaaatagcaaagatctgcttttgattagtttctgatttcttcaacatgaactagacttccctgcctcatttatggcagaaaattcaatcatgggcagttgtacattattaataagtgacctgaccatgcacaaagcgtcgcagcatcatcactttggccacagtcactaatccttatgagaggcttgcagagcacttccattttggatcatttgctgaatcttgtaacattatagtatttggcttgagtttcaagttgaaccagaataaagtaaatacgaaacctccttttcactcacatcaaatgggttctgttgacaacgcatttgcttctttcatttcattttagattctggaaaagagagctagagctacttattttgtatattttataagatgttagtttacttgttttaactacagatctaaaatttcacttgaatacctcgcagaggatctcaaaatttaatgtgcatcagaatcatgtaaagggacccagataggatgaagatgaagatctctaaatacagatcctcagatttctcccttagattctaatttagtacatcagtaagactaggaatttacctttttgtccaggtgattctgttttatgctttccaaggatcatgtttttgagagacactagagaagagaatggtgctaacaagtcaaagtcataggtttgattattttgtgagtatgttagttcacacatgcacacacacacactgatttttataggccccaatttgtttcctttaaatttctaggaactgccatgaaaatagagatcatggtaaccaaggaaaatgtgtcaaggtagtgtgtgggtaaaagcgacttcaactagggaaagcaatcatttattcacttaccacttaaataaatatttactgagtacatgttacatgccaggcaacaagctaggagctggaaaagataattcagaatttgtttatgattatccttgggtcagtggtcgtcattcatataagaaagtatcatatttgtgtatttattcacacagttcaaatgttatgcttgatgtagaaacaaaatggctacttggtatggaagttcaagagtttgctctgtgaaggtttattcttttttggaacattatataacttataccatgctttgtatgctcaataatatgaaaacaattaacaagcagattgtcttctcataattcaaaatataaggctaggattatttaaagagtaaccactcatacttgttttgggtttagcatgggataagaatttcaatatgacatgaatagaggtggttaattacaaaattatgtaaatagaggttctttaaatggtgtatttcccttatgcaaattttgaaagattgtcaaatttctaaagcttattttctgactattctttttaaatttatgattctgagaaatataacttcagtaaaacaagtgtttcttaaaggtacataggtgctatttgctttaagaaggtcaaatataaaaagatccagatattcaaaactgataaactagaaggttatcatttgctttaatgaaataatttctccatatatgtcatagtatttctttagatagttagctttctttctgcattaaaacaggatttgatttaaatgcaacttttctggaacacttttattatataaatcgtagcagacttttgttatattattgtggaaatttctttttattccttcaaaggctgcagatgcatagggaagggtttaacaacaaatagacgtgcacagtagcatgtttaggtcatttgctaatgatgcctacagcgacagttttatttcccacagcatattttaggtgactatatgctattttaaagtttttttctttattctcatgttgaatttgtgcggagggttaattgaagtgaaaaagtaagacaggagagttggttataagaaggtgagaactgtagtacaggtgataatggaaaaagaagaggagtaggagagagtgagcaacataatgggatagagtctctagggataagaagagaaagtctgccttaagaaggtcaaaggcagtatggccattttcacgatattgattcttcctacccatgagcatggaatgttcttccatttgtttgtatcctcttttatttcctcgagcagtggtttgtagttctccttgaagaggtccttcacatcccttgtaagttggattcctaggtattttattccctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggactgatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaagaaggtcaaaggcagacattacttatagggattcttcaaaatggacacaagaaggaagccagaactaattatctttatttggaaggcaattcaccattcacctggcaaatcattcagaaatacatgcttttatgcagctttttagacatgagcattagctacttagaagaaaccactaacctgtttcctggtgaatatgcaaacaacacctctcctcctgattattgtagacagctctagagtccctggttggagacttttcacacattaggggtaatctcttaacccattggcatttgaatatgatggcaagaaggatttattccttgaaaatacttcaaagatttgctgctagattactattcagcaatagtagcaaagcaatctggatataaagcttggggtaaaactaccaagtaggatttgggatcagtctttggtgaatatgttcaaacgcatggctttagcaaatgcttttaattccactttgcaaagtttaattgtagtgccttgttgcaggtgtcatttagattacatagcttgttagaaaaactttcctctggtgtggaaaatggcagctatttacacacagaggaagcaatttcacattcaggctggaaaacacactttttgtggtcctggctcttagtttatttatccttctactgttaatgctgagattttgcaggggagggtgagtttagaaaaaaacagtggaacatagcaatatggtggagagttggtgaaataaatagtagcggggattttgactgaataaagataatataacagatgtaatctctaagccagcaactccataataatcataaaaagggctcccagagagcttttatctattgagagctcactgtgcaacatacattgcgtttagagattttcattcattttctcatttagtcctcacaaccaacatatgagggtggtgttggggctcagaaaacaatacttcaaaatgaaggactcataagcaagtttgtctttgaccttttcctgccctcctgtctctcagtcccattctccccaccctccccggaggctagccatagaaactggaatccctcttccccaaagcaggtcatagaaaccagaacccctttcctgcaaagccagccataaaacctaaaaatattactctaactttctctccacttctctgtgtgaaaactggccacaaagaagttatttgacctaccttgtttaactataggtcataaggtccccattccagagagggtcctggaaggaatgtgtgctcagagaagcccagaagaatctagacagacaggccttgctggttttccccactcagctcattagcattagatcatagtctttttatcaaatcatatgcctacatggctgtccattctttgctgaacctaagcataaaaatgggcaattttccctgtatctttgggtcttcattctgaaggctcctgtgtatacagtgtatacatgttagataaatgtatatgcttttctccaattattctgcttttgtgagttgatttttcagcaaatcttcagagggccaaggggaattttctgcctgggcccctatggtggttactattattgtcccaatttatagagaaataaactaaaacttaggtgaaatgatgtacccaaagtcacatactcaggaaatggcagaacacagatataaacctaggtctttccaattctcagatgtagctttttaatcaccaccaggcaaaaaactgcatgatttcactcaccaaatgtgtattgcatacctagagaacataaaccaaaatattggacacgatgtctatcattccactataatatcctttttggacattcacaatttggtcttcaataattccctattagaatttagatatccataaaaaaagcacacttggcattttgaacttagtccttagctcttagcactttagttaagatcgttaggagtagggccaataattgaatctgcatgtggtatggtgccaggaaaaaagcaaggaaaagtgaggctccagaaaaattaagaatgcatgaaacatggtaaattgttactgaattttgtgttttgatgccatatggccctactagtatgataatttatattgagaatattccaatgatgttcattgcagttatgactatgatttcaagctagtggaagtgaagcaatggatgaatgtctagttaaacaatgttggctcagttggtaaagatcaatcaacacataaatcagtgcctactgtgtacagtaagaagttcaggatccaagtttgtaatgttgttctgaaagcagacaggtagggacagaagtgtgttctcctttggaacctgtgaaaagagagttattcactagaatagtgcttctcaaattgtattttgtggaaccctgattctaagaaatgttaagagagagatttccaagagagaaagaagaggaaaggagaggagaggaagaaaggagaggaagagagaagagtggggaagggagaagagagtttctgtagttatttgtgtatctgccaggtcaaagttaaacagtcatcttttttgcagggtatctcagggcaccttagtgcccataatatctaatgtgtactctaattttctaaaagggggttggagcccaggtgtggtggctcatgccagtaatcctagaactttgagaggctgaggtgggtggattgcttgaggtcaggagttcaagactagcctgaccaacatgatgaaaccccatctctactaaaaatacaaaaattagctggctgtggtggtgtgcacctgtagtcccagctacttgggaggcagaggcaagagaaaaacttgaactcgggaggtggaggttacagggaactgagatcaggccactgcactctagcctgggttacagagtgagactccatctcaaaaaaaaaaagcggtgggggaatgggatatatttttaggacatttcctaaacttgtatgaacacataatattcccagcccccaaagcatctgaggatgttaagtttccacagaacaaactttaggaaagctaagtgaataattgagtgagtatctggctctattggcctcctgctaatgcctataacatcaacagttgaaataaaatacttatttggcatttaggttatgattagtatcacttattttttccattgtttattttttcaaccatcctgtaagctccttaagggaatggatttgttgactaattaatatctacatctataagtgctgagtatatgataggtattcaaaaattatttgtagcttgctttggctgagtgcttatttgattggtaagtgttttgattgggtacaaataagacaactttgtgtttgtagagcatcttataatttcaaagcactttcacttctgggatctcattctgttacaagaactttatggaattgtcagcaaatgtagtattattattattaatcttggctgagagagtttaaaacaatgaccctaggatataagctggtgaattgcacagctaggactagaatccccatcttataagtcctagttacacttttcctactctgccccactgttactctgtttgctgtcccttaatcctgggtactaggccagaagaagagatgcaactcaaggaggattccaaagttggtgactccagagctcaggcctaagaatctctgaaataaccttttatttaaaatgttggtataccaatccattgttttgtcttttggaataactatttctgattctaaaaggaaaacgatttactactgatgtctgaaaccaaatcagcagaggtagccgctaacaatactcaaatgcggccaggcacggtggctcacgcctgtaatcccaccactttgggagaccgggatgggcggatcacctgaggttgggagtttgagaccagcctgaccaacatggagaaaccccatctctactaagaaaaatataaaattagccaggcgtggtggcgaatgcctgtggtcccagctacttgggaggctgaggcaggagaattgcttgaacctgggagttggaggttgtggtgagccgagattgtgccattgcactccagcctgggcaacaagagagtaactccaactcaaacaaaacaaaacaaaaataatactcaaatgcttccagcagccaggcaggtcatgtccacagtgtgaggtggaccaggtgtgtgaagcaacaactgaaggaaaaattggagagtactagctgtactgactcaaccctagctgattgctgccatgtgagattgagaatccaatattactaggccctctgatttataagagacacctgaagtctggatttttgtgtggaaatccgtaaattgtaaagcactctgtagaccaaataaaacagcctgtatgctaaattcaacatggggactgcatgtttgtggcttttgcctttgaagatttggttcagtaggacttttattaaacaagcgactgactgtgtgactgactcagactctgttccactatttccatctctagcagtgagtggaaaaaaatttaaagaaagaaaacctgaagtggcctggagagcagttaaaagacaaactgggaacagcattcagaagccatcctaatcacaccatccagtagactagtcgatccaacaagagtgaaaggggcacaatttatggatgtaatactatgggacgggtattgacaaatggatcaccttagaaaagtgagtgatttagatgatgaagcaagttggtgtccagtattacagataaaggaagagccctggggatgaagcacccgccttaaagctgccctgaagcggtgtgatgtgaagcactgaagggaacaaatcattggcatatgttctctctcctccatgttcactatgagcaggcagttaacatgatctgaatgtacgtgtcctgattatcacatgaacatgtacctcatttgtaccttttgtgtgacctaataaggaacaaccacagcagtcaatagttcttggatgcattaagggaacattcacatgactgactgtgcatttcataattgactgttcttttgcacagtgcagaaatctcatgaccagcttgcagcagtttctttgtctttcctcctaggctttattctccttttctggatgaccctggcctttcctagcctacccagcccaccctggatgacatctttgtctcttatctgcctcttttaaatgtttcaatgacctgttttctctgcagctcatctcctcagatccttgctttctcctggggttaatctaatgtctcaatgagctaaaaaattcatgactgataaagaccaaaaatgcttctcttctcagctaacatatttgcaatttaatagatatttcaattctgtaactcataggcataactaatggtgggaatttctggggactttgcagggcctgtggggggcatttcccagagtgtcacaatctaccctgcaggtggctgcttgttccttctagaaacaaggtcaacaatattcatgaccttggggaactagaagaaaaaaaatcctactgaggatcactgaaaaaaaaagggccttggatgtcagtccatagagtgacttttttccttcttctgcatttttattttgtctctcctttctttcccttatttccttcattctgcctcaacctatgacacagggctatctattaaccctattgatgacaaccatggagagattgccagtctttgtcccaggaaagtttttgtatcatgtttctatgccctacagggagatgaacaaatactattaactttcccataagaagaaagacagtcttatttttctgtagagtcaggggctgtgagagcattcattcctgtgggcttattttgcaagcaactgtgcaggagaccagtttggatagctggggttgaacaagttagagcacatgacagcagtatatggcaaacgtgtgcaatccaggccagttctactccaatggctctcgtccatcacctaaggtgaccattgactccttggctgccttctctgacaccaagttagtgctgggggaagggattcttaggaaggggttacactgtgactcctagctatgtagtttcctgagatccatgggagcagattttcctaggtccattatgtatattcttgggagtctcagttaccttgttctctcccagcctgaaagcagtggtttgagcaagctgagaatattctatcaaggcacccttccataggaatgaaaactaggagcttggtacagagggagaccagccatgaactagatccaatagagtagagcagatgctcagagaactatcatttattaggtcaaggattatactttataatcagtcaaagcttctcacaacctcaaaaggctggtgattatttcctatattttataagggaagaaatgaacagtcagagaagctaagttacttgttatgatcacacaccatagtaagtgatggagctaggatttgaatccacgtttatttcaaaacattactcttaaagcaccctgttacaaattacctgaatgggtcctgctcaatacatgtcactagttctattccttcctgcttgcctgcctgcttcatgctttttccactcctctttgctactacatgttttacatttccgtaatttcctcgtgaagccatcacagactaacctcatcttataatcgcctattttttctcctgaattccctcaataattttgcaaaagttttcaccacattgcctgatactaatttatagtaataatttatgagagatcttctttgtgtagatcttgtagcaccaattacattagggctcttcaagatctgctgctccctatacaaagctttgccttactatttagatacaacataaaattatggaactaggagctaggctctgtgtttcataaatatcatctcatttgatcagctcagaatcctgtaaggtatgtcattttagccctgctttatagatgtggaaattgaaatttggggaatttaagtaatttttttctcaatgttctacagcaactaaatgataatggtggaataaagcctcaggtggttgtttttccaaagcctgagcccctcccactagtaaatgcttataaaattatctgctgcacacattactatgatatggtttgactggaacaatttttttattattttttgtttgtttgttttgttttgtttgagatggagtgtcgctctgtcaccaggctggagtgcagtggtgcgatctcggctcactgcaacctccgcctcctgggttcaaaaaactctcctgcctcagcctcccgagtagctgggactacaggcgtgcaccaccatgcccagctaatttttgtatttttagtaaagatggggtttcaccatgttgaccaggatggtctcgatctcttgacctcctgatcctcccgccttggcctcccaaagtgctgggattacaggcgtgagccaccacgcctggcccatcttagttatttcttgtcttttgccatgctcatggataggaagaatcaatatcatgaaaatggccatactgcccgaagtaatttatagattcaaggctattcccatcaagctaccactgactttcttcaaggaattggaaaaaaactaatttaaacttcatgtggaaccaaaaaagagcctgcatagccaagacaatcctgggtgagaagaacaaagctggaggcatcatgctacctgacttcaaactctactacaaggctacagtaacaaaaacagcatggtactggtgccaaaacagatatatagaccaatggaacagaacggtggcctcagaaataacaccacacatctacaatcatctgatcattgacaaacctgatgcaaacaagcaatggggaaaagattccctatttaataaatggtgttgggaaaactgcctagccacatgcagaaaactgaaactggactccttccttacaccttatacaaaaatcaactcaagatggatcaaagacttaaatgtaagacctaggaccataaaagtcctagaagcaaacatgggcaataccattcaggacatagacatgggcaaagacttcatgtctaaaacaccaaaagcaattgcaacaaaagccaaaatagacaaatggaatctaattaaactaaagagcttctgcacagcaaaagaagctatcatcagagtgaacaggcaacctacggaatgggagaaaatttttgcaatctatccatctgacaaagggctaatatccagaatctacaaataacttaaacaaatttacaagaaaaaaaaaacgcatcaaaaagttggcaaaggatatgaacagacacttctcaaaagaagacacttatgcagccaacagacatatgaagaaatgttcatcgtcactggtcattagagaaatgcaaatcaaaaccacaatgagataccatctcacaccagttagaatggtgatcattaaaaagtcaggaaacaacagatgctggagaggatgcagagaaataggaatgcttttacactcttggtgggagtgtaaattagttcaaccattgtggaagacagtgtggtgattctgcaaggatctagaactagaaataccatttgacccagccatcccattactgggtatatacccaaaggattataaatcattctactataaaggcacatgcgcccatgtttattgcagcactcttcacaatagcaaatacttggaactaacccaaatgtccagcaatgatagactggataaagaaaatgtggcacatgtacaccatggaatactgtgcagccataaaaaaggatgagttcatgtcctttgcagggacatggatgaagctggaaaccatcattctcagcaaattatcacaagaatagaaaaccaaacaccgcatgttctcactcataagtgggagttgaacaatgagaacacatggacatagggaggggaacatcacacaccggggacttttggggagtaggggtctaggggagggatagcattaggagaaatacctaatgtaggtaacgggttgatgggtgtggcaaaccaccatgccaggtgtatacctatgtaacaaaactgcccgttctgcacatgtaccccagaacttaaagtataatcataaaaaaatacttagtatgatgattgagaaatagtaggtacttaatacatcatattaattgcagtcatgcatgcataatgatatttttgtcaatgatggactgtatataaaacggtggtcccataagattataatactgtatttttactgtaccttttctatgtttagttatatttagatacacaaatccttaccattgtgttacaattgtctgtagtattcagtacactaacatgctgtacaggtttgtagcctaggagcaataggctatatcatatagcctaagtgtgtaggaggctataccatctaggtttggtaaggacaatctatgatacttataccatgatgaaatcacctaatgacacatttctcaaaatgtattcccattgttaagcaattcatgactatattataattagtattattatcatcatcattattattacaggaaagttttcaaaggtgagttcatggccatttcatgacaagaaagcagtctgacaaatggtctaagacaaattgctgttgttaatagggtgcttcatttacagagcttgaatggaaaaaaaatagaaagttaactagggggctattaaaaagcaaagagccatataaataggtattaatatttcaggcagaaatattttattcaaggagatgcaatcatgtggaataatttgtcaattaaggtggtcagggcaagtattgttgtctgtataaatgagtttttgcagccagcaagaattttaagggatgtatgagccaagagcaaaagctgctaagacaaagctgaggtggaaatgagtccggaggacaagcatgttgaggaaactggacttttcctgtctagcatttccttatgtcattatgattaatccctggtggtttataaaggcagttaaatggcctcctttggcatcaaataggaaaataattcatcagttcaagtctgtaaatcatttcttggtactggaagtactttatatagttagaaatgtctccatgatttgtcactgggctccagtggggatcctgaagagcaactggcaaccaccagatgcagaggcctatgtgatgagtctcatgggcatgggtctgcagggaaagaagattggttcctttctggggtacattgccttgatcctctctgactggcctggaggaataaccacttctgtgtctgtcatatagtagtcacttagtatgtttgttgaatgaatgaatttacatattttgtgtgttttgagtcctttgcattggagctcatcttacagtgtctgataactctctctagctatattctgggaaaatgagatagaagggcagtaataatgatgttttgaagctactgggtcagtaccctagttatttgcttaatgttgatggtcaagacatcatagtctcaccataaactgtagcataatagttgaatgaaaaataattgtgctgtaattttttatgataaaaggcattttaaatcacagtttaattacccaatcccccttgctcttaaaatcaacattttttgattttgttatccttacattttgtgctagtaaaattatcttcatgatgctatttaatttacctcctggcgagcatatgaggtgaaaggtaaaaaggacattttgggacaagtgaaaaaatatctaatgaagtggaaaccgttattcaccctcactccacatgtaatacatttgatattcttttaacattcatcaaatactcattgttctgggtaaatagataaactaaaaaaggtatgatgtctgtcctgagtgagcttgaagtataatgagaggggggagaatagacagagattaagtgaataaacatatggatacatgtataattatatattgcaatatatcattataaggaaaataacaaagactaattgagattggggatggcctacttgaacaaaataaagttgaggctggaccctgatggttaagaaaaagccatctagatgaagagcgggtgaaaaatattttagagggaacagcatgtgtcagctataaaagaaagatgatggtggcttgggtcagaagggtagtaatagaggtagtaaaaagtagacagatttaagagatattatagagatagaatgactatacttcctcatgatgattcctgggtttttggttttactaatagggtagacagtagtgctatttcctgaaatgaggaagactgagggaggtcagattttgtgaggggttacaaaagttctgttttggccatgttttagaaatacttattatatactctagaggggatgtagagtagacagttaaatatatgaatctggcattcagggaaaagtttgaactagatatataaaatttggagctgtctgtatggtatataggatgagctgcaataaagtactaaattgtgtggggcaattgatgattactataggagatcaatgcaaactgcagctcctaggccctatgttacatattttctccagaattgtgaacagtataagaaagctacttgtcatgattttttgaaacctcatcaaattgttaaatattaagcatgataattgtacctatattttttctgctatatggggatgatatcttgtatttagctgacatttgaatccttcagagctagaagaatataactaatgccacactaaatacagtcactatttatgatatgtgctgggtgccatattaatcattttacacacattattgctaatctttaccacagtactgaatagtacaggccccaatttatagataaaggaactcaaacttgagaagttacacaacttgcccaaggcaacaaagcaagttttggggggtcttttccccattccatttccacacattaggaaaagtgactctacatttccttttggattcttccaatttccaaagtctcttacaacccaaggaacagaaagaaatattgagatatgcacatttgctgctagatttccttgctattgaataaaagcctgtctgtaagtgtctggtgcacatgcacagcctgctgttgggatacccatcacttgttaactgcctgcctggactagcaactgtcttcaaaccctctgtataccatactgaattcttagttggaggtctgccaccaacaggagggcaactccctgtgtgtggtacaatgaagggagaataaagcctggtacatagttggctctcaataaatgatagctaatattattataattttctttatcttatgcaatgacgacttctcaaagtccctatgaaatatgtattattatcttactggtgaggaaatcaagactcagcaaggttaagtaacttgcccgggtcacacagctaatgaggaactgagttgggatttgaaggccactctctgattctgaaacttaagattcatgcatttctcaagtttaatgactgagtgaagccaggggtgtcattggagaatatcaagagataacgttagatagagaaagtaggtctaattactggagggccttgaatgtcaggaagaataattcatatacttagcctatttgggtatatgtgccacaaaagagctatgatttttcctcactgataaagaagttcgagtttttggacatcaggtacctgtttccaagctgaatgccctaacagctgtgagtaacacctgctccttgcacctgtgcaaactcagagacttaccttctctggtgctgattcgcataacattctttctcctattttctcattttaactcaactcaatgaagatcttctgagtatcttttctctgccaaggcactatgctagttgctgcttcactggttgttgggagcatgcagttaaatgtaatcacaccaactggcctgtataggtttgtgaggtggaaaagtctaggaagaaagatacttgagaaatagccaatgtctttttttggagcccctgcaagagaaagcataagtttatcctgtcctattaaccaaataatctctaatgattggagatgtctttttaaattaattaattaatttctacttgctgggaattctagctacacagacttttgatttagccagtaatattttcaaactataagtagcttaaaatgtggattagaactagaagggactttgaatagcatacagtctgattcccctcattctgtagatgaggtagcagaagcctggagagattaatttatgtgcccccaaagacacagcttggcagtaactaagttgatactttctccaatacaatggtgctttctgccactttctaatactccacagtgtctttctgacttagtcctgagccttgcctaggaggcttttttatgccaaatttaatcaatgttccattttaattgaaatatttaagtcagattaatgtaaagccttcagagagttctgctaatctggtttataaaagtcactcaggcaaaactgtgaaagtatataggatttctgacattttccagaagccattagcttatgttcttcaataactcttagaatatatgtcaaaggaggacaattttccaactaaccttggcacactccatatgtattcctttttggttggttcataaatcagttttctaattcaaagatgttttaatcctcaaaacatgcactcttccttaatgattgtatgcattacaatattaccccacaaactagtttatgaatattaaagtttattagtagggagataccaggaagcagaactgagaaaataactccagcagtctcccttgcttgaaaggaaatacgatggaatgaaaagggcacaggctttaaagtcagaaagacatggtttcaaattcttttcttaccatttaccccctggatgaccttggggagattattgaacccctttgagcctctacttcctcatctgtttgtatatctttgcttacagagctgttgggagaatttgagatgacagagtagatgatagctatttccactttgctattgtcattatgactgttatttactgttcctactactagtactattagaactactgctactactaccaccattaatctgctttgcagcctcaaaaaaaaaaaaacgaagatgctttatactactactatcaccattaatctactttgtatcctgcaaaaaaaatgagaatcagctgaagagcagaaaaaacttaagacagagtaagacaacgatagaacaaaacagccttttttttttttaaaaaaacaacttctattaacacattgccagccagaaagttcaaacaacctactgaataaagatagtaccttagtcaagttatggaaaatatatttttacaaatgaaattgttaagataataaccctttcattaaaccactctgtatattccatcaggacaggaatcatatctattttgcccttttgtattcctatcactttagtaaggtcttgacatagagttggagatgaaagaatatttgttgaatgaacaaataaaatccctaaaggtaaaaataagtattattcagctgctattgtttcttcattagtgtattcattaacctattgaaaaatatctgtgctcctattatatgataagcgttgtgctaagccctgggaatgaagtggtaaagaaaatcacgcacagttcttgtctttaagagcttaaaatctagtggagaaaacagcccttaaaccatcacacaaataagtatgaagttttaattgtgaaattgctatggcggaaagaaatgcatggactaaaataacatgtgttaggggaatttgacctaatcagtgagatcaggaaaggcttcttggaggaagtaaatcttaagcagagatataaagagtaagtgagcattaactaggaaagacagggaaggagaggcttttgggacaaaagggtcagcatgtgcaagcgtgccctgtagagggatcatggtgaataccaggagctaaaataaggccaactacagctggctggagtgaagtgaggaagcaagaaactagaataagcttaggctagaggggtaggtaagggacagacagtgcagagcctttgccacattcaagattttctcttcatcttaacagtaagaggaagacataaaagtgattttaaggaagggtgtgggtgtgacatcatcaaatagtttcagtgtggagaatgaattgaagagaagcctgaatagttatgcttgcactagtccaggctagaggtgatagtaacttggactagggtggaagttgtgactatagagaaaagtagatgcattttagggctagttagaaggtaaaatcaacaagacttggtgatggcttagatgtggagtatcagataaatagatgagtgtctcttaagtgatgattaggtttcttgcttgtctaattggaaggattgtggtaccttttagtgacaggtccgggtatgacaaggttcattcaatcacaaatctttatatgtgctactatgtatcaggcaccatgttaggtgttagaaattcaggaatttctaaattatggttcttatctacaagaagcccacagtctagtagggaagggagtacagaaaatcaacaagtagttacagtgcaacaatgagctagcttgatagaggaatgccaagagtgctatggaagcccagaggaggagaatcacctagcaaatgggcagagttgcagaactgtggggaaagccaaaaaagtggagttgggttattttggacttggtatgcaataatttgtcagacctgttcactagacattaaattttgaaagagaaagagtccttttttttccttcctcatctcctgcttagtgtaataagcaacctggttgtatattccatggctgagagtggagacaattcctgatgtcactggctgatttcaaaatctttgcagaactattcatatgttcctcttcctttacaagatataataggcttcagaaaagtggtgtgtaaatcatattggggtaaattaaatcctactttaaatgaactgagtcatttgctatctacttttgaaaaaaaaaaacagcattctctaattttttcacatatatttccatttaattcttcaagtttctttaaggcaataagggatccagtttcagctttctgcatatggctagccagttttctttaaggcagtgcccatttttttattgttttatttatataacttctaaatatattttacacatactttattttaaatcaactttattgaggtataatttacattcaataaaaatgtacccattaatgagttttgatgtataatatgtaccctaaaaatatgtgtagccctaaaaagttgcagtaaatctccttcaccccagtcccaggcaaccacctatctgctttttgacattaaatttgtcttggtggggctcacatttaatggcctccagtgaatattgtcgtgagcacatattaggggaaagccactttcttttatttcaattagaattcttatatcccaaccttaatgctataaagaaaatactgatcttatcatgcttgttttagtatgctttttggggttgttttggtggtggtttcacagagagaattcttgaaaagataatctgtgggggctacaaaattatgggccttgatttacaggcagtcagtcatttcctcactaactacgttaccattatgtattgatactctcttttttttgttaaaactgtcaatttttttaactttcgtaagtcagtgatagtatataggaatgggctcaggatttgccatgtagaccagagttcagactttaaggaacaaccaggaggctggagtggttggggcagagagagtagtggagagaaaattaggagatgaggtcagaaagatggtgatggtgggggatcagatcatgtagggctatgcaggccattgtaaagagtttggctttcactcttagatggaaagccattgaagggttttgaacagaggcttggcatggccaggtttattttacaaggagaactctggatattggatagaacatagactgaagggggcaaggactggagcagggagagcaatcaggaggctattgctatagtccagagggaagatgattatggcttaaaccagggtttagcagtgaaaggaattaaaagttgtagagttccagttatattttgaagatagaaccaacaagttttctgatatattgaacatggggtactagaataagtaataagtcacaggcaaatccagattttttggcctgtataactagaagtgtagagttgttgattaatgagatggggaagatggaatcaggagtttggttttggacatttgagatgcctcttagacatctaagtagaaatgttggatgggcagttggatatgtgagttcaagggagaagtctaccatggagaaataaatatgggagcgaacagcatgtaagttgtaagcaaatctatgatatcactgaagaatgtagatagaataggttcaagctctgagctgtgggtacatgccagcattagaggctggggagataagagagaaacagtaaggaagattgaggaggagtattcaatcaggcaaaggggaaaactaataggaagtaagtaaagatagtgctctcaagaggatgggagtgaaggactgtgttgaagctgttgattggtcatgttatttagaaacgtggtagttgctaattgacaggatcttgatctgacaggatccaatctgggttcctttcattatactgcattccttgttcaggttcttgtccttaagagtatctcttcactcctttacatagaatttactaacagcctgttgtgtgccaggcattgtcctagacactaaaacccaaagataaataagatatggtctctgcctttaggggatccatggtctagtagagagatgagatgcattaacaatgataatacagcatgtatagtgctatagtagagacacatacaaaatattatgggaacccagaactcatcttgggtgtaggtaggaggtggtgggagaaggcttttcaaaggagatgactggacagggatttcagtaatgagtaaaggtccactaaacaaaagtgcaacttatccagaaatactcacagagctgaaacatctgaacattatcttgaaaggtggattgtaatttatcaagtggacaagttgaagaaggactagagagaaagtcaagggccagataataattcagggtcttctgtattggaggagttgatggtgacaaattgggaagggggaagagaaaagaaggagtgaagcaaataacttctttattttctgcttggatgattgtgttggtagttatgctaaagtctcctaggttatcaaagttacagtattgagtctttcagaaggagtacaggtctcttcctcaaatttgttttgagttgagtgtcctgacactagacaggtgattactaaataactaggtgcctcacttacacttgatggagatagattttcttttaagtgaaccaagttcatggaatttcacttttctaataggaacatttctcttttgctaaggcaaaaatgggtcaagtgctgagacacatggctctgaagggccatcaaatgagatccacagctgggcccttagcccctcataaaggccatttctgcctatttaaagcctcctctaggcttgatcaaaatcaaaaccatttcaaaatgtaataaattattacattttgtgctgaattgctacttctcaaaatctcttacatagaacaggatgtttgagaattgagtttgttggaagttttgtaaaacattttgtgctttgtaaaacagaaatgaaaatattacaggacagatatattagagatatatctttttaatgacaaaagtcttttgtactgtctttaaatacttgtttactgttaatcaactatttgagagaaagggaggggaagcaaaagtgaaatttcagtgtgaaatttgtgtttcacaatttgtctcagaaactaaattgtaatgttttttaagcaatcataatggatttgtggcatttatgaaatgatcacaaaagtcatcaggaatatgataaccaattctcaaagtttgttattttgttcagagttaagtttttttgttttgttaagaattattgatgaagtcacttagctttattaaggaagtgaaaagaaaatttatgtcagtctttatttgtttttgaatatgtaatacccacacccagtagaagatccaaacaataaaaatatgtacattgaaaaaatctcctttctgcctccaactccttacctagatataatcatttttttcagtttcatggatatccttccataaatattctgttggatgtaatagtgattctaaaagtgtagcccaaggactcctagggcctcaaagaccttttcatgggttctacaagttcaaagctattttcctaataatacagttgaccctcaaaaaacacaattttgaactgcacaggtccaggtacatatggatttttttcaaccaaacatgaatagaaaatacagtattagtggaatatgaaactcacttatatggagcaccaacttttctaataagctggttcctcagggctaactgtgggacttgaatatgtgtggattttggcatatgcagggcgagataggggacagtcctggaatgaattccctgcatatactgagggacaactgtactaatgaaattaataatgatattaatatatatgatgttttgatattgaggtatcataaaatgtatcaacatttagaacatccatataactcaatgaagtagtattttccagataaccaatgtatgttgttatgaaattatgcatgtataaaagatccattcaaagagcaatatgggtcagtggattttaatgtagcaaggtatacaaagttaattgatatgatttcacacttggtcttagccaaaaggccaagatgcaataattgatatgatttcagattccacacttcagctaatccttaagaaactgccacttgttgtgtttggtatagtatcgaagaagatcatccacacttttttgaaaaggctgttaaaatacttccttattttccgactacttatctttgtgggactagattttcttcatatatttcaaataaaatgatatatcacaacaggttgaatgtagaatcagatatgataatttagttgtcttctgataagccaggcattaaacagattttcaaaaatataaaaacaataacactcttctcatggcctttttgcttttgcaaaatatagtttctgtgataaatatgttatgtaataaaatcatataattataattcattattttaagtaaattattaaatattttaaatccctcagttttaatttttaatatagtaaatacataacctatataaacaaaagcttcttagtattctctttaatttttaagagtgaaagcagtcctggccgggtgcagtggctcacacctgtaatcccagcactttgggaggccaaggcaggcggatcacaaggtcaggagttcaagaccagcctggccaatatggtgaaactccatctctactaaaaatacaaaaattatccgggcattgtggcaggcgcctgtagtcccagctactcgggagactgaggcaggagaatcgcttgaacccaggaggcggaggttgcagttgcagtaagccaagatcatgccactgcactccagcctaggcgacagagcacgactctgtccaaaaaaaaaaaaaaaaaaagagtgaaagcagtcctgagaccaaaatgttggccaactgctgatatattttaaaaagtgtacatttggttattttctctatcattctatttgtgtttatgtgtctatatttatttttatacacataggcagtgttcgtgcaactgtcctgtgacttggtttttgggatttaatattgtttgagcatcatttcatatcagtaatgatagatatttcacttttatgtgactgcatagtatcccatggtatacacatacagaattcctgaaaggagaattgctggatcaaaggttatatgctttttaaatttgataagactgccaatttgtcctacaatttatgctcccaccagcagtgactgagaatacccgtttccccaaatctttgtcagcagttttccctcaaatcttttgctgcttcctgagcatatagggaaaaaattatatctcattataggtttatttggtttatcttattatgattggtgttaagcatgttttcatataattcaatatggttatgttttacttttttgtaaaccatatgttttcacttctttaaagagaaccctcgcaccttggtacagataatctttcaatttctaaatataattctgaaaaaaaaataatgtgaaccttcaactttgaatggaatgaccttgagctaagtccctcaagctctaaggaccctttaagctgtgacattaagtctcaaaacaataacagatacatttgagctatacaagaagttagcttagcatgtttacaacatagtaattgaattgtttgtaatatgatttaactaaaagcagaaagttgagcaaaagcaatttgcaaacaatagatgataatgtaataagaaacatttatttctatatgtaaatgatgtgctgtttcctttacctgtcctttgtgaaaaacaatgaggaacgttatttctgtatctgtcaccatttcccacagttcagtggacaaagttcctcaagatcttccagtttccatttactagagctctgctttttttggagctgaggcaaggggaaatttccttatacttttatcaaaaaccttgaggttaataatcggagtgatttcagaaataagcctgttctgtaagagaatgggagtgtattagagttactatcatgcttaatataatgggacttcccattcaacatagatgtgaagattttataaaaatagccacagccacagaattgacatttgtgttttgagtcccttgttgcaatttagtcagcagagaaaaatacaacaaatgaaattttaagggtagaggaagagtcacagcaacacataagatggtcagggaagagcactgcctttcatggtctgtttgctgtggaacctcccataactaatttctgaaaagtaagccaaatgaaaaagtaaatggtttaacctttgtctctggttgacctgtttagctgactgtgtttgatgactgggaaaattttatttatttgaatacaatagtggagaagagtgaattgattaatcagtaaatcaatcagattttactaagtgcgtactatgtactcaaccctatgttagatgttgtataagatgtaatacctttttccagggaaagaacatgcagtggtaagtagttgttgagcacatttcaggcactattctaggtcctttacacatgttattgcatgtaatgttcacagtaaccttgtgaagaaggtgtagagtcagtactgttattcacacttaaggtcaaacaccctatagttctgtgtgtgggtgttgacatgattcagagtgaagccaagtaattagcagcagatacctcatggggtagatgggctagagtaggtatttttcgattggtgaagaaaaagaaaaattggtcaagacaaaggcaacaatatgagctcattatagaggaagggataagcagtatatgtttgtagaattaatctaacaagaacaagtgtgttaaggagttttggaaaatgagattggataggaagggtgaagctaagttatgaaggaccttgaaagccaggacatataatttgggcattttggactaggcagtacggaaccatgaaaggtttctgagcagaaaaggagtaacatatggaaaatgtttgtaggcagattactctggaagtggtaaatttggtggcagggtgactagacctgagattattgaaatagtttgatgtgaggtaggtgagtatctttttaaataaaagcatttaaaagaaacaggctactaaaagcatactttctctaggctttgaattatttgctttgggtcgaattgattagctcttggtagatgattagacaggtgtaaagtgaatcctgtgacctagacatcccaatcacttagactaaatctacggcaatatttttcaagccatgagttacatgacccattagtaggttataaatcagtgttgaaatttgcaaatagtgttttttaagtgaaatagaaaattgaatagagtagaaactttcaatgtgcctatagagtgataagaaaaagtgtgtttgtgaaaaattatttcagtcatttgtgttacatctgtgcatacatgcacattggctcatgatataaaatatatttattactatggcttgtggtaaaaaaaataagtctctgatctagagtatagcactgaattacttaatcctttttcctgccatgtaaattgtcaaagcttgcatgattgatttgaacattaagataaaaaccccaccacctagttcaggatgtctttacctttttcctggcccatttctaaccacccaaagtgatctgtttaccttcagtctttccataccaattcatcttatacccagctgccagatcagtctttctaagagtatttctcacatcatgtcattacctttgtccagaaaatacactggtcctcaatccatttatttaatattaatttagcaaatctcagttaagcacctaagaaatgaagtccacaatctttgtttagtcacatatgaaaattccttttaattcttacctcaaactgtatttccaactatgttagcaccacagagaccccatagatcagcttaattgtactacttactcttcctagaatatatgcatttttcactctactatacctttgttcatgctaatccccacttattgcccttgtcatcctttaaggccatgacttttataatcatctcagctggacataattagttcctcctctggacccacataatactttttgtcattcatgtgagactcatcacattctgtcttgcattatattagttgggtttattcccttttctagattataaactcttgagagtaagggtcacttcttgtttatgcctgcaatgttaacagtgctttgcaaaaggtagatggtcactatgcagctgccaaatcagtgaaaatgctgaattcatgacacagttctgtctttttctttcatttaagcagaatgacattatatagttcagcaaacaattttcccaatatttttcttagtatgactgacagcattagacagaatggaacagagcaaagagcactgggctaggaatcagaagacgttgacactagtcttggctctgtcaccaaaaaattctgtcacctttaatatgccatttgatctctctggttattttagcataaggcactcctcctttaaaaatacgggactgaaatgattaacttaaggttttttctaactctaaaaacattcatcttagattatttactgtgccagttgcattcactcagcagatacttattgagtccttactggggatatagcaatgatcaaaactaactatatgctttcatggacctgacattaaggtagtggagacaaataataaataaatgaaatgtaatatataatgtaaaatagtggtaagtgctaaaataaaaataaaacagggaaaagggatggagattggcaaggaaggtctctctgaagaggtgacatttgggcagagatctgtatgaggtgaaagatttggggagaagagcataccaggcagagggagctgctatgcaaaagccctgaggtcagaatgtgctttgcactttgggggaacaaataaaagtcagtgtgcttgagtcatagacagcaagaggttgagtaataaaagatgaggccagaaaagtagtaaaggactagatcatatgaaaccttttcaacggagtaaagagaatgttattctaagcacagtgaaaagccactggaagattttaagcggggtgttttagtccgttttcacactgctataaagatactaccaaggactgggtaatttataatgaaaagaggtttaattgactcagagttctgcatggctggggggtgcctcaggaaactacagtcatggcagggaggcgaaggggaggcaggcacctttcttcacaaagcagcaagagagcaagtgagagtggggagaagcgccagacacttatcaaacaaccagatctcatgagaactccttcactatcacaagaacagggtgggggaaactgccccaatgacccaattaccttccacctggttcctccctccacacctggggattataattccagatgagatttgggtaattacaattccaaatgagatttgggtagggacacagagccaaaccatatcatagggtagtgatatgatctacctactttgcatttaaaaatgatcgctctggctgttgtgtagagaatagatggcaagagtggaggccaggagactaattaggaagctgctaaaatattccctttaagagattatcattttctctatgtgtgtgtgtttctaaatagatttttgtcttttctttttaaaattttttaaaattttatttttaattgacaaaacttgtatgtatttttggtataaacatgtttatatatatgtgtgtgtatctacacacacacacatacattgtggaatgataaaatcaagccaattaacatatccatcacctcatatccttatcattttttgttatgagaacatttaaaatctattattttagcaattttcaagtatataatacattattactaactataaccaccatgctgtacgatagatctctggaacttagttctcttatctaactgaaactttgtaccctttaacgagcaaggagatgttgaatgattagactaaaatggtgacagtgaagatggagtgaagtgaatagattgggaatataatgtggagggagaatggacaagatttgttaatgaattgaatatggcagaggtgtaggaaaagcgggaattagagatgactcttatgtttgtcacctaatcaactgagggagatggtgataccatatactaagacggggagaatgaggaggaataagcttgagggttgaggctggagatttaaacaagagttcagtttgtgatataagtttaaaatgtctatttcagttttaaatgaagaaataaaagatatatatgaatatggagtttggagagaagtcaggagtggatatgcaatcttgagggcttttactatttaaatgacacttaaagccatgctactagatgagataacctcagaaatcattcaacattttcagactgggtaggaaaagagtcaacaaaagagaatgagaaagagtcgccaattaggtgaaagaaataccaggagtatgggtgtcactgaagccaaaagaagatactgttttgagttgaaggaagtgatcaactctagcaaatgctgctgagtttgaataagtggaagactaggaatagatcattgcatttggcaacatgtaggtcattgggcaccttgacacaagttaattttgatgtggtagaaaaaataggctaacagaagcaggttgtaaagagatggggaaaatgaggaaaaggggacaatgaatctataatgagaaatttttctgtgatggagaaatcgaggagttagctaaatgaagatatggggaatcaaataagcttttttgttgttataatacatataagatctctaaaaatatgttagatctgtttttaagctctactgaggtttaattgacatagaaaaaattgcatgtatttaatgtagacattttgatgagtttggacatatgcatgcttctactgtgatactgttcctataaccataatagttttattgcctgatgcacacagcaagtcagtacactgaaacatcaggttgtagcagagaaagaggtttcatcatagggtcactgaatggggaaatggaaaggaacctcaaattaatctccccaaggagtttggagctaggatttttaagtgtctcggagtgggctgaagtgtggagatcattgattggtcaaagagtacagggtgaagccatgggacagcaagatgaggaagctgtattctcatgctaatcttgttcctctgtgggggtcttcaaactggttgctggaatttgaggtttgaaaaacatcttaagccatcctcaaacaaaagccttaaaattctaatgtcagagatcctgtctataggaacaatggggatacaaatcaatttttaatttcctatgaccctaatgccagaaatcctacctataggaacaatggggtgcaaatggtcagttatctaatgctacatgacttttagcaacaaggaaatgagcaagagggcagcctgataaatgcttaactctaactatatttctgtttggaacgcggcatgcaattcttgtcaaccctgtaggaatgatttcagttctgctttgtcttgttaatcctctatcctgagctgtgatcaataaggagggaattgggtgatgacttctctggctgtgtcttgctgacaaggggcacagatagggaccataatcaggatttgaggaataaaactgctttgcagtggcctgtaaatggtcttgagtgccaagtctagagttttgactctgcatggcaaaaatgtcagttcttgttactagtccttgttgtctgtgggaaatagaaaagaaatacaacaataattataataaaaagaatttgtaaggaggcctgtattagggcattctcacattactataaagaaatacctgggggaaaaatacgtgagactagataatgtataaaaaaagttttaatttgctcatgattctgcaggctatacaggaagcataatgggttttgcttttgggaaggcctcaggaagcttccaatcatgtcagaaggcaaagtggagcaggtgtcttatatgacaggagcaggagcaagagagagggaggaggtgctacatatttctaaatagccagatcttgcaaaaactcactcactatcatgagaccagcacgaagaggatggtgctaaaccattcatgagaaattcaccccaatgatccaattacctcctaccaggccccaactccaacactggggattatatttcagtatgattttgggcagggacacagatctgaaccataaaagggaccaaaaccagtttcccattcccataagaagccagctaaaggatcattaagagggtttgtgacatacatctcttgccaaaatgccatatttgggggtataggtttctgagccccgacatcccctgtctgaaacttccctagaagtttcacacattaaaagctgagttggtggaaaaatttagtaagtagctgagtggcaaaggatcctagtaaaccagtctcccattcctggaataggccagttccattaaacagctgtatctcatttcaggagatggcattgcaggcaaactatagtttgtgtatcacaaagtatgcttgcagttactcaggaaaacagtagtagcaatttaattgagtataagtcagagaaatggaataaaaatttggtaatataagtttggagacatgcttagaaaagaattcaggattcaaactaaactgtagacaaataagaaaaactcaaaataatggacacagtatactaataaaaggtgtactgtagtttcttttgaaacataatttttctctcttcagtgcctcatttctaccaaataaaaatcagtaggaccaacttattggcaaaataagtttgagtcttattatatttggtttgattatttgcatagagtgcagcaagagtaattattggtgatgtaggctttttaaattatttttaatttttattttttgtaggtacatggtaggtatatacatttctgcagtatatgagatattttgacacaggcatgcaattcataataaccacatcatgggaaattgggtatccatcccttcaagcatttatcctttgtgttacaaacaatccagttatactatttttgttattttaaaatgtaaaattattgactacagtacccctgttgtgctgtcaatactaggtctgttaaccatccccatcttccccccgccctcccactatctttccaagactctagtaaccatccttctattctctatctccatgagttcagttgttttgaagtttagatcccaacaataaatgagaacatgccacattcgtctttctgtgcctggcttatttcacttaacatgatgacctcccgttccatccatgttgttgcaattgactagatctcattctttttttatggctgaatagtactccattgtgtatatgtaccacatttttaaaaatccattaatctgttgatggacacttggttgcttccaaatcttggctatcatgaatagcattgcagtaaacatcagagtgcagatatattttccataaacagatttcctttattttgggtagtgggattgctggatcatatggtagctctagatttgtcctttcaaggaacctctaaactgttctccgtagtggttgtactaatttacatttccaccaacagtggatgagggttctgttttctccacatccttgccagcatttgttattgcttgtcttttgaatataagccattttatctggggtgagatgatatctccttgtagttttgatctgcatttctctgatgatcagtgatgttgagtacctcttcatatgcttctttgccatttgtatgtcttcttttgagaaatgtctgttgagatcttttgcccattttaaaatcagattattaggtttttttctatagagttatttgtgttccttatatatcctggttattaatcccttgtcagatggatggtttgcaaatatcttctccgattctgtgggctagcttttcagtttgttgattatttcctttgctgtgcagacacttcttaacttaatgtgaacccatttgtccaaggcctgcagtgagtcttgcctggctaacactgctgattactcagggcccaaagactctttagtcagcaagtgatgaatcctgccaggacttggttcttcccttcaaggaagctgattctttcatggtgcacagtgtgtttagcaatgtcatctgtgtgctagggcatggaatgggggcctcaggactctgcctggtaccctgttctactgtgactgagctgatattcaagttgtaagacaaagtcatcttaatgtcccctctcttctgaagcagagggaagcagtccctcccagagctgcaagctatgctgtctgggtttggcagaggggtgacacaagcactcccttgggcgctctcactagattgtctcactaccttaagtaccttaagtccactggctgtaagctcagcacagaaccaggacttgcccaggaattgcagtccttgtggcctaaactggttttaaagtttattttgtaccccagagcactttagcccatggtgacagggcttgttgagacttagcttctgaccgctgggttggatgatttgcccctggctagggcttgtctaaatgccccttccatgggtactgagttctgccctatattgctttctgccgtgacagggcatcactgaattccaatgcaaagtccacaatcactgcactctcctccccaaaccacttgattctctctccatttgacatggttgctgccagggcatggaggagggttggtgattcaggactgtctttcataccctctttagtgccttttcccttaatatgatcttaaaaccaggtactgtaattgcgcccgcaaattaaaacctttcagaggagacaatgatttttactgtccattcaactggattccgcacaaaaagagaggccaggaggccaactgggaaggaattcttacccttttactggctttttgggttcctgaattccttcaactgcagcttccagaagagcagagttttgaccaccctgatcgctaattactaaggaaaaccattttcattattttcatgggttcataggtgaaagccactcaattttataagacacaagggatccaattaacattccccatatcagcagagacaaaattacaagatacacataacagagacacaaacacccgttattctactcagtttccaagttttagccaggcaaaacagacaaaacaccaaaatggttactcccagtcaggcctgctgatattctgctagtgattccttccagcttgcccacacacaaatggggcaagacaaaaacaaacacaaggcctcacaagtcaaaattctgaaaccagatttcagaactgtgaccagaagggtcctggcgtacttccctctaacagtgtgcctttcgttctccttccaattggggaaaatccccttaaacagggcccttcctataggttagggaaggtcaacaggatctccgaagaggtcacaagacctctgaagaggccaacagatcagaagaatggaaaggagatgtcagttgcacttggaagtactcaccagattcagaagacatctttcagattcagaaaccatttctctgctgcaagcaaatgtatgcaatgccctgccagcaagtgaggctccagggacagcccctggtttaaagaagccaggcatccacttgggctttcctctgggccacagaaatgggtgagggagcaccaagccacagccacataaccatgaggggtgtccctttgtggggttgccactaaatagcagccagaatatgttcattgcccaatgcacacagcaagtcaatacactgagacaccagattgcagcagagaaagagctttaattgtagggtcactgaatgaggagatgggagggaacctccaatccatctctccaaggagtttggagctaggattttttaagtgtccttggagtaagccaaagtgtggagatcattgattagctgaagagtgaagagtgaagtcatgggacagggaaatgaggaaattgcattctcatgttagtcctattactctgtggggatcttcaaactgctggaatttgaggtctgaaaaacatcttaagtaatagttaaacaaaagtcttaaaactcttgtgtcagattctgtctataggaacaatggggatacaaatcagttcctaaacagtcttatgaccctaatgtcagaaatcctacctatagaaacaagggcaatacaaatgatcagtgtccagtgctacatgacttttagcagcaatgaagtgggccagaaggcagcctggtaaatgcttaattataactatatttctgtccagaacgtgacatgcaattcttgtcaaccttatggggagggtttcattaccacatcaaggtactaaatatatccattacctacaaaaatgtacttgttttgctcaatggatattgtgttagtctgttgttacactgctataaagaaatacttgagactgagtaatctataaagtaaagcagtttaattggctcacggttctgctggctgtacaggaagcatgatggcttctggggaggcctcaggaaactttcgatcatggcagaaggggaagcagatatgtcttacatggccagagcaggaggaaagggggagggaaggtgctacacacttttaaatgaccagatctcatgaaaactttatcaggagaacagcagtagaaagatggtgttaaaccattagaagccacccccatgttccaatcacctccttccaggcccacctctagcattgagtattacatcttaacatgagatttcagtggggactcaaatccaaaccatatcaggtataaagtctgggttatgtgagatgaataagttctagagatctgcagtacaacacagtactcatagttaacagtacagtattgtgcactttgaaatatgctaagaggatagatctcatcttaggtgttcttcacacacatacacacacacacgcacggatctatttttcaatatactttatgccttaagcattgtcaatgacactttcatctttaaaatatcttttttcatttttcttttccttttttctctctatgtcccttcattcctcttcctccccactcctttctctgtctccccatctctctcttccttccctcccccaactttctctctttcgctctacagtagaaaagccaaaattcccatttgaaaagtttttgctatttttttcgaatgcttagcattccctcctgaaggggaattcttcccaaatatttgtgaaggcaccaaatttatgagaaaacacaaactgtaaactactcttgctggataataaggttgagcctttactatgtctaatattccacactggagggtaaataatttaatttataaaatttagaaatattttataagagcttaggatacaaaattaaatggtggacctgtaagggacatctgctcggggcagagaactattctttttcccctttctccccgtcattattgtatttatcaagaacgatgggaaaataatttttcaaaatccagggttttttaaaattttaaatatttttccatttatgtctaaggaattggatgatattccttattattatgcaggttcaattcttatacttcattttataactacttcattttgtgttgaaaggtttaaagcatgatacaagaaacacctaaataccattcatgaagattcacaaattttattgcagaggttcacaattttaaaaaatattttgccctatttgcttttttatttacctattttagatagataggtatagatagacatctaatttgtaacatatatattaataacatatactacataatgtgtatttttttcagaaaaatcttaaagttggagatatcatgcccctttcatcatatagacttcagtgtgtatttcccaagaaaaggagagtattctcatacaaagactccagtatagtttacaaaatctaaagatttaacagtgatatgttactttcaactaatctgaagtctttttaaatttgtgtaattttcttaatcatgtcttttatagatagtttttatctcagtaaaggataaaatttagtatcacacatttcttaggtaccatgtctctttagttttctttaatctggaatggtttttgagactgtgttccttgatattgaaatttttggaaagtatagatcaactattttatagaatgtccttcaatttgattgcctcatgtttcctcctaattagattcaggtcatacatctttgagagtaacacaatttaaacgaagattgtgttctaaaaagtgcatcttattaagaggcatatataaagtgggtttgtctgaacgttggtgtggttagattgggtgtggtggctcacacctgtaatcctagtgctttaggaggctgaagtgggaggatcatttgaggctagacattgtagaccaggctggacaactctattagttcattttcacgctgctataaagaaatttttgacactggttaacttataaaggaaagtagtttaattaactcacagttccgcatggctgggaacgcctcaggaaacttacaataatgtcagaagcggaagcaggcacatcttacacggtggcaggcgtgcgtgcacatgcaagagagagagggtgagcgcgagtgtgagtgtaagtgtgcagaaaaaaaactacaatttataaaaccatcagatctcatgagaattcattcactatcacaagaacagcatgggagaaactgtccccataatccaatcacttccctccctcaacacgtgaggattacaattgtcaatgagatttgggtcgggacacagaatcaaactgcattggcaacatagtgagaccacatctctcccaaaaaaaaaatttttttttaaattagctaggcatggttacacatgcctatagtcccaactacttgggaagctgaggagggaggattgcttgagtccaggagttcaaggctgcaatgagccacaactgcaccactgtactccagcctggatgatccaggatgaccctctctctaaatatgtgtatatatattttatattatatatattatatataatatatatattttatattatatatattatatataatatatatattttatattatatatattatatataatatatattttctattatatatattatatataatatatattttctattatatatattatatataatatatattttctattatatatattatatataatatatattttctattatatatattatatacagtacacatatataatatatatgatattgtttgattacttgatgaaggtagtatccaccagtgtactgtaactcttttttattcagtgagttacaatcctttataatgcttttcttgatgtgcaaattatctcagaattggccaggacgaatgctgtcaaactggctcctgtgcccttttaacatgcctctattccttgagcacttctttactttatgatgcaacaagctgttcaaagctcattttatgctttctctgctctgaacatgaaatcagccatttcctcatggaacttttgttcatttcaataaggaatagtttagaaactaggatctgggcactagatgtctgcattccaacaagcttcatcatggtgactaggtcttctcagtgaacagggtgaaatttatctgttgatatattaaaaaccatgagtttatactcatacctccagtttcaatccaccaccactgaaaacattctagtctttcccctttccctttccatattcataacatttttcctaaaataggaaaacatggctcccattattctcaatacatttactcatttgtttaagactaaaatatgcagaaacctgttttagaattgctaatccattcctccatgataaggtagcccaatgagtagaattcaatatgtgtttacagtttatttttattgaggtaaaatgtacatgccttgaaattgttaaatcttaagtatacgactcaatgaattttgtcaaataaatatacctatgtaacccacacccctgttaaaatttagaacatttcaatcactccagaaagttctcttgtgtcatttccaagtcaatccttctctcctttccagaggcacacattattctgaatttttccccacggattgtttttgcctattctagaagttaataaaatggaataatatactatgtttttgtttgtgtgtctgtgagatccattcatgttattgcatgtgtcattctcctttattactaaagatccgtcgtcctgttgatgaacatttagattgtttctaattttggataattatgagtaaagctgctataaacactcttgcacaagtctttttatgaaaatatattttcctttctcttgaataaataccaagacattgaattgttgggacaaaaagtaggtgcatgtgtaacttaaactgtcaaatattttgccaaaggttcttgtattattttatatcccaccagcaatgtatgagagttccagtcactctatatcattcccacattgggtgttcttagtctttcccatccatctattttacattctagtgggggaaagagggtatctcattctgttttaatttaattaaattaattaattaattaattaatttttgagatggagttttgcccttgtcgcccaggctggagtgcagtggcacaatctctgctcactgcaacctccgcctctcgggttcaagtgattctcttgcctcagcctcccaagtagctaggatcataagtatgcaccaccacgcctggttaatttttttgtatttctagtagagatggggtttcaccatgttggccaggctggtctcaaactcctgacctcaagtaatctgcctgccttggcctcccaaagtgctaggattacaggcatgagccatcgtgcctggccacattatgtttttaatttatatttccctgataactagtaatattaaatgttttatgcttactggttattcatagatcttcttttgtgaatatcttttaaaattttctggttttggctgggcgtggtggctcacgtctgtaattccagcactttgggaggccaaggtgggcagattacctgaggtcaggagtttgagaccagcctggccaacatggtgaaaccccatctctactaaaaatacaaaaattagttgggcgtggtggcacacgcctgtaatcccagctactcgggaggctgaggcaggagaattgcttgagcctgggaggtggatgtttcagtgagctgagatcctgccactgcactccagcctggccaacagggcgagactctgtctcaaaaaaaaaaaaaatctgtttttaaaattttgggggtttgtatattattggattgcaagaaatctaaaaaatatacattctaggtaaaagtctatatctaggtcagaaatattatgcaaatattttctgttttcaagtatacatatgtgtatgtgtgcatatttatatataaaggccttttgcatctctattaatgagccatatgatttgtagttttctgctagtatctttaactagtttgagtatcatgattatgatggttttacaagacaagttaggaagtgatccctccaactcttttatctgaaacattgctattacttcttaagacatttgatgaaactcacagtgaaaccatctgggcctggatatacttttttatgagcaggtttttggagaggaattgaattttttttatagatttagggctagtcagagtttctatttcatattgttgcagtttcagtgactattttttaaatcatttattttatctaagttttcaaactggcacaaagttgtttataatattgccttaatattcttattatatctataggatttatagtgctatcctgtctttctttctggtattggtaatttgtgtttttacatctttcttttttgagataagtcttgctacagcattatcaattttaatgatcttttcggatagtcaactgctggactgaattgatttttcctagtgtttgcctacctgcaattttatttatgtatgctcttgtctttattacttccttttttctgcctactttgggtttaatttacttgtcttttaaaatcttcttaaggttagaaacttatataatctattttaaacattttttagcataaacatttgtattatacaattttttccaactcccttagccacatcccacaaatttttatgtgctgtattttcatcattatttagttgaaataattttccagttaccattacgatttattatttggtatatggtatatttagaaatgtgttaatttccatatgttagtgctttttaaacataatttattgttgttcatttctaacttaattccactgtgatcaaagaacatgcatactctgtaacagctcacattgtgtaatttattgggacatattttatgtcttatttttaatctaatcattctaccaatgcagaaaaaggaatgtaaaaatctctgacttctcacttttattatggcttagtgtatttctttgttctgtcagggtttgcttatgtattttgaagattttttattaggtgtagatacatttatagttgtttatgtctcctggatgaattgacccctttgccattacaaaatgtccttctttatctttgggaatactctttgttttatagtctgttctgttaatagagcaactccatctttctttcttagctttttccattcttttattctcaacctgtgttttgtatttaaaaatgtatctcttatagacaacatatagatgttccttgctttttatccaatttgacaattgtagccttttaattgaactatttattccctttacattcaatatatatatgatatgcttaagtttatgccttctatttgctgtgtattttcaatttgtcccatctggtttttttttctgctctgtttttcccttcatgctttcttctgggttaatcaaatattttttagtccttcattttaatctctttatggtcatttaagtactgtacattcattttaggggtgttattagggattataatatgtatatttattccaatctacttagagttagtttttctacttataaaatatggaaactttgctttgcaacagtttgttttcatttatcccccatcactctttgtggatgattatacatacatacacacacacacacacacacacacacacacatatatatatatatatacacacagacacacatatatataatttatatacattgtatttatacttatttgtatttatattttatttttatccatggtagtcccaaaacaatgttataatgtttaaactttaaaaaagtaagaccaggaggcagctccaagtgagtgtagaggcatcattaaaaaatgatgactaataaacttaggtgaaaaatgtgttccttgctaatttaataattcatgagttgctgtcagtgtatgcatatatgtacaagcacatttatatagagacagtatttgtgttcagattcatttgtgtgacattgtttacaagaaaattggcgaaaggagttaccaattcagacatctcttccacttgtggtgatggttaagttaggtaagtgacctcttttttgaacacatcatttaaatgactttctagtaaaatgactacctgaatcttagttattcccttaatacctgggcagagtgtgaaacaaaagcagtatttcaggttaggataagaaaatttgacccaacatggaaaggatggattatggaatggatggaaagaaaggattatgatactccctctaataaaacatgaaataaaaatccacaattagctgaagcagcaagatgcagcctattctcttttattggaagtgtacatcatctaattcagtatctagaggctttagagtcagttaaagatacctgtgaattatttgttgttacggcagtaatgtcaattcctcaaaatagttccattatggaaacaggcctttaattttcaatcccaagtgatacagtcagataacttatgtcctaccattgttcctgagacaacttgctcttttttctttttgttgggaaatctgtttagatacagaaatagttggtatgacatttttcctgaagttgtatagcaatatacatgaggaaagctcaggaattatatggaatctttgcattttttaaaaggatatttaggactttaagacttgtacatatactgtcatacttttatatacattgtaaatagttaagataaaagtcaactttgcataaccttatatagtttttttttgtggtgagaacacttaaaatctctgtaaggtaatgcacatgttaattagcttgggttaggaattctactatgtatatacattttgaaacatcatgttgtacatgatagatatatataactttatttgtcaatttaaaaaaatgaaacacttttaaaaaggcaactttggacatttgttctttctccatatgcccaagatatttttcatagatttaaaccacagttaattcccaattaaatgaacaagaggtataaaataatgggaaagtagaatgctgagagaccaccacatccaacaaactactcaactttgaaatttgtgttcattcaaatacactgacattgtcagaatttatgctgtgggcattccaaaagttcagcatacagtgatacaattccccattccgacccagtacacagtactcctgggaatggaatagctcattctttctctttttttgctatctcccaaaaccagcctatagtgatgtgcctgaactcaaatgggaagatttcaaagatcttgcttagaatttgtaaaagttagggttattactgatgtgaaattttaacagataaagtaattgaacagagtacagtaggtattctctgtcaataattgtgaaacctagtgatcagaaatgattttaggtcacagaatgacttcaacagaaacagggacaaacatcaggactcgatcctttccatcttttagccacatttcttctcctagtagaaagcagagaaaaattagagttgtaaggtctattgatgcatcttggtaagaacatttgcagttaaaccattgagctcctaaagagatgcatctcactgttacactttgtgcccccctccatttgtttattcttccatgtcatgcacagggcaactagaggtacctaccagtaatattacattttggttaactattctttacacacaaaaaagatctttcacaatagtctcaataacctccttttgcagtgatttttttacagattttgtttaggacatgtgaatgtagatgatttactgtacagtttaataacataactgctttgttactcaccaaagtttaggtaaataaatttatggcatgagggagtgcgggaatggaggggtggggaaacacagagctcaccatacactcacatttttaatgccatacttcttatcaaagagaggttactttagaaaaccctatggcagtggacttttgttcttatggcatcagcaaggattatgtagcaattcatttgcagatgtagattttagcccaagtaaattataatcaaaatctatctgacacattgtgcttcctttatctaaattgccctgttaatgagttttctgaatacactaaatcataatcttttatgaatcatttcagtttaaaagccttcagaatctcaattagattatcttagatgaagagaaaagtaaatgttacaatgaatgtctctaactgtggcaaagtggaatgttatctcttaaaccactgtctcctttagtggcttcttccaagaccaggacctacaatttgttcccatttgcttgaaaaaaaaaaatcactaatattggtggtatttggtagtgaacttaccctctagtcgatcttgctgttttcaaggatgatgctcagcatgacatactctgggcttttaaaagagcctttctttgtatgtatcaacacggtagtttctgtagctgcggacaatcaagcagaccaaacaggctaagccagactgtgtcggatcacaccacaaattagaggcagatgcacttttttcaatctggcgttctcctttgacttactatatcattctccattttttccttctattatgttataccacacctaatttcccaaaaggctgagtcattttatgaaaatacataaaatatgtggaaatgggtgaaaaggaaactaagggtgagtaagctaagatggagccaggataaggtcagtaagccaatgcaaatcatgctgctatatgattcagctgcaggtacagaagagcctctttaaacatagcctgtagcaactggggtcaggatggagtgagatgggagggcatgaaagtatctaatgtttacaacatttcagtggccatcttattctagttctctagggaagaatatcagtccctctggaaaagggagggaaaggatgagaagctgaaagactgcaatcattttttaaattgtcaaatgagtccatttgttggaacagaaataatttagtagaaaataggcaatcaagttgaagttttcttctcctcactatttaatcttgatatattgagaggctcttaacatattaaaaatggacaatgaccaaaatgagaattggaatttcagccaaaagtatatgtgctttcatccacttgtggaaatacaagttctaaatgataattaatgttagtcccccatccagagtgatatccttattctgtgtagctttggccgtacaaaccagcctggtccatcaacagggaacaacttgacctctgatgaggaacacttttaccctgacagaaagtggtaatgttttcttagcttctgtagtctgacttaatgtcaggcaaaggcaactttgaagagacagtccttcaaataatactattggcacataatatttattacctttttttaaaaaaaaatgagatgaaagtcacataatttagaattaatcattttaaagtgtatgattcagtggcctttagtacattcacaatattgtgcaactataacccgtatctaattccaaaacattttcatcatcacaaaagaaaaccccatacctgttttattagtcagggttccctagagggacagaactaatggatgtatatatatatatatatatatatggttttattaagtattaacttacaagatcacaaggtcccacagtaggctgtctgcaagcttgaggagcaaggagagccagcccgagtctcaaaattgaagaatttggagtctgatgtttgagggcaggaagcatccagcatgagagaaagatgtaggctgggaggctatgccagtctctccttttcactaatttgtgattgaaggatgcaaagttaagcagttactctccatctccctctctccctagcccctggcaaccattaatttgttttctgttgtgcattccttgttgactatatgctttttgatgaggctggtgaaaaacagatggaactaacactgggcaaattagtctgctgtaataagaagggtattaaaaaataaatataggccaggcgcagtggctcacacctgtaatcccagcacttttggaggccaaggacggcggatcacctgaggtcaggagttcaagaccagcctggccaacatggtgaaaccccatctctactaaaaatacaaaaattagccaggtgtgatggtgcatgcctgtaatctcagctgctcaggagactgaggcaagagaatcacttgaacctggaaggcagaggttgcagtgagctgagatcaagtcactgaactccagcctgggtgacagagcaagactccgtctcaaaaaataaaaataaataaattgataaataaatatagctggtgatgggccattataaaaaaatctgcttgctaatcaatgaaaaaaggcatgaaatgagtgatggccaagactgtgtactcgttagttatctagatttaaccagaaaaatgaagcaacaatatatgaacaatttagttaaaataaagacattgcaaaaacagttattgatgaaaccaggcagagaaagagcagggtcaggaaatttgagtacatgtgtaggctttccatcttaaggagaaaaaaaattggataccatctggtacaagcactactctcccatgtaacatgaaaacttgatgaaaacaaaatcaaataaaccttgaatgaagaatcttactcataagaaagttcaacttcatccatgtgcaaatgtttgggcatgttgggaggcagagattaataggagtgacaatgggtataaactgaaggagctgttaaatccaattttgccttcactgtgtaatgacacaattcaccttctaccattcagtgcctcctgaaaccagatgcacttgaaatactgatggggagcgggggaacattgtttaaacattcagttttaacccatgactcaaggttgaaggtctccagtaattttttttttttgaggtaaaaagcccaatatctgtaaagccaaacttgagatagctaaattaggaatcactaaaggccctaatccagggttcagtagtaatcactttggtgaccttaggctagtaatttacccattctaatcctattttctcatctcactctgcctagctcataataatttttttaaagtagaactaggctgtatgtttaaaaacactttgaaatagaactcagcaactttttagtttgaatatttacaaatatctgtttattggacctgtaaaaataagggaaaaaccctttctgtgtgacacaaatatttattaagggcttaatcactagcattgaattcctctataaagtatagtcactaatacttcacactggtttttgatgaggtttgcaaatatgaaacagtgttgacagtgatgatccatttgcatggggttttcgctttttctcctctcagcttcttagtttatcttaaagccctcagaagcttcttgtatttcttcaacctaaaccacaatattttatctgtatgtcttgagattttggaggaaccaaggcattttcgaggaattataagtcatttcttgttgttgaaattcacacttgggagaagagtgtccttataaaagattattctggagagctaaacataatccagatcatgaaggatcgttcatgatagatatgaaccaggttaagaagctccttttttagacccttatttaaggtcagaaatcctgtttggtggccagtcagtcttcaacagccttctttactgaacaaagactcaaagactctctgaagtggcatttttcttttttcccccctgagaacaaaaagcattaatataacttaggtggaaaaagtgaaatatgagaacaggacagagctacttctgtgaggtagctaccattatttccacttcacaaatgaggaaactgaggcttagtacagttaaataatttgcctatattcacacaggtagcattagagttgggattcaaagttcatacattttaccactaagaagtaattattttctttctttcttcttcttttttttttttttaaagacgaagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttctattttttagtagagacggggtttcaccacgttagccaggatggtctggatctgctgacctcgtgatccgcccacctcggcctcccaaagtggtgggattacaggcgtgagccaccgcgccaggcagaagtaagtattttctaaattactgtgtgctgagaacacttaggcactcctctaggagttttatgttagagaactatgcaagatcgtgtagaagcaagggccaagttatatggtacatccaataggtgctatagaaataaataaaaggaagacattactgggatttgttcagtcagagaaaaaaaatttttttggaggagttggaacctgagctagctctcagagaaaaatataagaagtagatcaattaaagttggaggcaggagcatgggttattccaaacagagacaagaataaggtgaaggcacagagagagaaatgaacagagtgtgtattgaaaggactctgacttggtacaatactagagtcatggtggggagtagtgaagtgaagcctggtgtggcagggtaagctatgtagaaggccttgaatgccaaccacagggctttctctctgccttagaactgtttattgaataagcaaatttctgcctgtctcaggtactctcactattgttatccatcaagcagaacatgagttgcatttgctttccaaagtgctgttatattttatgtttatgaggagaaatgtgacaatacaggtccaggtgtccaaagggaattatagctatcgccttcaatgcaatacaaaactccatggctgctgggattttcatgcccactggcagcccagagatacattatttatttcaaattataccttttcccctaatgggcctgtgtttctttcaatgttctgctagttctagcagcttcagctgttgctgtcatacttaataaggactttgtggagcttagatattgtgcggctgcactatctttcccacagcccagtaaaggagctttgagatgagctttttctttctgtgttggctatgtttagatttcaacctgaaaaatattccaggttgacccacagcttattctgctatcagtgagagggtaggaatcagtaagattagcttcctctaatgccacagcaaggtcacccacgaagcccgtagcttgtcgaattgcatgaagtgatccaagctagttcaaaactcccaatgtattaaatgtcggtgcccacttttgcaaattcaggcatccaaattgtgcctggtatgaagcattaggcagtgggtctaggaaattgagctcaagggcaggaacatcataactttggaattattggcgttgacatggctattttcactcattgtgataggaatatgttcctgaaagaagcaagatgattctaaaaagtaccgtgcaattataaaatagtgggaaattaaagaagggtgcttttgtgcttgctttcttgccactgattttgcattccctattttacttcatggtagtctatatgtcactcaaatcaaatataattggtgctgtttagtatttggtaattttactgctgcttgtacaacatacgcaaatattctaaaatgtgttaatgatgtcagtacatcacaaataaaatgcacgtgaaatggaaataacgctgtgcacactcatacacccacaagtgcatgggagtctgatcttgatagattcagaagaacccttagctggcagttttaataggcgatcatagaaaagaatgccagcaaaaatgacagagctcatatttctactgacaaaataccaaaatgacttacgagttattttctcaaaaatggaagggggcagaactgaagagtcagtgtgtgtgtgtatatgtgtgtgtgtgtgtgtatgtgtgtacagacttatataaggtcagtggtagattggcgagatagactaatatgtgagtaaagttatggagtttaataacataatcatggttaactaacaggatctgaaactgtaaaaaatatagggaagcatcagtatttgatgaggaagattgggggtactgggctgggcagctacgatagaactgggaacagaactcttacattgaactgacatttagcccttgactttatgaatgtgtgttgaggttgcaactacaaagtaactacatttcttaagtgtcagaatagtgaattctaaccacttggcaaccacgtttcagagggaggattgtagttacttcactaactgggtctaggggcaataaggagaagaaatggctgcctactaggcaactgcacacattcagtaaggtggggggaggaggaagactattggtaacactcacagaaaagtggggcctgcctgcccagagacagagaattacagttgagaaaggcctgtctgcctggaagtgtgtgtgagtatattgtgtgagtatatgtgtacgtgtatatgtgcaggtatgtgtatgtgtgtttgtgtgtgtgaggatatgtgagtgtgggtatgtgtacatgtgaatgtgtgtatgtgtatgcatatgtgtgagcatgttgtataagtgtgtatgtgtttatgtgtgagtgtatatatttgagtgtcttatgcatgtgtgtatgtgtgaatgtgtagatgtatgagtgtataagcctgtgagtgaagtttacactgatgcagaagagggctggagcccatggagagaggtgatcagtttgaaccaggcctgatttgaaccctgccccatgcctggtgagcccatgctctgcaccagtgtttcatccctagctttgcacataaacaccatctctctctggaaaatctttccagtctctgactgggtaatgtaatgtagccccatccctcaaggaccagctcaggtgcagcctcctccatgaagccttccatgatttcatttcccctatctccaacagatgtgacctctcctgtggctatgggtttggggtggggcatctgtgctggggtgtagaggagtgttggaacactgagatgggagcaaactgacaggaagaatcagaggtatacatttagaatttgtagtttgtattaataacaagcacccttggtgatcctcattatcaggtaagtttgggaaacactggcccagtcttatcccctcattttttagaagagacaactgaagctcagagaggggaaatttactggcctaggatcacacaatcctttagtgacagaaccaagaccagcatgcagatatcccactatctttccagtccagttatgtttccctttgtattatattaccgtaacaagactggctacataatttgcatggcccagtgtaaaattaaaatgcaaggctctttgttcaaaaattattagaaatgtcaagacagcaaaagcagagcattaaaccaagcacagggcccttttacatgcagagccctgtgcatctgcacagatcatacacctgtgaagctgacgctgtcccacaaagagtgtttactatatcttgcatgtggtaggtcgttctataaatacttgtcggatgaatttatggattgaattaacacctcccatttgccaggaatctatgaaagtgagacactagataaatatgttttgatggaagtgtaggaaagaagagaagaaaaataggtctggaacatgatacatagggttactgacatttgtgtttggattttttatgtgagtttttgcacacaaattgagattgctacaaaggctatccagtataagcaattgctgagtaaccaacacagggtctctgactggtaataacaatggattttaaacacttagcaaccatgactggggaggaggctttgcagccctagcaggccaaggggctgggaggaaaagaaaaataaaattggctgcctactggacaactgtgcatatttaacaagaaatagtttggggtgcaaataaatcatctgagttgattaaatccagtctgtttagggaattggtatgtagcttgctcccttggtgaaggtttgacctaaggaataatcaaagcttttctgaaatgtctgtaatcactatttggaatccttatgttgccataagacttctaaaagccacatctgctatacaatattgtctggtgatccatataaactctttaggccacaggtttttaatttgtttgtattagttttctattgctgtgtaattcattgccacaaacttaatggctattaagccatttatttattttcccagtttctttaggtcagaagtgcaggtacagtgtagctggtttctctgatcagggtgtcacatagttgaaatcaagttgttgtttgggttgtgttcccatctggagcttgggatccttttccaaactcatttagattcttggcagaattgagtcctttgtggttatgaggtatccatttacttgctgtcacctggaggtcattctcaactcctagaggatgctctcatgtcccagttacatgtctctctccatcagcagctcctaacataatcatttgctttcctccaagtcaacagaatagcatctctgccacttagaatctttctgacttctccagttttttaaggtttcgcctcattgggtcaggctaaacttgggtagtctctttttttggtaacttaaagtcaactgattaggaaccttaatttcatctgcaaaattctttcacctttgcagtatagcataacttaattacaggagtgagaacctatcagattcacagaagggattatacaaggtatgtatgtacaacagtggtcaagattattggaggccatcttaaaattctgcctaccataatattaatgaatgaactttagggacatattcaaaactctaacattttatgcaaaaatttttgtgactgttcattttttccgggagccagttggcagcattcatcaagagaggtctgtgacccaaatcctattaagaaccactgatggaccagataatacacactggcaagaagtgatctagaaccaaatacttatttctgaaagaatttaaccagtgtcttttcaaggaactaaagaaatctcatgtggtgtttattgagatgaggtggctcaagttttattcaaaatatatcttttagtgtgtgattttcttttaaatcaatgaataattggtatttccaaacagattttgttatcaaagtgttcgtttctttttaaatttaccattgttactttatttttcacatttgtgtaactgtgcctccaccgtccttccccatctggctgcctataacatttccaccaatggcaaggagcggttaagtcagataaaatttggatattagttggggacagacaatcatcagtgctgtgcgcattatattccatacaggaatataattaaattttggaccttctggctaggttgtaagcaacttgagagacaggaatcagatcttgtgttatattctatatagcactatattgggtcaaaaataagctctcagccaggcgcggtggctcatgcctataatcccagcactttgggaggccaaggggtagatcacctgaagtcaggaggttgagaccagcctggtgtcaaccaggtgaaactctgtctctactaaaaatacaaaaattagctgggcgtggtggtgggtacctgtaatcccagctactcaggaggctgaggcaggagaatcacttgcgctcaggaggtggaggttgcagcgagctgagattgcaccactgcactccagtctgggcaacagagtgagactctgtcacacacacacacacacacacacagacacacacacacacacacagccctcaataaatattgggtgaattcactttgattcagaaaataatttttagagggtattgtgtgtaggaactgtaacaaaaaataggacaaaattctgtgcctcaagtttacaatctaaggattatcagataatcacaacccaaagattgtaacgtgatacaaagttaggagaatgccaaatgagaggtatgagcagtgtggtcagatcagattacatgtagcatctaatgggagtgtgggtggggctgggcaaggtaatgagtcagagaagagcacagcagaggagttgaaatttgcagtgtgtgaatagaaatggagtacagagggaggaaggctttaggatgtcagaagtggtaaggaagcaagaaagccatacttcaggtaaatagatgtactgcacattctccatgtgtggtccagccttcccctgctttttctgattggattcccttaacctattgactcaaatgcaaatatctgtcatggcccagtttaaatgtcagcatccccatgaaacctttttgttcactcagaccaaaaagaatctctcgttcctctgaaatcctgtagcatgctatctacatgtctcacaagtcactttctgttgtttagcatagttatatatatatatgcatgttttttcttctctatcaccactgatttaaaaattcccttactttatattgtaatttctgtttaaaaagcaatttcacatacattgttctagtgttctcttggttgcagatgaaaagaccaaggctcacaaagccccaagctttactgctagtaagtaacaaagaaagggcctgagtctaggttttcagaattcacacctaatacatcttttttattttgttttcaccagattattgtttgtgtgtataggtacgtaaaatgtctgtgaaggtgacagaaataaaatctgctgatatttaaaatgttactagtcttggccacttcacttcagatgtccagtgaaaatgctgtttagcttatctgatagatcaacctgtgtaaataatctttctcataagtaaattatgggaaaatgtgagtctgagtttcatatccctatatttcttctaacatggatgtttgatgcacgtttttaacagctttattgctatatgattcaaataccataacatttgtttcaagtgtacagttcagtgggtttttgtaaattttgtaaatttacaaagttatggaactgttattaccacagcccaattttagcatatttccttcatcccaaaaagatccctcatatccatttgcagtaactcacattttttcagccccaggctaccactaatctcttttctgtctctatacattagccttttctggaaattttatataaaaggaatcatacaatatgagttcttttgtgcctggcttcttttactttgtacagtgttttcaaggttcatctatgctgtagcatgtatcggtattgcatttttattgcaaagtatagatatactatattttattttcccattcaccaattgatggacatttgcattatttacactttagggctcttataaataatattgctgtgaacattcgtgtataagttcttgaataaacatgttttcattttatctctcttggttttatatatatatatatatatatatatatatatatatacacatatgtatatatgtatgtggaaatgctaggtaatatgacagctctatgttcaactttttgaggaactgtcagactgtttccaaagtgactgcaccattttacatttgcactaacaatgtatgagggttcctgtttctccatatcatcaccagcatttgtcattatgtctttttaattataaccattctagtaattgtggagaggtatctcattgtgcttttgatttgcatttccctgatgactaaatgatgttgggcatcttttcatatgcttattggccatttgaatgtcttctctgaagaaatgactgttcaggtcctttgaccattttttaaaatcaggttatttgtctttttattatttgagttatgactttttatatatttaaggtgaatgttttttaccgaatgtatgatttggaaatattttctcccagtctgtgattcatgttaattttccttattttatgttttattttattagttttttagatacaggatctcactctgttgcccaggctggagtacagtggtgcagtcatagctcactgcagcctccaactcttgggctcaaacaattctcccacctcagcctgcagatagctgggactacaggtgtgcaccaccacatctggctaatttttaaaatttttttttgatagagacagagtctcactatgttgtccaggctagtctggaacttctggcctcaagcaatcctcctgcctctgactcccaaaatggtgagattataggcatgagccatggtacttggcctgtcttctttttttttaatggtaactttcgaagcacaacaatttttgaaaattttttacgaagtccaattgacctaatttttatcttgttgcttgcgtgttgttgtcttacctacaaaatctttgtctaacccaatattacaaagatttgctccaatgttttctactaagagttttacacttttagctcttacatgtaggtctttggtccattttgagtaaagacttgtgtatggtatcaggtagaagttagaattaatctttttgcattgttctagcaccatctaaaaactattttttatcccattgaaatgcctttgtacctatgtaaaaaatattaataataaatgtagggttttttttattccattgatctatacgtctatccttatgccaatacaagactgtcttaattactgtaactttatagtactttttgaacttggcaagtgtaagttctttgttctttaccaagattgttctggctgttcttgaacatttgccttctcatacagattttaggagtagcttgtcaatttttgccaaaaaaagcctactaagattttgataggcgaatgtctgtgtgagaaaaaatggaaaaggatctagaaaagactgtgagagtcatcataacataaagccaatctgacaccaagtgagagagatgaaagggaagttgggtagaattgtcctagacttccatcagtctaaagaaggtttaacaggagagtttggctgataatctttaagccaaagtcaaccaacaaattgttttctgtttcccaagaatggacctgcctttgtgtccctgccatgctcagtcattggctgggggaagcctgtgggacacacgggctcaataccagtgtggtgatggattttagtgcacagaagctagagcctttcgtcagttacattccttgtagttggaggtctgtgagttggattctcatagttgctacaatacatgaccaagaaacattcttctttctccaggagaacttcagaagaaggatctgatcattctggcccagaatcaattttccttgaagttcagtcttataatgtctgtaatactatgcaatatagattctcctacattcagactgtcactgtgttcatgtgcttggctgaatcatggttgtttctagaggaagtagccaagatgatgtgacttgacctcaacaatactgattatttaaattctagcagtaagttctgctatggaactatccatgtatattttgtataagattccttctagatatctgtgtgcatcctcctttcataccatgggagtttactgagtgggaagtccataggggctggtaggaaggcttcatttcagatatggactttgtacccattgagatgaatgtcatagaaagggttagtttaaagaagtagatgagaaacattaccttggaaacagcatgtaggtagagtagggggctactgaaaagatgtattccctatataggcacttcagtggcattttaccttttttatgtaagtagtaattatacatttaaatcagcaaaccttgggagagcatactttctcagcaatgttttcattttttcatatctctaaaaattaatcttctgttgggagtgacttaccaatgatccccacgctatcatgtgatttcagcattctttccattatgatgtcttttcagcctccagcagaggtaagagataagttgtgaagtagaaagttcttaaatcaggaaaatgaaaaaaggaaatcaatgttacaactatgaaagaagcaagagtactttccagggcaaagaatttggtgtaatctagatagtatatctgatccctttgtcaaattcttttctgaacctaggaggaagttgtaacagtcctcacattgccttgtaccctccaagaaagtcattaacatttcaaaaatattatcagttttttttgaaagccatgggagaaccttaccattttaaagtaaaattatgctttgctttgtatgatttcaactgctctgattccattttagttaagggtagcttaattctcatggctctaacccatcccagtatatttgcctgaagctctattaagtagattgtattaagtaaaattttaccaacttgaaattaagaagaggttttaacctgttaaggttttgccatgagaatggatgtagtcatagtagtcataccttctatgccttcttggtttctatctgcttgcttcattttggctttggcattgcgtttacctgcagcaaaaccctacagaattcacctgaggggttagacactaattatgatagatttacagtcatgtgctgcataacaacattttggacaaggatggactacgtgtatgatggtggtcccataagattataatacgatatttttactggacttcttctatgtttagatacacaaatatttaccactgtgtttcattttcccacagtattcaacatagtaacatgctgtataggtttgtagcctaggagtagtaataggctatgccatgtagtctaattatgtagtaggctatgcagtctaggtttgtgtaagtacactatatgttgtttacacaatgacagaatttcctgacacatttcttagaatgtatcctcattgttaagcaatgcatggctgtgctgactggtgtttatcacaactctatatctggcaggtcactgctgccatagcaaaggctatttatttttctttgttgatttaatatagtttcagtcattagaaaatatttttctgtggattctgattcaaagttcattaatcaacagaactgatacattgttgagatgacccaggacctggaagtgtagggatgtgcccatttgttacatgaagtgttgacttgtaattagaatgtactcatgatgcatagtgttaaatacaaatgagtagaacatgagaattgggagaaatcttagagattatctggtccaaccccctacattttactatggaggaaactttgtgtggcccaagtcacataacaaataaatagaggcagaactcttttgggcctgaatttgtatctctagattcctattccagtgattattctatttcctgttctgtttcttaagtgtcttagtctaaagtgaatttatcatatattgggtagcttacatggaaattaaaagtaaacattgagctaagcaactgtttaatttcatattgaaaactaagaacaattggctatgaacaggtgggataaaaactttcaaatgcattgtgaagaattaaggtctatttttatgaggatgacagtgatcattgattcaagacatctaatgcagaactatctgggcttgcactgtactgcatatacggcttttaagcacttgaaatgtgcctagtccaaactgagatagatgttgtaagtgtaaactagacactgtatttcaaagagttagtaccaaaaaagaatgtaaaatatttcactaatactgtaaatattatacataatgaaattatgttatttggatatattgggttaattatatacatattattaaattagttttaccaatttatttttactttttaatgtgactactagaaaatttaaaattacaggtgtggctcacattgtatttctattgaatagcacctgtccagagtgttgctaccaaatgtatggtccatgaaccagcagcattggcatctcctgagtgcttgaaattaatgcagaattttatgactcaagctaaactgactgaatctgaatctgcattttaacaagattcccagggtaatttacatggacattaaagtttgatatatactgagcaagcatgtgcacaccttgttcagatacttcctagttctccacacagaacttgttggatcccttctgattgatatgtgacatttagagccaggtcaacccacgacattctggctttaagctttggtagatttttaaactgcttttatgtgcagtggttttctgatctcaaaaagctctaccctcctcgtataccaacatgtttttactaataaatcagacagcagtgatgaaggtgggaactccagtaggccaaatatgaaagttacaaatgctgttaataccccaatctcccttctgctcagatatctctcctggttctacatcagtacagccaactgtctgttttatatttacctctgttattctactagaatctcaatgcaaagtgtccagaacaaaattcaccatgttacctaaaaaatatgattatttttatatttcatgtcctgatgggtatcagtaccatctacctatacatccaagtgtgacctggaagttataattaataatccttctttcacgtcttcacacaaacctgaaatccaattagccccttaagtagtcaactctgcctcacatctctctctggaatatattcttactttccacttatactgctctaattctgagttttcattaaatctttcctgaattattatagtagcctcctatctagtcttctataccctgtactatctcccctttctaaacattcttccacattgcaaccagaaatacctttctcaaatacaaatctgatcacgcctaaaatcctttggtggcttctgagtagctcagtctccttgttaaatggggctaataatagcacctatgtcaaaggctttttgtaataattaaataaattaatgtatataaagtgtttagaatagtgcctggtacaatgtaagtgatatgtaggtattagcttatattatgtttattattcaaggctctttacagcatgtgacctcaacctattttgttagtgaaaccaatgtcctatcaatttcttacaacacacagaacattttatggcttatgcatggtctgtcacactgtttgtgctgcctagaatactctttatttttgtgccagaaaaaaaccccacttcacatttttccccaagttggttcctggccttcatggctcctttttgatggcaaaaatttacctatattccatgcttgcttattaaaatacattcctaaactatgattatctaatgctggaagcttacatattccatttggtaaatggatgatgctgcccaaatggaatgtatggcaacatttcagatttcgttaccatgaacatttaaaccaaagtaaccaaagctttcccagatggtgaaatgaacagctaatttttgtaaacagaacagcaggtggtctcctaatttatctaaactcaaaggaaaaaaaacttgtttgtgaccttcagacagatactgactactggggaaaaatgatttttgtcagcttgtttatataaagttttaaatcactggtgcttggtgttttcctcctgttttaattgaaataattaattccaattagaataacaggcataactgtctttataaaatatttccattctagaagagatatagttcaacagcatttcttcaaataaaatactaccaaaatgtcattggacaaagtaggaatttatagaaatctgatagtgaattctactaggatatcacctcctaacttaaggtttccttaagtgtgcattctgaaaagctgcatcagcttcccttgctggaacctatcacacttccaaatttcttgccgctgtctcttcaagaagtgacaatggcaagatagacaggcagaagaaccagcacaagtgacaacaagtaggcaggaaggatcaatgcgtattcacagaatcaccagaacaatccaaatgaataatagcagaaggttcctgttggggaccagaagcaaatgcaggtatcgcagacatataaaacagaatctcagggaataggtccaaaaaaaattttttaacaagtaccctgccaccccaaataatacagatgctcataaatatttcaaaaccactgggctaagtcttcaatttggttcacctgcatttgttgctggtccccaacagggaccttctgctataattcatttggattgctatggtgattctgtgaacatgcattgctccttcctgtctacttgtcacttgtgcttggttcttttgcctatcttgctgttgtctcttcttttcatctttcattattttatttgcttctcaaatgttctgtactcaatgatacttttctgaaggatgccaactttcaccactgttactcaacatagtactggaagtcctagctagagcaatcagacaagagaaacatataaagggcatccaaactggaaaggaagaagtaaaactctccctgtttgcagatgatataatcttatatttggaaaaacctaaagacaccaccaaaaactattagaactaataaacaaattcagttaagttgagggatacaaaatcaacacacaaaaatcagtagcatttctaatgtcaacagtttacaaactggaaaataaattttaaaaagtagtagtccaatttacaatagccattaataaaatcaaatacctaggaattaaccaaataagtagaagttctccgtaatgaaaactgcaaaacgctgatgaaagaaattgaagaggacaccaaaaattggacaaatattccatgttcatggattagaagaatcaatattgttagaatgtccatactactcaaagcaatctacagattcaatgtaatcctatcaaaataccaatgatattcttcacagaaatagaaaaaaagtaccctaaaatttatatggaaccacaaaagacccagaatatccaaagctatcttaagcaaaaacaacaaaactggaggattcacactacctgacttcaaattatactacagcgctatagtaaccaaaatggcatggtactggcataagaacagatacataggccaatggaacagaataaagaacccagaaacaattccacacgcctacagtgaacttattttcaacaaaactgtcaagaacatagactggggaaagaccatcttttcaataaatggtgctgggaaaactggatatccatatgcagaagaatgaaacaagacccctatctcttgccatacataaaatcaaatcaaaatagattaagaggttaaatctaagacctcaaaattgtaaactactacaagaaaacgttgggaaaactctccaggacatcagcctgggcaaagattttctgagtaataccccacaagcacaggcaaccaatgcaaaaatggacaaatggaatcatatcaagttaaaaagtttctgcatggcaaaggaaacaaccaacaaagtgaagagacaacccacagaatgggaggaaatatttgcaaacaagccatttgacaaggggttaataaccagaatatataacaagttcaaacaactctaaaggaaaaaatctactcatctgattaaaaaatgggcaaaaatattggaatagacatttctcaaaaaaagacatacaaatgggaaacagacatgaaaaggtgctcaacatcattgatcaacagaggaatgcaactcaaaactataatgagatatcctctcaccccagttaaaatggcaaatggctttcatccaaaagacaggcaatagcaaatgctggaaagaatatagagcaaagggaaccctcgtccactgttggtaggaatgtaaattagtacaaccactatggagtccaatttggaagctcctataaaaaactaaaaattgagctaccatatgatccagcaatcccactgctggtatatatccaaaagaaaggaaatcagtatatcaaagagatatctacactccagtgtttgttgcagcactgttcacaatacctaagaattagaaacagtatctatcaacagatgaatggataaagaaaatttagtacatatacaaaatggagtacaattcagccataaacaagaatgaaatcctattatttgcagccacatagatggaacaggaggacactcagtaaaataagccaggcacaaaaagacagcattgcatgttctcacttatctgtgggatctaaaaatcaaaacagttgaattcatggacatagagagtagaaggatggttaccagaggcttggaatggtagtggggtgtggaggcagggatggttaatgggtacaaaaatatagttataaggaatgaataaggcctagtatttgataacacaacagggagactatagtcaataataatttaattgtacattttaagataactaagagtataattggattgtaacacaaaagataaacgcttgaaaggatggatatcccatgctccatgatgtgattattatgcattgtatacctgtgtcaaaatatctcatgtatcccatgaatatatacacctactatgtacccacaaacattaaaaataaaaatttaaaaaatgctctcctggaccctgtttttgggagaaatctctctctcttactaaactgtgttttcacacatattgaattgggagctttgtatgcaaattatcatcttagtcttctctcttctaggatgaatctcggtgttttactcactactgaaatcctgtacgtacttgtgtgcacaacatataccatccttcacacataaaaaacatgcaacaaaacttgaaaactagttatttggaagaaataaatatatattttatatagaggtttttttttaaaggaaagtattggcatatttcagcaaggtaacttgatgtgctaagatgaattcttgagacaaagatatgacttggtacagcttggtagagtaaagcctaaaggtacaatcttctaaacctgtgactgctcaggcttcccttctgctcagacccttttttctctacctcccatattccaaggacttctatgtggctgccctcattttggttaccttatattgatgtctttgccatgaatttggcccttgatgcccttgtcctttatcttggcttttaactcttacccagattaggtacaccatagctgttcagtgggtagggccagataccttcccttaacacatatacattcgtatgtaagagggtactttctgccaactgatgattaagttaactcagtgctaactggtgccataatatagcatagagctgtgtcacatagacccagtcctcagtgggtctctctgatgcaaaggaaaaagtgagtcctcggttcagatgacttttttcttctcctagcagccacaatattgctttagctcctagctcttggcctactcatttcaaacttagaaaaaaagctatggtattgaactgggacatagttcaggcccaggacagagattttaaattaatgtctggggtatccaagcatgtgaaggcatagacacatacatatgaaacccatttatactggatacaaaaacttagctgaaaatctttccagtcgaccacctcaaatagttggatccatttttaataaaagtaaggctgatttggtgcaactacctttcagttaggatcagaaggggtagatggtggtgaaagggctgaaaatagaggattccacctagaaagcacaaactaagctttaatattgtctttcttgagtaaattttacattgtgaattctggtctcactacccaacaaaaaccatgggtgagagaaattaatgtccttagctttcctctggagacatctttttgttctaacacagagaaatgtttgccaataaaaattcatacccaaatgagtacagttattggttaagatgaaatgtttctcatttgaaactttcatggttgttataaagaaaatttctgcatcccttcataaacgttgagactgactgaaactgactgagttaagttatagtatcaatgaatagccacacattttctactttaaaaatataagtgatcagagagccattcggctcaaaagaagatgattgtcatccagtcaggaggtttgttgaaccttatagaatacataagataaagttataaaatgatagcatcacttacacactgaagagttataattgagatgcccagttgctgatggtagctaagatgtttgtgtttttctgaaaaggactcaatgtggcctaatgttcttgccttctatgctatgaatccttcaaagcatcactcatgcattcaataaaactttattgtatgcctactatgtgccaagcactttgataggctctcaagtttgtgctattccttaaaactttttcctgctttgtgtcttaagacattgcatttccctcgttctgctccttagtcatagatgtagcctttgctttctcttatttacctctaaaatgtaggtgtttcccaggactttgtccatgttttcttctcttattctgtactccccctgggtagcatctctcagcacaatctctacatttatgtctcctaatttctacctctggcttctctcctgaattcaaaatacaaacttccagatgctctgctggcaaagtcatcatggctattctgttgataccttcttcatgatccaagtgatacataataccttctgcctaatcgccaactccaccttcaaacctgctccttcttccttatatcatttattggtaaatgtcactactgtattacctgtcctccatgttagaaacctaggcatctctgatgccttttttccttcctatcacatatattgagtctgctttcatagcctactaattctgcctttcctgtgagctctcttttttccatttccacctccaataccttattttagaccagtaattacaaactgacagcctgcaggccatatgtgtttctttcaacagcagtgtttatttttaaaaatgtaacatcctctaaaatgaacatatactctcgagttcaccatgtttctgctgtatcttcaatggtgctaagccagtaccttttatataatagatagttaggcagtatcttgaattgagtgacttgtcctcggaaagcttataacctggctggaaaacatgaaatatgtatatgtaaaatgatttagtaacaacccaaggcagactataagaagaatgtaaaagaaaagtggagcagacaattagtttttcatgtgatgagagaagggagagatcattttgggagtaaccagagaataattcacagaggaaaaggcatttgatcagagctttaaagagtggatagagattatgaaatattaaataaagttgctttattttgatgtttacatcctaagtaaggactttgttgcaaatactgtggattaatgagggagaatgggtacttatttccctcaaactccaaaccatgggacaaatgaaggggggagggcccgtgatgattgaaaagagtaaatataaaactgataggctgggtgcagtggctcacgcctgtaatcccagcactttgggaggctgaggcgggcggatcacaaggtcaggagatagagaccatcctggctaacatggtgaaaccctgtctctactaaaaatacaaaaaattagccaggtgtggtggcgggcgcctgtagtcccagctactcgggaggctaaggcaggagaatggtgtgaacccaggaggcagagcttgcagtgagccgagatcgcgccactgcactccagactgggagagagagtgagactccatctcacacacacacacacacacacacacaaacttgataaatggaggtgttactctaaagggtaagaagtacatttccaaaagtatcaatagcttcagatatatttagaactttcaacaaactcatttgataaatttatgaatggcaagacatgggttttaagagaaaccacaaagtttgggaaaagatgcttggaaagtaatcatgccttcctattatttgcttctttgttatctatttaaagattaaatatagggctgggctgtccatgctacaggcaggcccagaagccctgttttgatgttttcattacctacattctctcctacagtacagtgatatatattagaggactttgccttagttgatgttactgtcaggattgtaactagaattactcatatactctttgctgatgaagaggtaagcctgtaaacagcttagcaggaaagaccatgccttactttttttattagacacagcacctagaataatgcaacaaacatagaggctgttcctaaattccttttgatttcctctggctgaatctaaaggcaatatttgtttcttggagcctgaatcttcatctagcctcagacacaggttatacctacttcctgcctatccctcttccactattctctcctcctcagagcctgttgtactctgttatttttgaaagtccttgcaattccattatcatagcattgcatataggctagttctatggtgaggccaaggggagttaaattgcaattaccctactccagctgggcctagcaatactgcatttgaaaagagtcaggcttttgaaggatgacctttttcatcctttttttcttctccttcagcatcttttgctgccaccacctcctcctacaactgaccatctgaagcagtttaaatatctgctcatttaaaacagcagcacaggctgggtgcgatagctcatgactataatctcagcacttttggaggctgaggtggatggatcacctgaggtcaggagttcgagaccagcctggccaacgtggtgaaaccctgtgtcttctaaaaatacaaaaaaaattagcaagatgtggtggtgtgcgcctgtaatcccagctactcgggaggctgaggcaagagaatcacttgaacccaggaggcagaggttgcagtgagccaatatggcaccactgcacatcagcctgggtgacagagcaagactccatctcaaacaaacaaacaaataaataaataaatacaaacaaaacagcagtacagcaaactgacatgtggccccaaactgggatgttgtgctagtatctagcccatcactgtcaaacccaggagtctagtgttgtttttgatggtttctcttggatgctgtactttgttatatgccatgtaggttcctttttggaaagtctaggatttccccaaaacatatagggaatcgtgtatgaagtctccaaattaatagctcatctcagattttagttgttggaattctctcagcagatatattttcagaatctcatagttaataatatatggagcatttggaaagaaactaaagacagggagatgatggagaagttgggaagatatatgaaacatatgggtaggaggataaggggagatacattttaaactaaaacattaaaatgaaggatcaattttaaaaaatcaaaacccctgatttttctaatcacaatctaatgttatccttaggaggcccttatgcttataccaggctaagcacagagcagatatatcatctcagaaactacctgtctgctcaaaagcgtaaaggaaacttagtgagggaggcttctaattagaattaagagaaactgaggcagatgatgatcagatgtaatcagggtagacaatatacatagaacgaaagccaggttacttaattatattttaaactagattatgcaacatataatcagtggcatactaaggctggagccacggaagcagtccactccgggcacaggaaataaaggagtgcattgtctgtagagatataaaagcagtaataaatgtgattaataatcagtttgacttggtgtgcacattattatcactttggagtgcccaggcttaatccttggatttacctttcttttctgtctatatttactctttaagtaacttctatatgctgatgactctcaaattaaaatatctgtatctatccaactagtaactccacatctacatagtggaagtctaataaacacctcaaatgtaacatttccaaaattgaattcctagtatctccataaaacctgcagtcttccccatctcagttgatggggtcttcatccttctgattgctcacaccaaaattcttggagtcatccttgactcattcttcttttctcccacagcacaaccaatctatcaggaaatcatcttggctctaactttgaaatatttccagaatctgaggactcctcaccactctctctgttatcatcctggtctgagccatcatcatcatcatgacttgcctgatttactgcaaaaatctccaggctggtctccctgctaaactgagaataaaagcttaggctcctttagtggcccacaaggccatatatatctggtacttggataccactgtgacttcgtctcctgttcctctctccttcactcccttcacttcagccacattggccaccttgatgttccttaaacacacctgagcatcctggggaagtttcttctgcctgtgatgctcttccaccctgataactgcatgctttgtactccctcgtctctaggtctttgatccaatatcaccttcccagtgaggtttatcctgccctgcctgtttaatatgcaacttgtccccactccactcccacctccccatactctcaatccaccttactctgatctaggcttttctttgatgcatatcatttgttactttctaatttttcatgaaatttgcttattaattttgcttactgtttattgtctgtcttccctcactggaatgtaagtgtatatttttgctcacacattcccagtgtctcaatagttcctgcttggcatatagtatgtattcaataaattattgttgaatgaatacatgaattgtatttaactatatatatctattaattatggaagtaatttaactgactgaaattagagaaaccaggcatggggcacatctacacatcacaaccaggcacttcaacacagacttttttgttccctgaagcatttgtggatgtttgtgtattgtttcctttagattacaacctaatccttgacagaaattgtaagtgcttgttcatacatacttgcaattgcttactttctgccagtctaaatcaagaatatattataagaatttccctggtttgatgaatgtcacttactgcaattccttcttacacatttgcacatttactttttattgtttgtattttcttttcttttcttttttttttactgaagattgtttagaaagttctatataatatagaacttttaaaaataagcatgattgtttacctaccctctcatccatctagatatttccagtgagaaaaaaaggaaggcaaaaaagagaaatcacctggaaggttaccagaattaactcttaactggcatttaaaacctttaatctctaactgccctgtaaacaagatagtactttcatacttaactttctgtataaatcaagcaccttttttatacaaccttatgagaactgctagccatgtgacaaatattaagaattgatggccaggtgcagtggctcatgcctgtaatcccagcactttgggaggccgaggcaggcggatcacgaggtcaggagatcgagactatcctggctaacacggtgaaaccctgtctctactagaaatacaaaaaattagccgagcatgggggcgggagcctgtaatcccagctactccggaggctgacccaggagaatggcatgaacctgggaggcggagtttgctgtgagcggaaagatctcaccactgcactccagcctgggtgacaaagtgagactctgtgtcaaaaaagaaaatgtggcacatatacaccatggaatactatgcagccataaaaaatgatgagttcatgtcctttgcagggacatggatgaagctggaaaccatcattctcggtaaactatcgcaaggacaaaaaaccaaacaccacatgttctaactcataggtgggaattgaacaacgagatcacatggacacaggagggggaacatcacacactggggactgttgtggggtggggggaggggggaggcatagcattaggagatatacctaatgctaaatgatgagttaatgggtacagcacagcaacgtggcacatgtatacatatgtaacaaacctgcacgttgtgcacatgtaccctaaaacttaaagtataataataataaaagaaaagaaaaaattattatctgtatcttacaggcagggaacataatttagtaatttcatagaaaggtctatactgaactattacaaatgtttttaagtacctgatttttccccatcattaactgtggttttctcttcaaatttctttttcaactttcaacaagaacatcctgctgaagcttgtggccacatctagtacaattgtcctcaaaggcttgtgctgagaagaatggaagatcgctagatagcttcctagggcagtgtaggattgaagggaagagagaacctcagagcaaactcagttaattctgatttaatcattaatgaaccagacaacaggctatatttacgaaactgttaatcaaaacagacaggatgtaaatttctgggacaaaatgttgaaaatatcaattctgtagcaaggttaaacctgtttattatttatttaatctcaagacacagcagaccatttattgattaatgagaaataagaagcatgttgcaattaaatttaacttgtaagtcaggaggccctggcaatttggtctgatactatatgactttgggggatgaattttgaaaattcctactccaggataaggaagacctcatttatttctttccaaggtctcatatatcatgttttatcttaaaaggaaaacagggaaggacagcaattggctgcattctgaaatccaggcaatagatctaacatagctattctattaaaaaaaaaatgaggaatcctcgaacatagaaaacattctacacaaggttggtcaggtagctatgttgaagaggcaaagtccttggaaggcccatttgtcctcagaaaatcattagacacagctagtgaaattctgactctccatcaagcaaggcaaggctaactttgtatgtaggtaatatgttctttgcagtatttctttattttatgtcttttaaatgaaaaacaattaggaaagctacattgtaaatatttgtaaaaatagaatgagttttaaaagatttaccccactgctaccattcctataaaacttttattaatattttgatgtatttcatttcagtctttttttctatccataaaagttacatagttgtaatcatactgtccttacaattttgtatggtgctttttaaaacttaatattatatcataagcttttccaaactgttgtgaaattctcttaatcatgattttaatgtctgtaaaatgatccattgaatataccatgatggacatttaaattatttccaacttgaaccatagtaaataactatttggtggcatgtacccccatagttatttctccataactggatttttttctttaatgcagagacccacaaataaaatcattgggtcaaagaacatagctcttttagcgaattatattacagtttgattttgtttttacaaaaagtatagtgtgtgcctggaaagatacataggtacttaaaatttaacagtgattatttctgctgctgggtctacaaataaatactaacgaatagttgcttttctttcttttttacttttcgttattgtcaaagttttctttttttttttttctttctttttttcatgagatggagtctcactcactctgtttcccaggctggagagcagtggtgtgatcttggctcactgtaatctccatctcccaggttcaagtgattcccctgcctcagccccctgaatagctgggattacaagtgcatgccaccacacctggctaatttttctattttcagtagagacggggttttgccatgttggccaggctggtcttgaacccctggcctcaagtgatctacccacctcagcctcccaaagtgctgggattacacatgtgagccaccgctcctggcctttattgtcaaaaatttctacagtgaatatgtattcctttttaagttgagaaattataataggacaaagacagagtaaagtgtaatgacttaaactcgggctttagaggcagactcctgggtttgaatttctgcttagctagttactagctctgtgatcttaggcaagtaacctctttgggactcagctttcctgtctgtaaattaggataatgatggtacataagctgttgacctcatgtctgtgttgaggattaataaattaatccacatgaagtgctgaaaacaatgtctggtatataataaacaccccataaatgttcaatatcattgttatttgggactggacagcaattcaaaattcctatccctcatacagatcatgccaccctctctgaaattctaatgttggcaattcaatccagtatagttcattcataggacaagtatacttgactttacttaagaattgaagtgattagaagagggagcatctgaaactcagatccttctgccgtcttatatgtatacgttattctctgtgctctccagaatagtctaattgaagaaaaaaatgaggatatgctgagagccctggttatatgccataaatagctctggtttgaatgagagggaaatacaaggcagacttttaaagacagtaccttacaattttatctgtgacaggcactgaacttaaatattatgccatgaagtatgactatgaacatttatagaagtagatatgtcttggtacaaatctctgtcattcaaagatggctttcccctcgaagcaaaattgattgttttgcttcattgaacattgcaaaattggatatcttgtttactcttccatataccaaagatttataaggtacaatctattagtaaatataaaaatgagaaccgagtttcatttttaaaatacttttagacgactaatctacctagagacctacatttaattctggagaataatctataaattcttgaatagatatgtcaatgccctttatcataatcaccctagtttaaaaatcatttatcagatgcctactcaattatctacgtcgtatctttttatttcccagtataaacaaatacgcatactagggaagctcactgtgtgggatcaccagagaaattagttcatgcagtgaataattattattttttccatcggatagttaagctcaggattttcatctgtgtaacttataatgtatttctactatataacatagatgaggtcgtgttaatatgaagccctcctgcccttctgagacccaggacagtgtttggcagccttctgatgctttaatactttgaagaaaagaagtaaatattcatctaattatctggaaagttttttttttcatttcagagactcaatagcctatgtaaaatggacaccaaatcattatttcccaattaaacttttcttgctctgagcatgatagtggcatttttttaggccatccaccaaacaaagtgttgttcctcgttcctccagatgttaccatcttcttttcatgcccagggatatacaacggaatgtgtcctcaggaggtagttagaaattttgtttgcctacacttctaagtctcaaattaaaagacatcaactactggtgtatgccagtcattgcataagcacaggaatagacttaagctatttgtctaaatttccattccagggagcaacaagaaaatcataccaacagtataataaaaaggcatttgaagctcagggcatatctattgtctcctttatggcaggcttgagagaggaagatattatttggacgaggagtttacctaatatctgcgacatcactcaagcctactctaagcttttcttaaactgtcctttacttatgtagtgctgtaaagtaaaaataattaaaaaaaaacaagcattgtcttaagtggataccactgagcgtaaagcctacaaggtgtttgaatgggctgtctctcacttaagcctaataaactctgattgtattaggaaatgtagtttaataactcctgtaaaccgggagtcaacaattctgtgtcccagaaaaataaaatgaaataaaagagttggaaattattgagagctttgaacacacaatgtagtggatgaacacaggcatttcacttttgatttctatgagcagtaatttttttgttataaaaacaagaaaaaagaaaactactgtcatactcagatactcacttccctgtactagtataactcatgaggaaacaaaagctctccctatgagtaagctccagaatctatcagaaaataaatcaccttaattttcattgttattggaaagccttctgccaaatggggaagtagatgttgtactgactgaagcttcattttgtgacaacagcaacatagggtctgacttggaaggccttgaagaaggctgtaaggcctttgtaatacaggtttgcggggacaggactaacatcagtagacaagctagctgagatagagctggctttgactgatcggggctattatatttccaagatgcagcctagcctctgagtatcagaagcagcttaagtattaagggggtggtggtgctactgtagtttaaaagcagatttttaaaaaaagactttattgtgtaataatttagcattgagaaaaatagtaaatgtagctatttttttctccaggtagaactgttgaaagggacaattttaaacagccttcttcacttttagcagatataacacatagattgtccttggtgagaaaaaaggcttgatgtcaagtccagaagaaatgtgaatgtggaattgagtttgaaataaactgattcccaatgctcccattcataaaactgcatacagacctgtgtgttgagtgatgtacaatctttttgaaaattcactgatttatatcagtcattttattcctcaaactcttcttcatagcaccttccccatgcacccatacctccaggtacctggaaagggtttgtctttgtgtccatttcttgcttctgactcttgaaccaactgtataccctaagccaattgcacacatactatagagtataatggtctctggagtcaggcagaattgggcgtgatgcctgattggatcacttacagttatgtgatcctgaacaatgtaattaactttctgaacctagttttccacatatgtaaagtggagctaataatagcacctacccttgaggattattttttgcctggaggattaagcaaggtaatgtaataaagagctttgcacagtgcctagtaaacactcaaaaatagtggattctgctttcattttttgttggagtattgtaatttattcctcctcccgctcttccctctcttcctccatcatcatcatcatcatcatcatcatcatcatcatcatcatcagccaacatcacctatagaggctacctgggctacctggttacggttggtcatagactcatacctctaggccacagtttctcaaatagcagcactcttgacattttgagccggatagttcttggttggagtgggaagaggttagcctgtgccttgtaggatacttactgtaggatgctcatttaacagcatccctaccttctacatactggatgccagtagcacacatactccacacctttgtcgtcaagctatgcaaccaaaaatgtctccagacaatgtaaaatgtcctctggggagcaaaattgctcccagtcgaggaccactactctaggtattctttggcttaaaaatatccatgaaaagtatctaccattcatgtatctattactcttcattagtttgactcatttcatccagtaatcttggtctttatcttaaattctcctttagattttcagagttctctggtttttatcttgatttttgaaactaaatcttatttctctattttccttactacaaaccagcaattctttgatagccggttctgggccttaatatatctctgaactaacaacttactgttttttgctttgagctaccagcacttatctgcacacccctagtgctaggtcactggtatctagctagagcctttcctttaaatgtttttataaaaggcagttgaaatgaggactctagagccagatatcctgggttggaatcctggctcttccaattaatagcttagtgactttaacctctccattttcctccatttaagaaatgaatacattaacagtcactatttcatagagctgttgtgggacttggtggtttaaataaataaaaatttacttagaacactgtctggcatatggtaaataccatgtaagtgtaaactattattattactattctcataaagactcccatgtgtctttactagcataacataaactaaactgcaagccccatcttagtatgttatgaaacgccaggggttcagtgtagctcccattgctcacttcacagagagccaatcactgagacaatgtgtattgccagggaggaaaggctttattcaggtgctgcagcaaaggagacaggaaataaatctcaaatccgtgtctccaacaaactaaaagtgggggtttatatagcagggaaggagtgcagctatgtgcaagagaacaagaattaggagaaaggaagcaatcacgatgggtgaggggtctagtgtcttattgtttgaatgtggtgatctggtaagtttcagttccttgatagtatcagggaggcctgaagattggtttcctgaggaaggaactcagataagacaaatgtgagattcaagatttaagactgtgagggtcaatttctgtgtttattcaaaaagactataaacatcagttcttttggacaattggaccagtttcaagtgctctggaagactaccaatgttttcacctcatggtacatattgaaaattttaaatatgtattcagcaaattggagttaatcgtggtggctctgaccacttgaggactgaggtgatcaatatcttagccatgtgtaactgacttgtgacatgcagttgtccacagcactgtggtttgaaaactttgcaccaggctcatcaaaattaaaggggaaaggttttaaattgtaatccagttagaaattgtgatttcctttttggatgtgtaagatcccagcatcttctaggtccacaggccttgtaaggtctatagctgccctttagttttcttccttgaacaagctaaaataaaacaaaggcaatttctggggaatatcatgaggttttaaacatgtgtacatgtttctctctaatagttcagaatctagtaattcccacaagtataatggtatgagaatttaacccaacaatgttagagaacagcagctcttcattcaaatttcacatgatgacccactcattctattttgtaattttcttttgaaaggtttggggcagaaatagctcagatattttaaaaagagctattttctctgtttttctgtttgagtcctgtggctttcattttatggcatgagaggactgtttttcatttgtaacctctccaagtactgattttaagcaactcattaacatatgcttcctcttcataatccatcacattcaaacatttgattggtctcttcagcacaatatgaataataaactatcttcctcccagagacattcaaaattgtggtttagatatgatgaaccagaaaaaaatgttgttttttagtccactttttgaaaagtctcttagatgaaaggatactacaaatgaactttctaaggtaaatcagggctttggctaaaaaaagccaaacatttcagtcaaggtctgacttacaaagcatgctgtcagccctaccagaatatgtggcactggacacaatatacttcaatttttaatttctattgtcaatgccttcgtttatgcctttattagtttatgcctcaactttggtgatagctacatattggactgctttttctcttccaggacctcccatatgagttcttgaaacgtagctttgatagtatcatttcactccaccaaaaccttcaatggctccctaatgattgatgaataaattcctgggaatcatagaaatgctagaatgtcagtgttggaatgaatcctgaagtataattcaccagttgccaaactatggtctctggaccactgccagaagtttgcactagtcctcagtggaaagagaaaaataaggacaatgaagtcagtgttccataaaatgaaatttacttattttaaaaattatttaaaagtatcttgaggttgggcatggtggctcacgcccgtaatcccagcactttgggaggtcgaggcgggtggatcgtctgaggttggaagttcaagagcagcctgaccaacatagagaaaacccgtctccactaaaattacaaaattagccgggcatggtggtacacgcctataatcccagctaactggggaggctgaggcaggagaatcgcttgaacccaggaggcagaggttgcagtgatccaagatcatgccctcgcactccagcctgggcaacaagagcaaaactcttgtctcatgactaaaacaccaaaagcaatggcaacaaaagccaaaattgacaaatgggatctaattaaactaaagaacttctgcagaggaaaagaaactatcctcagagtgaacaggcaaactacagaatgggagaacatgttttgcaatctatccatctgacaaagggctaatatccagaatctacaaagaacttaaacaaatttaaatgaaaaaaaacaaccccatcaaaaagttgccgaaggatatgaacaggcacttctcaaaagaagacatttatgcagccaacaaacatatgaaaaaagctcatcatcactggtcattagagaaatgcaaatcaaaaccaaaatgagataccatcccacgccagttagaatggtcatcattaaaaagtcaggaaacaacacatgctagagaggatgtggagaaacaggaacacttttacactgttggtgggagtgtaaattacttcgaacattgtggaagacagtgtggcaattcctcaaggacctagaaccagaaatccagaaatacgatttgacccagcaatctcattactgggtatatatccaaaggaatataaatcattctactataaagacacatgcacacatatatttattgtgacactattcacaatagcaaagactcggaaccaacccaaatgcccatagtgatagactggataaagaaaatgtggcacatatacaccatgcaatgctatgcagctgtataaaaggatgagttcatgtcctttgcagggacatggatgaagctggaaaccatcattctcagcaaactaacacaagaacagaaaaccaaacaccacatgttctcactcttaagtgggagttgaaaaatgagaacacatggacacagggaggggaacatcacacactggggcctgtcagtgggtggggggctaggggagggatagcattaagagaaatatgtaatgtagatgacgggttgatgggtgcagcaaaccaccatggcgcatgtatacctatgtaacaaacctgcacattctgcacttgtaccccagaacttaaagtataataataataaaaaaaatcttgaactttgttttgaaatatcttttattttatatagtgacagcattaatagataataatttatttgtttattgtttttaatgtccatacttggcaaaatgaagttggcaaccatttgttgcttcacgtcccccatcccccactttttatttttattttttattttttctgagacagggtctggctctgttgtccaggctggactgcagtggcatgaactcagctcactgcaaccttcttcctcagcctcccaagtcacttggactacaggctcatgccaccacatccagctaatttaaaaaacaatttttttttctagagacagggttttgccatgttgcccaagctggtctcaaaatcctgacctcaagagatctgcctgcctcagccttacaaagtactgggattacaggcgtgagccatggcacctagctgccaccccgaactttttaaattttacaaatccatgaaatccaaaatctgaaagctactcatttcataaatgagaaaatttaaaaaagaaagattaaatgacttacctaaggccatacttatactgggaatgctgtattacaaatgttaatattagcttcaagtctttaccataaatttcaaagtcctctgtacttaaatcccagtatgcatttgcgtctctattatcagcatatcttaaaagaaaacctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgaggtggtatctcattgtggttttgatttgcatttctctgatggccagtggtgatgagcattttttcatgtgtcttttggctgcataaatgtcttcttttgagaagtgtctgttcatatccttcgcccacttgttgatggggttgtttgtttctttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgtttttgtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttttcaagcaccatttattaaatagggaatcctttccccatttcttgtttttgtcaggtttgtcaaagatcagatagttgtagatacgcggcattatttctgagggctctgttctgttccattggtctatatatctgtttaggtaccagtaccatgctgttttggttactgtaggcttgtagtatagtttgaagtcaggtagtgtgatgcctccagctttgttcttttggcttagaattgacttggcaacgcgggctcttttttggttccatatgaactttaaagtagtttttttccaattctgtgaagaaagtcattggaagcttgatggggatagcattgaatctataaattaccttgggcagtatggccattttcacgatattgcttcttcctatccatgagcatggaatgttcttccatttgtttgtatcctcttttatttcattgagcagtggtttgtggatctccttgaagaggtccttcacatcccttgtaagctggattcctaggtattttattctctttgaagcaattgtgaatgggagttcactcatgatttggctctgtgtttgtctgttattggtgtataagaatgcttgtgatttttgcacattgattttgtatcctaagactttactgaagttgcctatcagcttaaggagattttgggctgaggcgatggggttttctagatacacaatcatgtcatctgcaaacagggacaatttgacttcctcttttcctaattgaatactctttatttccttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaggtatgtcccatcaatacctaaaaataccatttgacccagccatcccattactgggtatatacccaaaggattataaatcatgctgctataaagacacatgcacacgtatgtttattgcagcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacactgcatgttctcactcataggtgggaattgaacagtgagaacacatggacacaggaaggggaacatcacacaccagtgcctgttgtggggtggggggagggggaaggatagcattaggagatatagctaatgttaaatgacgagttgatgggtgcagcacaccaacacggcacatgtgtacatatgtaacaaacctgcacattgtgcacatgtaccctaaaacttaaagtataatacaaaaaaagaaaacctatattctaaacagtcatgatcattttccattccttaaatgtgccttgcagttgttctttaccctacctattctcctaaaatcccacccagctcaagtgctgactctattaccatacctcaatgtcagaagggatcctttgcttttctgtgcttccatatgtggatgctacttatcagcatattatgtcttgttcaacctgtcatcgtctgtggactattccccctcctatgctctccatttcagtaaatgacattaccctctacccaattgctcaagctggaggccttgaagtcattcctttctgttccctataccaatattgagttaatcacaaagccctgtcatctttagctccccaatttatcctgtatatgtccactttaattcttccactgaactgctacacagatcaccctgtgtctccttgttccaccatgcaatccattttttacctaccggccgcttttagatctggtactgctccttgtaaaatcctttggtggttttccatagccctcagattaaagcctagaatgtcaacatgttaatacaagatatgtggtacccatgcccacttctccagcctcatctcttcctactttttaatttgcgtcctttgctttagctgtactggatttcagttccttgaatgcatctgtctcactattgcatgcttttgcttgccgattttaattgcctctcacttctctggatcttcacacatgctatggagtgaagcctacactgcctgcaatactcttccttctaggaaacataccttaaggctctaagtttcagtttgggtgcgccgtagcagagtacctttcctttaccatagcactcaccacattatattgcaatttcttgtttaactgatttcctttctaactagactatatgaaccatgaggccatggatcatctttatgttgctcaccattgcattcaaactgtcagctctggcacatagtaggtactcaataaatgtaatctgtatgaatcaaaatatcatactacatttcctcttatactgttgagactttcatatttgtggtatttccttgattctattacaaattcctataagtggaaggcagtcttttataattactaccattttatagcaccacacacataggctgctggtaaatatttgataaatagatgaataatctatttttttcttacagggtcgcgggtaagaattagagtgcatatttgtaataaacatagaatgcagcacaacaaaataggctatacaatctaagaagtttggactaatactagtattgattgtttatagcctaaaaggtgccccccaccaccgtaaaatacctgctttaaattgggaaatactctatggtttcatcaaggttaaatacgattttacaaatagggattctgatacatttcaagggtaataaaaaatgtaaaaatcttaaaatgacttgtgatgccttgactgctgtggggtgtgtgtgtatgtgtgtgtgtatgtgtgtgtgtgtgtgtgtgtggtttgtttcttgggggctgaactcagctggagtttccatgaagttatgggtagggtgatagatttacattgaaatatttcactttatccaaaagttagttcagtttttcttaatgggagattttttcaattgagaatatatttttgcacttcatgtttattgattctctttccaacatccagaacatacagcaatatcatcagtcatagatagttcatattgcacataatgggctctaatatcagtctgtttgtatatatcataatacctgaattgttcaacaaaatatctcataaggcaggaagcttcttttctgttttctgtttttgatagactcaacctaaatggataatgttctttgtaaaaggtgagcaaaacatcagcactggtgatatttattttacaggatgtgccacaagcctggctcactcctcttacttagaagggcattacctgctgagaccatttggatttgttgagtccagtgcaaactgaaacagtgacctatgtgaatgacagccaggtaaatgtcagaggacaatgccaaaaagacatattaagttcaggagttgaaattgtggtaagcattagtgcccatcctcaaagaagtcttctctgactttcctgtgcaaggcagtttcctcgctccccaatttatgatgctatatcaaactcaacaaaccttggtaatggattgaatgatgtgggtgaaggaacagaaggaagaatcaagaatgtcttggccctaggattattatctggctcacggtaagctctaaataaatatctgttgaaagaaaaaatagctgggaataatacacattttgtcaccctcagccacactatgcagactataaaattgatgcttgtttacatcattaggtggccatatttacattaaaaccacagttttaagagccaaaaaatcctgggttcaaatcctgacttcaccatttgagctatgagacattaggagagttacttaactgagtctttctttctcttcttataaaaaggaaatcatctcataccaccctcacaagatgatggtgaagattagatgagataatacatttatcgtacttagaagaatacctggcagaaagtattcgtagagggtagttatcattgttgtcagaatgtaatgtacttaagtgtcttgaaaatagtaaatattcaataattgttatctaaaagtattataattatcactaccataatagttttatagtaaattattttcagtagaatgcttatggtgacaaaaattacactttttcatattattgcacacaaatttttagtcttaatttcagtaattgttatttcttaaaatatttggtatagacatgggatatctttttatttaaatcaataaagggaatggttgttgctcttataatttatgcaaattgttcataaatgaataaattaaagcatttatttgtactaactctggtagtttgctaaaaaaaaaatcaggacaggctaaaagaagatatggatataacggctgcattgtttttgctttttttgataaaccatatttcaaattcattcacagacattttcgctttcatgaatccaagatatcttctctagtttctaaaagtatatatacacatatacacacacaaggtatacatatactcacacattcacaatattaaaatgtttgggctaggtgtggtggctcatacctgtaattccagtaatttgggaggccaaggcatgaggagctagaggaggctgagttgataggattgcttgagcccaagagtttgaggctgcagtgagctatgattgcaccactgcactccagcacctggatgacagagcaatatcctatttctaaaaaaaaaaaaaaaaaaaaaaaaaaaaagtttgctgcctgctgctgcctaggaccacaatggagaatggagaatagttgaagaaagtgcagtacagaagtttaggcaagtggtaattgttgttggtatccatagattgagccaatgcaaatttgcaggctttagaaagatacctctgctgttctccagatttattttctaatttcaccttatatgttttttttcctacacgtttttcttttactgtctcataaattttatgtcagtatgctatgactggatatttaggaggaaacaaaattgcattgttaaaaagttcagtctttttttttttttttcttgaaaatgagctgctaactgggcacagtggctcacgcctgtaatcccagcactctggaaggccgaggcaggcaggtcacttgagctcaggagttcaagaccagcatggtgaacatagtaaaaccttatctctacaaaaaatacaaaaattagcttggcattttcccacatgcctgtagtcacagctactcaagacgatgaggtggaaggactgcttgagctgggtggtcgaggctgcagtgagctgtgttcacaccactgcactccagcctgggcaatagagtgagaccctgtctcaaaaaaaaaaaacacaacaacaaacaaaaaaaaaaaaagaaaaagaaaatgggttgctttttaatgctatggttagtggttagcaaaccaatagcatcaatccagaatcttcatcgaataactatggtgtgtcgcattctaagggagtaaatggagtaagtatgagactttggctctgtaaggaagtaagaaaagtgaaagacaaaattgagcagaagtagaagctgaccgataatgtagttgctacggcctcagcagatcttacagggagatctggagttaggatgggtctctggatgattatcccaaattgaaacaagggggctaggcttttgaattccttcatcaggcagtctttggccatacgccactccctgctaaggtgttacctttgggcatacagctccttatagccaaggacaattcccattgttgtggctctagctgcaaggattggtaacttgatattctcaacagttgtgggataggtgcattggcccctaaagaacctacccttgaccaagcaccagagcatttactataaggcattgcaacttgaactgccctttaaaggctggatagaatttaagtagatgtagaggagaattgacatatatgcattcctgggtggggaatggtatgggaaaggacaggctgtactggagacagcaaataaatcagattttaattcagcttatatttattgaattactactttgtaaaggtactatgttgtgctgggaattttcataatgtggtacctcatttaattgttataaccctttgatttaaatattatttccattttatatatgaggaaaatgtatctcagcatggttatgaattgcccaaagtcacccatgaaaacagtattagagctggcactcaaatccaagtttcctagctctaaagactctgctttttctgctacaccatgttcatatgtctaaaaatggaaaattacacttacaaatggtggcagtagattatggagagtctataggatacattctggttcttggtcccatactttattgttttggtctctagttgtctcagaaattaactgtaatttaataataataataatacatttagtaatagtagttttaattaccattggttatcgttcaccaatactatgttaaatttactcactctttctctgtggattattgcattgagtctttactgtaaatctgaaaaaggtagtattgtttttattttatgtatgaggtaactgaaacttagaaattgtccacgatcacatagcaagaatgtgacagagctgacattagaacccaggtctctctgactcctaaagtccatgattttaagcactacattttaagcctacctctttgtatgttttatagtcctttatacatcaccgagcacatggttttgtgctattactatacttaactattacttatcaccttagcaacttgggataagtaattttgtctgtctgcttcagtgtctaaaatttttactcaagtgaagcaatacctacccatggctaatgggaatactatatgagaccagagagtgaagcagtgaactcaaaaaaatgggcttatacctgatttctttcaggctctaggcctatgtcaattggattgattttattcattgtttcatgcctactcttcatccatcctttattacaacaaatatttattgagtcttactgtgtgcctgtcactgttctagatggtgaaaaaaaggcaaagtcctgtcctcatagagtgtacgttctagagagtgagacagttgattcactactaaatatataaataaataataactcaagatagtaataggtgctctggaaaaaaattaaagcctggaagagaatgggaagtggcatagggtggggaagggggctgataatttagatagggtggtcaggagaggctttttgataagatgatataaaagtagagacctgtgggaagaaaagtaagccatacagatattttgaggaatagtgttataggcagagaaagtgaataacaagtgtgaaagcccaggggtaggagcttgactggcatgtttgagagccaccaagatccaattaatgatatgttattataatattttgccaaatgactcaccagtgatataaaagatttaaaagccgtttccaaagtatttccctgtagagcagatttggaatgtgatgaaagagggaacaggaccaatgggaaaatattaaagtgtttgaagccaactcatcaggatgaaataaatgagatgggctatttaatgattatctatagcagttccatataaggtttttataaagaagcagtggaatagccttctaaagactaagctcttccctttctcttaggaggtaggtacgaattagaaaattaatcaagagagaatgtggcctctgatgacatgagagttgtttgaaggtggcaggaggcaggagggtggttgcattcagtcaatagttgagcaatttacaaaaataaatagaattgagcaaattcagaacagatttaatctccattttattttcaagctaaacaaaagatgctgatataagggggaaattactccaaaaatccagctttactgacatattttgagtcatttgcatgaataaaatggtcctagagacaagtgcgaacttgactttaaagtgaataggcctggaagtgttttctgacggagaattagtttggtgcattcattcaatatttattgatataatatttatattcatgttattccaaaaaagagttgaagcagattgcaaagctatgtatataatccacaatacaaaaactaagagatgaaatcaggaggaaataataagaataggagaaataagataaggtcaagtttgggtaaaataaatgtctaaactgtatgtcgtagttagagacaggccacacacatttagctctgagatttctagaaacaactgaaagagtcctggaaactgagataatagacttgtattgtgttaagccactaaactctctttcaaaccattccttagttctcaagggaagacatgaggatgggataaacctccaggggaattggggtactaactttcataaagatttttacttcttgaagaggacttaatttcaagtctatgtagaagcagaataaatgggttatgtgattgtttaaggttgctgaaagatctttccttatatgtagaaacctgtattggcttttgagctacttgaatgtagcaaactaaatattctggaataggatctgtcatcctctacatgggacgctcttttgtatgatacccatccactcttttgcactttgaacatttcaggcctttactgagtatgtaattactgactgctaaacaattatgtcatttgctgaattcctttatcaccagacacataatcatcagttcaaaaacaattaggcaagattctcattgatcttcagaatgtccttaaagcttttcaacttataattaacacatatacttgtcttctttcctttagcacacgtgaaacagaatagtgttcctgctgtaggattttcatcatttgccaatcttcactgtaatccttgaaaatgtgaaggtggatggatgcattttactttacaattcagtgtgataaaacccacagctgctgttcaaagttctatttaatttagaagggaaaggactacttttatcgtgcaggagattgattgaattatataattctctcaaataaggtagataataaaattttaagatatattttacaatttcactattatatactacctagaaggctagctatttttattccttcacagcctgagggggtaggaagttttataaactccacgcccgccccccaaagactacaggttctatcctcaacaataaaggaccctacagtgttatcagtgagagaaattattctgactaagcaggtctgttatttcactaaaatatcgcttatgccttctaatctcaacattccagaaaatgtatttaaaaaacaggcaggctatcagtaaaaaagaaaaccaaaaataaatctaaatattttgttcagttaatgatcagtgtgatttatttatttttattgtatatatttgtagggaataatgtgatattttgatctatgtgtatattgtagaaagagtctatcaagttaacatatccattttatgtttttgtggtgagaatgttaacaatctattgttttagtaactttagaatatacattattattaactgtggttatcatgcagtgcaatagatcaataaaacttatctttccagtctaacagaaactttgtaccctttgagcaacatctccctttgtcttatcccttttcctcccctctcctttaccctctggtaaccacctttctattctctgtttctatgagattagcttttttagatttcacatatgagtgagggcatgcagtatttgtctttttgtgtctggcttatttcacttagaataataccctccagattaatctatgttgtcacaaatgacagaatatcctcattttttaaggctgtatagtattgcattatgtatatgtgtgtataaatgttatatacatgtgtttatatatatgtgtgtatatatatataatatatatatatatatataatatatatatatatatatatattcttcattcattcattgatgaacacttaggttgcttccatatcattgctattataaataatgcagcaatgaacaagggaatgcagatatcgctttgacatactgattacaattttttttggaggtatgcccagaagtgagattgttgtatcatatggtaattctagtttagttttttgaggaacctctatgctactttccaaaatggctgtaataatttacattcccaccaacagtataaaagggttcttttttctccatatctttgccaacacttgttagcattcatctttttgataatagccattctaacagttgtgaagtgatacctcattatgaatttaatttttatttctctgataattagaaattttgagcatattttttatatatctcttggccattcatatctcttcttttaagaaatatatatttagatcctttgcccaattttttaaacctggtgatttgtttccttgctattgagttatttgggttccttatatgtttttgatattagccccttatcagatgtattgtttgcaaatattttctcccaatccatgggttatcacttcactctgtttcttttgctgtgcaaattctttttagtttgatgcaatctaatatatttttgctcttgttgcctatgcttttgtagttctattcaagaaatcattggagcttttccctgtgttttcttatagcggctttacagttacaggtcttacgtttaagtcttttatccattttgatttgatttttgtttatgatggaagataggggtccaatttcgttcttctacctgtggctattcagttttcccaacacaatttattgaagagactattcttccccgttgtatgttcttggcacctatatcaaaaattaattcactataaatacttgattttatttctgtgctttctgtccttttccattggtcaatgtatctctttttatgccagtacaatgctgttttgattacaatagctttatagtatattttgaaatcaggcagcatgatgcctccagattttttctttatgctagagattgctttggctctttggggtttttttctggttccatatgaattttaggattgttttttctatttttgtgaaaaaatgatgttagaaatttgatagggattacactgaatctttagatcactttgggtattacaggtgttttaataatattccttcaatctgtacagggtatatttttccatttatttgtgtctccctcaattttttaatcaatgttttacaattttcagtgtgcagatacttcacctccttggataaatttactcctaattacttttttgatgttcttgtaaatgacgttttaaaaaaaatcagatagctcattgttaatgtacagaaatgctacttattttgtatgttgatttggttatgtgcaactttactgaatttctttattgattctaatagttttttgtggaatctttagggtttttctacgtataacatcatgtcatcagcaaacagagacagtttcactttttccttacctatatggatgcattttatttctttttcttgcctaattgctttagctaggacttccagtactatgtagaatataaaaggcaagagtgtacatccttgtcttgttcctgctcatcaaagaaaagattttaacctttcttgttgagtatgatgttagctataggcttgacatatatggcctttattgtgttgaggtacattccttctataccaatttttctgagggtttttattatgaacagatgttgagtgttattgcaggctttttctgcatctattgagatgatcatgtggtttttgtccttcattttgttaatataatatatcacatttattgatttacatatgttgatgtatccttgcattcttaggatagatcctgcttgatcatggtgagtggtctttttaatgtgctgttcagttcaatttgctactacattgttcaggctttttgcttctatgttcattaggaatattggcctgtagttttgttttcttgtgtccttgtctggctttgaaatcagggtgatggtgttcttataaaataactttgggagtattccctcctcttaaatttttttgggggagagtttgagaaagattggtattagttatctaaatatttggtagaattcagcagcaaaaccaacagactcttggcttttctttaatgggagattttttattagtgattcaatatccgtactcagtaatgatctttttagatattctgtttcttcttgatatggtcttagcagggtacatgattctaggaaatcatccagtctttttaggttatctaatttgttgatgtatagtttgtcatagtagtttattatcttcctttttattttgtggtatcaattgtaatgtctcctcttttatttaggattttgtttgtattttctcttttttaattcttttttgagacagtattgctctgtcacccaggctggagtgcagtggcatgatcttgactcattgcagtctctgcctcctgggttcaagcgattctcgtgcttcagcctcttgagtagctgggactacaggtgcacaccaccagacctggctaatttctttctttttttttttttgaaacagagtttcactcttgttgcccaggctggagtgcaatggcacagtctcgcctcactgcaacctccacctcctgggttcaagcaatccgcctgcctcagcttcctaagtaactgggattacaggcgcctgccatcacgcctggctaatttttgtatttttagtgagatggggttttataatattgtccaggctggtctcgaactcctaacctcaagtgatctgcccacctcagcctcctaaagtacagggattacgggcatgagtcagtgtgcccggcctgtgtcttctcttttttctttgttagtctagctaaagttatgtcagttttgtttatcttttcaaaaacacaacttttagtattgttggtctctttttctagtttcttattttttttccttctctgatctttattattttcttctttctgctaagtttgggcttagtgtatgattttttctaatttcataggttgtttatttaaaatttttatttttttaagtcaggtttttgtcactttgaacttccctcttaaaactgcttttgctgcattccataaagcttgctgtgttgttttcattttctttatctcaagatattttttatttttatttttatttcttcttcaacccattggttgttcagaagtatgttgtctaatttccacatatgtgtgcattttctaagattcatccttttattgatttctagttttatgccattgtagtcggaaaagatactcaatatgatttcagtcttcttaaatttgttaaaatttgttttatggcctaacagattatctgtcctggaatgcttcgtgtgtacttgagaggaatgtgtattttgttcctgttgggtgaactagtctgtaaatatctattaggtgtttttgtctaaagtctagttcaaatccaatgttttcttattgattatctgtctagatgatctgtccaaaattgaaactggggtgcttaagtcttctgctattattgaattataatttatctctccatttagttctatatttgcttgattagttgccctgatgttggacatatatatacttgcaattgttatgacttcttgatgaatttacccctttattattatttaatgaccttctttatctctttttacagattttgacttaacatccacattatctaatataaatatagttaccctgctcccctttgctttttatttctatggaatatcttttcagtaccttcactttgagtctatatgtgtctttagagataaagtgagtgtcttgtaggcagcatgtagttagttcttgttttttatatccattcagtcacatagtgtcttttgattggagaatttaattcatttaaacttaagtccttacctatcaataattacctattactatttacttacctattggcatttgttaattgttttcttgttaatttgcagatcctttgttctttttttcctctcttgatatcttcctttgtggtttaatgattttctttaatggtttaccttgaatcatttctttttgcattttgtgtatctactaagaatttttcattatggctaacatggggcttatataaataatcttaaaacatgttatactaataacagaatattttaagctggtgacaacttaactttgaacacttgcacacactctacgttttatgccttcccacactttgtttttcatgacacattttgtatcttttatagtttatatcccttaacaaatgattgtatctatggttgtttataatagttttatcttttaactttcatagtagatataattgattttcacaccatcatttcagtataagaatgttcttagtttgactatgtatttacttttaccagtcagttttattttttcatatattttcatgttgctacttagcaacattttccattggcttgaaggaattcttttagtatttcttatgaggtggtctagtggtgataaattatcttagcttttgattgtctgagaaagtttttttttaatctccccttcatttttgaaggacaagattgcagggtgctatggtttgagtttgtctcctctgaaacttgtgttgaaatttgatccctaatgtgttggtgttgagaaataaggcccagtgggaggtttttgggtcgtggggacacatccctcttaaataaattaatgtccttctctggcaggaatttctcactctcataggagtagattagttcctaagagagaaggttatttaaaaaaatctggcttccttggtttctctctcttgcatcctgtcttgccatatgatctctttgcatgtgtctattttatttctgctttctgccataagtggaagcagcctgaggcccttaccaaattcaacaacccaattctggacttcctaagcaccaaaattgtgaaccaaataaacttactttcttcataaattacccagtctcaggttatagcaacactaaatagattaagacactgggtatagtattgttagttggcatattttttctttcagctttatgaatatatcattctattccctctggcctgcaggggttctgttgaaaaaatctgctggtaatcttagagaagtttctctgtatataacaattcactttttctttgcagctttcaatattctacctttgtctttaacctttgacagtttaattattaagtgttttggtgtgagtttctttgaattcatcctattatagatgactgttaagcttactgaatctgaatttctattttcttcctcacacttgggaagttttctgccatgatttctttgaatatatttttctgttcctttctctcctccttcgggtacactgaaaatgtgtatcatattctgtatgatggtgtcccataaatcccttgggctgtctttaatcttttttattcttttccctttttgcttctcagattggatatttaccagtgacctgtcttcctgtcttcttctgcttgatcaagtctgatgttgaacctcttgttggattgtttcatttagttaatatattcttttgctcaattattcatgtttgatactttttaatattttctgtcactttgttaaagttctcaatttgatcatgcattgctctccttaattcagtgagcatctttatgatgatccttttgattttcctgtcaggtaaatcacatatctccatttcattaaggtctacttttggagatatatcttgttcattaatttgaaaaacatctctctatttcttcattttacttgactctctgatactttctgtgaattagataaaaattctcctctctcagtcttattagactggtctcatggaggagatatttctcaccaatcagcccacccagagattcttagtgcctctaaattccttgtgcttgtccaacctgctgttattcttcttattggattcccccaaattagacagtgtcaagtcatgttattgccttgagtaaggtgagattgaagccagtcctttgagatacagctggagaggttggggtgttagatgtgtgttccagcttttcctttccttgcagagaagctgggggctagattttatctcacatttattctgccgtaaccaaagtggagggtctgagacatatgactgtattcttgatcagactgctcattttgaacctggggagatagctgctgaatgtttgtaattttaaaagtcatctttttgttttctgtagtttaggagactcaggactgcacagacccaacaacttctagagctatttgatttaggagtgagttgctggtaagggctataaaagttgagatgctctatctgtgccaaatctacttccatggagagtctgaaaacctggatttattgctggagcaagccagggaagaatgtgtggggcatgaccactctcctgttagagcaagcagaatattcatttcaaaagtggtaaactgaccatatacaggtccatatatctattctgttttaaaattttcactagttgccatcatttaagcagctaagactaacataaaaatctgtttagcttcactttaattcccttataccaataacatctagaactgagtagcaaccatgccttttcaaaagggaatatattttccaggttatgcaagtcactactcttccctattttcttacaccttggcccattcatttaattatattgccagcctgacttctatagcagataagttggggaactcttgttattttgcaagagataaatatttattttatcttattttttagacttttaggttcaggggtgcacatgcaaatttgttacataggcaaattgcatatcatgggggtttggtgtacagattattttgtcacccaggttatgagcatagtacccaatacgtactttttctatcctaaccctcctcccaccctccaccatcaaataggccctggtgtctattgttccctttttttgtgtccatgtgtacaaatttttagctccatcttgtaagtgagaacatgtggtatttggttttcttttcttgtattaatttacttaggataatggcctccagccccatccatgttcctgcaaatgacatgatataattcttttttcatgggtgcgtagtattctatggtgtatatgtaacacattttctttacctagtctaccattgataggtacttaggttgattccatgtctttgctcttgtgaacagtgctgcaatgaacatatacatgcatgtgtctttatggcagaatgatttatatttctttaggtatatacccaataatgggattgctgggtcaaatggtagttctcttttaagttatttgagaaatcaccaaactgctttccacatggctgaacatggctttccacgtgggatttacattcccaccagcagagtataagtgttccctcttcactgcagccttgcaagcacctgttgttttttgactttttaataatagtcattctgactggtgtgagatgttatcttattgtggttttgatgtacatttatctaatgactagtgatattgatcatcttttatgtttgttggctgcatgtatgtcttcttttgaaaaatgtctgttcatgtcttttgcccactttttaatgggcttgttttttgttaatttattcaagttctttatagattctggacattagacctttgtcagatgcacagtttgcaaatacttcctcccattatgtaggttgtctctttattgtattgacaatttcttttgctgtgaagaagttctttagtttagttaagtcccatttgtcaaattttatcttcattgcaattgcttttgatgtcttcatcatgaaatctttgcaagggctgatgtccagaatggtatttcctaggttttcttctatagtttttatagttttatgatgttacatttaaatctttaatccatctcgagttgatttttatatatcgtaaaaggaatgggtccagtttcaatccactgcataaggctagccagttatccctattttgaaaaaattagaagacaaaagtaaggaacaaaaaattaccatctatagacctaccactcagagtcagccaaacttcatatttggtatatatttttcagttcattctttcagatagatcagtaggtaggtatgtaaacagccagccaaccagatatgtttagaatatttttatgctaatgatgatagatcaatattatttattatttttcttatttcaatgaagacagattgttcagagaatgaggttttaagttacttttatagtaaactgagagatgaacacaaacaccatttgttttaatgctttgcatggaaagatccttcaaatatgccattataatttttggtgcaataaaccagtgatgaagattcaagtagactagtctagactaggatatttaaaatccttatggtccttgatatctgagatgatatcccgttcagggaatggaagtagttgaggaaggtataatagattggtactgaattcaggatgacccctaaatcttgaagcttcacataaattcatttctcttcatgcctcctgagctggaattctctccatagcatcattttcacaggtttttaagttcatacttgaatgcctctaacaacagaagacttattacctcttaagctacaacctgtcctttttaaccaactattaaaaaggtcttttaggttaggcacagtggctcacgactgtaatcccagcactttgggaggccgaggtgggcagatcacttgagtccaggagtttgggaccagcctggccaacgtggtgaaaccccatctctactaaaaatataaaaattagccaggcatggtggtgcatgcctgtaatcccagctactttagagaccgaggcaggagaattgcttgaacccaggaggcggaggttgcagtgagccaagattgcaccactgcactccagcctaggcgacagagtgagaccctatctcaaaaaaaaaaaaaaagtcttttaatcagcttaaatgtgggttcctaaaactttttaatgtttaagttcaggggtacatgtgcagttttgttaataggtaaacttgtgtcatggggtttgttgtacggattatttcttcacccaggtattaagcctaatatccattggtcatttttcctgatcctttccatgctcccaacctccaccctccggtaggccccagcatctgttgttcccctccacatgtccatgtattctcattatttagctcccacttataagtgagaacatgtggtatttggttttcagttcctgcattagtttgctaaggataatggcctccagctccatccatgttcctgtaaagcatgatttcattcttttttatggctgcatagtattccatgatatatatgtaccataatatggctgcatagtattccatgatatatatgtaccacatttgctttatcccttctaccattgatgggcatttaggtttattccatttctgtgctattgcaaatagtgctgcaattaacatatgtttgcatgtgtctttatgatagaacaatttatattcctttgggtatatacccagtaatgggattgctgcgatgaatggtagttctgtttttaggtctttgagtaagtgtcacactgttttccacaacagctaaactaatttacattcccaccaatggtgtataagcattcctttttcttcataatcttgccagcatctgttattttttgactttttaatagtagacattctaactggtatgagatgaaatcacattgtggttttgacctgcatttctctaatgatcagtgatactgagcttttttttcatacagttgttggctgcatgtatgtctttggagaagtgtctgtccatgtcctttgcccactttttaatggggttgcttgtttttttcttgcagatttgtttaagttccttatagatgctggatattagccttttctttgatacacagtttgcaaaaattttctcccattccttaggttgtctgtttactctgttgatagtttctttcactgtgaagaagctctttagtttaattagatctcatttgtcaattttttcttttggtgcaattacttttggcatctttgtcatgaaatctttgctcgtttctgtgtccagaatggtattgcctaagttgtcttccatggttttcatagttttaggttttctatttaagtctttaacccatcttgagttgatttttgtatatagtataaggaaggggtccagttttaatattctgcatatggcttgccggttatcccagcaccatttgtcaacaataaatgagtagggagtcctttccccattgcttgcttttgtcagctttgttaaagaacagatggctggtctgggcgcagtggctcactcctataatcccagcacattgggaggctgaggtgggcagatcacttgaggccaggagttcaagaccagcctggccatcctggtgaaaccccgtctctactaaaaatagaaaaattagccaggcatagtagcacacacctgtaatcccagctacttgggaggctgaggtatgagaattgcttgaacccaggaggcagaggttgcagttaaccaagatcacaccactgcactttagactgggcaacaagagcaagactgtcaaaaaaaaaaaaaaaaaaaaagaaagaaagagcagatggctgtaggtgtgtggcctctattctgtttcactggtctatgtgtctcgttttgtactagtaccatgctgttttggttactgtagtcctgtagtatagtttgaagtcaagtagtgtgatgtctccagctttgttctttttgtttaggatttccttggctattcgggcccttttttggtttcgtatgagttttaaaatagtttttttattctaattctgtgaagaatatcattggtagtttgatagaaatagcattgactctgtagattgctttgggcaggatggccattttaatgatattgattcttcctatccgtgaacatggaatgttttccattttttttgtgtcatccctgatttgtttgagtagtattttgcagttctcattatagagatcttacacctccctggatagctgtatccctaggtattttattcttttgaggcaattgtcaatgagattgtattcctgatttggcttttggcttggttgttgttggagtataagaattctaggccaggcacggtggcttatgcctgtaatgccagcactttgggaggccaaggcgggtggatcacgaggtcaggagatcgagaccatcctggctaacacggtgaaaccctgtctctactaaaaatacaaaaaattagccgggcgcggtggtgggcacctgtagtcccagctacttgggaggctgaggcaggagaatggcgtgaacccggtagacggagcttgcagcgagcctagatggcgccactgcactccagcctgggtgacagcgagactccatctcaaaaaaaaaaaaaaaaaaaaagaattctagtgattttttaccctgagacttcactgaagttatcagcctaaggagcttttgggctaagtgtataaggttttctagatataaaatcataccacctgcaaacagggagagttcaacttcctctcttcctatttggatgctctttatttctttctcttgcctaattgctctgccctataaaagtactccatcttgacagagtcagagtccctaggccagtcagacttttgccaggtatcctaaagaacaacaatctgagctgggcatggtggctcatacctgtaatcccagcactttgggaggctgaggcagctggatcacgaggtcaggagatcaagaccagcctggccaacatggtgaaaccccgtctctactaaaaacacaaaaaattagctggacgtggtggcacgtgcctgtagtcccagctgctcaggaggctgaggcaggagaatcacttgaatctgggaggcggaggttgcagtgagccgagattgcgccactgcactccagcatgggcgacagagcgagacctgtctcaaaaacaaacaaacaaacaatcaacaacaacaaaaaaaccctgtacctgctatatttttcaggctgtttcagaaaaaggcaaaagtaataattcattacttgaaactagacttgactttctgggaattggttaacttgtttgaagaaaatatattaaacatttattgcctcattgcttgctttcaagatatttttctatgccttcatttatgagaagctggctcagtttgttgaaatccatcaatgatttgaactataacattcataatgttctttataacccagaacttgattacataatggtatttattgttctctagttttttcatgtgcacaagtcttgtcctgccaactgtttcgtaagtttttcaaaaccaaagctcatgtcttctacttatttcatggttttcctttcctcacaatatctagtacagtaagcacttaataattatttcttaacaaaacaagatctgcatgtgggctgtgtagcttggctcaattcttacattccagtttgtgccattaaccccaactagctttctaggaagacttgtcacatggggcctgggcaacgaagattagatgattaagaaaagccaggcttcattgctgcacagaaaaactgaaggtcctatgctactgctcagatgtgagtatctcagttcatacagatgatatacttattgaggctagttggtcccagtaaatttagagttctgcatgtatccttaacatgctctttgtgaaccattgacaaggcattcacaaattaggccaagtgctcccccaagtcatggtttacatgtttgctttgagagatttacttttccttctggcaagtattcttccctcttcctcctgtaagaaatatgaaacttgtctctggtcatgaaggttttatattaacctattttttaatacttactggggaaaatccctttttctgctgctgctgctttgattggctgaaaaatggcagctaccttactctggagcttctaagtctgcttctcagcatttctcaaatatctgagactttgttgttcttcatagtaaaagataaacccttagactctttttttatttttcagaaattatcactattctaaaagagccactgagttcctagtctggatattttaaataaatatgtatttctgttattcttttccaagtcatgtcagcataataggagtaggtgtatgcaaggaaaactagttattgattaaagaggattttgaagtggtctaattgtcctttttaatgatatcaacctataggaaattcctaaagtgaaatttgaagtaattttgtcttattgaacaatctgtatgttgattgtcaatcagtggacaaaattaccaaatcagctatgccattcatcatttgacacattaatttattacttttttcagttaaacagctttataaattcaaaaacaaatgcatatatacagtgaataaaatgtttgagcagcataaacattgcaggtaacaaaagtaattccatcttctgccccacactgtcagtcctgctttgagaggcaaccactcttaacagattttttgtataaactttccccaaatttctatagttacacaagcttagaggatgtgtctgtgttgtctatacattttttcttttacacaaatgggggcaaacttgatattaagttctacattttgtgttttctcctcttcgtaatgtgttttagagatttcatattagcatagattgatctaatcatttcttcaaattgctgcctgtaatttcattacatgggtattccataatttatttttgtcagacccttccccaaattgatgaatatttaggggtatgtgtgcatgtgtgtgtgtctgtgtgtgtgtgtgtgtgtgtgtgtatgtgtgtgtgtgagagagagagagagatgaatactgagataatcttaagtatttaattgctctatacctaaatttgccaaacagactggatttcctgtttgttaatctgatctttttcttggtatttgaaagtcatgctagttagaaaaaaaatcagtaattttaattctgtacatatttatgaaggtttatgctgcatccagcactttgctagatactattggatataagaaagttataagacaaagtttctgcccatacatatttttctctgtagtttagaagaccaggtttactcatgtaaaataattagtgaatcatatgagatagagtaccatgaaaaagaaactccaatgtgaacttacttaggtactcattataaataggcaggctcccatcatagcagtaaactgtgtgtgtaggccagttgaagaataccacacttggaaaatagactgctttggggagatatttgaggtttaacctaaactcaaacttgaagaccatttgaagactatgaaaacgctttcctcccagataaatgactataaaaagtaagcaaatctggaattaaaatcttacaaattgaaataatatttctctataacaaggccattttgccatcaaaaaatggaataacagtctctccaaagtgtgcatatatgagcttatctacactgtatagatacagtagcataactactctaattagttttcaaaaggacattctccttgtttcatggaaactattggatgataacaaatagtctgtacttcagagaagcaaaggagaaaaaaatagcagaataggctgatgtcagttaattgttaatatatgaggtttgaggtagaaggtagattcttgaagtttgaaatattttacatgaaaactgagagggtaaaagtttgagagacatagatcaccattttcactttatgaagaatgctgtcttttatttacgcctttcagcttatatttctaagctagcaatttaaggacttatgaaagatggaagaggtatagattagaatccaatattttggtgggtcataggcttgtatgattcttccttgtgctaatacaatcatttaagcagaatgatatggtgataaaagctaataaaatacatttagggaaaagcatgctgtgttggatattcagaatttgaggaaatgtgttgtgataacagaatgagtgagcagctttcatagagtacatgcagttaagatgaaagcagggattgagaaaaaaatgttttttctgaaacagattttgtacctaaactgaaaaacatttagtgacgtacacttttccttccaaataaatatttcagtcagccatttaccttctattctctgtaacatgttcactaactaggagcatgttctctcacatttaataaagtaaaaaatgcatcagcttttcaatgttttccccaactttctattctatttaacaaatatttcttgaatagctactatgtgcggagcatcacaatagacattgtatgggatgcaaagtcaagagtgaggccactggtcttagaatcaggaaacttgccttctaatcctatttttgccagttacttgtatgacctagagattcacttctcattttagagccaaagtcctggatttaatgatgtctgaggtctttttcagctatattgtaatccaacctaatgagtaaaaccatttgtttcccctaaaactttacagtattctatggggggtcgaaactattacagaaataactatgaaagaaagcagaatgttatcggtaatttcaagagagagttacaaagtgatgtaggccattaatagcttcatggagggagtgaccttgagggattaggttttgataggcagaaataggggtcataagaacaactctgttcctattgtgggctttctccatcctggatattactcagaatttgtcagtggcaaaacaaaagtagtagaaagttagcctttgaaggatttttatcagtctgtttccgaactagccaatgagtgtagattggagctgtaagcaatgaagtaaaagtaaaagagatgaacatgaaacatagggaggggtcatagaaatggaatttcttcacaaatgctaatagcaactatcccttacatttgtataatggttaaaaatccaggatatgagggtatgacagagctgttaagagcatggccgaatatgctcctaacatggactaaaccagacctgggtttctatccctgctctgacatttaccagtggtagaaccttgtacagtcacttagcctgttgcacctcagtttcatcatttgtaaagtggagataacaactactccatgagatggctgtaagattaaaataagattgtgtatttaaagcagttatcaaaaggactgacacatagaacttactcaaaaagggtagctaggaggtagtatgtcaggtattgttctttcctttcaacagaaagtcaaaactggggctctgagattctgaatcatttattagaatccagtattctttctattacaagagtgactcctaacctgagttttctgcccacaccctatccctggggggcatctgtgaaggtaataatgagaatctatgagttattttcaatatttgaaagaagcctaacagagagcattaatttactcgtgataaattacacaacctgactaatatgtcaagtttctttgcttttgcctgaaattatatcaactcattttggtaatactggctatctcatgctgatgggaaactgattggcagctatatatgcctttgatgaatagaaatgaggaaaacgaattttatatcataaatgcagttgatctgggagatattcttttcagcttgggagaacatagagaaaaataaaatgctcctttgttgctgaaactattgagaagcactgtattttacaccatgctttctgattcaagggaaaagggggtttaaggggcttagaaagataggcagttgtggtcagagagaatttcagactttgagagcttatgggtaaattgttttcatataacatacctgattgaaaggaggatatgacgtgtttttcttctgtgagaaagagatgaggcaactgaggcctaaagagggataatgaatcagccaagttaaaaaagcagcttgtaacagaaccaatatttcaacccagtcttgtgactctgttccatagctctctctactctgaatcaaagaaatatagtcatcttgtcttgattttgccacaatgtccaaaaaaacattttctcaggtctgattttaatattgactttttctagtgaaagagagaaaacactgttagaagatgaatgaaaatgaagttagggacttacagacagctgacatacaaaggtctcctttgtattgattggcttctttattgatttgacaatatagatcaatatctcttcctctgaggctgtagtgttatagtgtgaattctctgggttccatttcactctgcagaattgatacaaatacaacaggtgcagaggtaatagggggatgaattatcatattagctattatttactatgtgcccactatggccaggaatgttattcaggcatctatatttattgagtgcttgctgtgggcgaaatgctagtctaggaagtgacagagtaatgaacaagacagagaaaagtccctacccccatagagctcatattttatcattctaagtatttttgtatggattaccttacaacaaccctgtaagtttggtactgttagtactctcaatttacaaatgagaaagtggagacagagttagtaagttacttgcacagggtcacacagctaggaatattaaatttggaagttgatgtaagatctgtctgactcctaaatgtacatttttctattattcttttcaagttttattccccactgtgctacttcatcagacagcttctttctgccattcttctcaacactctcttcctctcgtatctatctttccttttggttataatgctgaaaacatgcagttattaaaccaaagacagagaggcaaaatacattcatgtggataaagtaaaatgtacgtaggcttgctcacacactaaacagagagggcactatgcagaagctgtttgctttggggagattagataggagatgttatacgataatagacaaaatttattgactgcttattatgtgttagccagtatactttttcatatttaatttgtatgtgtatataatagctgtacatatttatggggtataagtgatattttgatacaagtgtgtaatgatcaaatcagaggaattgggatatacatcatctcaaatacttatcatttctttgtattgggaacattccaaatccattcttctgattattttgaaatatacaacaatatattgttaactatagttaccgcatatctacaaccatctgatctttgacaaacctgacaaaaacaagaaatggggaaaggattccctatttaataaatggtgctgggaaaactggctagccacatgtagaaagctgaaactggatcccttccttacaccttatacaaaaattaattcaagatggattaaagacttaaatgttagacctaaaaccataaaaaccctagaagaaaacttaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaagaaacaaacaaccccatcaacaagtgggcgaaggatatgaacagacacttctcaaaagaagacatttatgcagccaaaagacacgtgaaaaaatgctcatcatcactggccatcagagaaatgcaaatcaaaaccacaatgagataccacttcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacaatgatagactggattaagaaaatgtgcacataaacaccatggaatactatgcagccataaaaaatgatgagttcatgtcctttgtagggacatggatgaagctggaaaccatcattctcagcaaactatcgtaagaacaaaaaaccaaacaccgcatgttctcactcataggtgggaattgaacaatgagaacacatgggcacagaaaggggaacatcacacactggggcctgttgtggggtggggggaggggggagggatagcatttgaagatacacctaatgttaaatgaagagttcctgggtgcagcacacgaacatggcacatgtatacatatgtaacaaacctgcacgttgtgcacatgtacccttaaacttaaagtataataaaaaaaaagaaaatcacatgaacgcaaaaataaaaaaaaaaactatagttactctatttttgtaccaaacactagatcttattcctactatctaactatatttttgtacccattaaccaacccctctttattctcccctcccactacccttctgagcctctggtaaccatcattctattctctatctacatgaaatcatgttttaacctccatatatgagtgagaacgtacaatatttgtctttcttttcctggcttatttcacttcacataatgtcttccagttctattcattttgttacaaatgacagaatctcattcattttatagttgaataatattccattttgaatatataccacattatctactcatcttctattcatctgttgatagacacttaggttgattccatagcttggctattgagaaaagtgctgcaataaacatgggaatatacaggtatttctttgatatgctgatgtcctttcttttgaatatctgcccagtaatgagattgctagatcatatggtagctctatttttagtttttgcaggaactgccgtactgttttccataatggctgaactaatttacattcctaccaacagtatagaagcgttgccctttctccacattctcaccagcatctattattgtcttttttataaagcccattttaactgcagtgagatcatatctcattgtggttttaatttgcatttatctaatgattggtgatgtggaaaatttttttcatatacccactggccatttatatgtcttcttttgaaatatgtctattaggatttttttgcccatttatagattggattatttgtgttttttgctattgagttgctcgagtcctttatatagtctgattattaattcctattcagttgaatagtttacattttttttccattttgtaggttgtctctttacattgtcaattgtttcttttgctgtgcagaagcttcttagtgtaatataatctcattcatccattttttgctttggttgcctgtgtttttgaggtcttactcaggaattcctttcccagaccaatgtcctgaagcatttccccaaagttttcttctagcagttgtatagtttcaggtcccacatttgtctttaatttgtttttgatttggtttttgtatttggctagagatagggacctagttttattattttgcatatggatatccagttttgccagcaccattttttgagtagacgatcctttccccaatgtctatttttggtgcctttgtttgaaataagttgcctgtagctgtgtcaatttatttctggtttccctattctgttattttagtctatgtgtctatttttatgccagtagcatgctgttttggttactatagttttgtagtataatttgaagtcaaggactatgatacctctagctttgctcattttactcaggactgctttgactattctgggtcttttgtggttccatataaattttaggatttttttttctatttctgtgaagaatatcattggtaatttgatagagattatattgaatctgtagactgctttgggtagtatggacactttaacacattcattcctctaatccatgaacatggggtagctgtccattttttgtgtgtgctttttaaattttttatcaatttttcatagctttcattgtaaagatctttcacttctttggttaaatttattcttaggtaattattttgtagctattgtaaataggattgcttccttggtttatttttcagattgtttactgttggcatacagaaatgctactgaatttgtatgttgattttgtttcccacaactttactgaatttgtttatcagttctaatagattttttggtagagtctttagggattttttttaatataaggtcatataatttaaaaacaagaataatttgacttcttcctttcaaatgtgaatgtcctttatttctttctattttctaattggtctggcttggacttctatagctatgttgaataaaagtggtaaaagtctgcatccttatcgtattccaaatcttaaagggaaggcactcagttttcccccatttagtatgatttagttagctgtgggtttgttgtatatggcctgtatcatgtagtcagtatactctttacgcattcaattcttagaacaaccttataagataggcactgttattattattgtcttcattatttatatgggagaaactagggtacagagtggttaattaacttgccaagaatcctctgtttataaggggcagaactgagattaaagttcaggcagacagtatccagagtttgttgtcataatcaccaggacagtacttacaacatagtacatcataccataagtaattgattatttttaaaaatccaggtatgagaaaataaatgtataaactatagtagtaacaatgagaacagaaaaaaggctatgaatgcaataggcattttagagaaaggggcaacaacatttactaaatctcagatttgaatgacaaggaaagtgattatagcagtgacattaaaaaaaatctaaagagatcaaagtcttgggaggggaaatagtttggtttctgacattctgatattaagttgatggtaagatgtccaagtagaggaactattaagtaagtgaaatatgggactgaactcaaatttgaagacaaatcccttcagactctttgtccagagtctgcaggccatagagaggtatgaagagagaggatagaacgtagaaggagcaaaggctttcaccacgtagacatttcctcctttctttttccagtaatattattattgaaatacaattcaaccttagttttaactttttccaggctaggatgtttctttgcttcctcatacttttctccaccaacatcaaaatataataggatgcagtccattcagaaaagaaaccagttaacaaattatgccttcaaaggaagaaaatttcctgtgatccccgattgtggtctaaattatgtttattatacgttttataaaattctgaacaggtattgaactattttaaatttcttggatttattgcttttatacaaaaacaaacttacaaatgaaatataaataaaaccacaaaactaataaatctaaaattaattttaattatatttgtcttactgaaaaaaatcactgtttggaatgtgactatgtactactgaaaagtgcaggtttgtttgagttgtacatggctggatttctgtgtgctacgaggtgcttttaagtctccaccacttagattgcagtgtgctatgatgtatttttgttctcatgtgacatgaaggcatcatttatatacatttatatgtatacatttatatacagtactactttgtgacaatataatcataaacgaatatgtaaaagctggcacttaaataatgcaatagtatcatcatgaggtgatcacctagaatacccaaaatctattttcttaatttattttaattcaaacataaagtttgaaacatatacacacaaaaatattatagaaaagtcctaccctcccgaaactctagtttgaaaaatattaatctgaaggcaggagataaatatactgtcttgttgtggctttataaatttgtacattttcctagcatgactaaatttaatcctgcctatgtgttcatataatgaatgtgggatttaggagacatgagatctcaaactggctctgccattattctattatagaatctcaaggaaagtgttttacctccctggacctcatttttctcgtgtataaaatggaaattggagaggaagaaacaggatgaaccacatgatctctaattaggactccttgtgattttcaagtcaaccatacatttgaatttcagaatggatgatacacatttcactatatatgtatatgcacttatgtgcacttactgatataatgtttacttaacaccatggatattagttcatttgccaaggaagagtgttactcaaaattcatgataaagaatttttttttttttgctgctcttttggacctgtaataagatattgttaacctacatgtacttcataaaaactttccctatgtgcattttctttttttttttttttgagacggagtcttactctgttgcctaggctggagtgcagtggtgcaatctcgactcactgcaacctccacctccctggttcaagtgattctcctgcctcagcctcctgagtagctgggattacaggtgcacaccaccacgcccggctaatttttgtatttttagtagagacggggtttcaccatgttggtcaggctggtctcgaactcttgacctggtgatccacccgcctcggcctcccaaagtgctgggattacaggcatgagccaccgcgcctggcctccctatgtgcattttctaaaaaatgtatctaacttaatgattatgagtagacagttctgttgaattttatttatgcaatcacatgaccatttctttactatgaaacatataaaattgtactgtaagtgaaacaagtagttccattgtgtaattgtttcatcattacatataatttaataaatacttcttttcaaattagggaataacagacttggcatttatatactttaaacacttaagactccttcagcttctaaagaatttaggttaatttacaaaacagaaagtgattggcttacattatgctttgcgtctgtagaaaatgggtaattgggccgggcgcagtggctcacacctgtaatcccagcactttgggagaccgaggcgggtggatcacctgaggtcaggagttcgagaccagcgtgaccaacatggagaaacaccgtctctactaaaaatacaaaattagctgggcatggtggcacatgcctgtgatcccaactactagggaggctgaggcaggagaattgcttgaacccagaaggcagaggttgcagtgagcagagatctcgccattgcactccagcctgggcaacaagagcgaaactccatctcaaaaaaaaaaaaaaaaaaaaaaaaaaaaaaaaaaaaaaaaggataattgaataaaataaaccgttctatgaaagtgtgaattagtaactctgactatgtcggcagccacaattttgcctccctaagcaaagcatatagagtatacatgatcacattaagaaatacagcaagatgttttgggtcaaaccaaatattttaccaaagcagatttttttttttttttttttttttttttttactaatgatgattcaacactaataccatgaacaagacaaaatgaattgttgtgagcacaaattttctgcaaacattattttaaaacttggcatatttatgcctattagtgaatacatctttataatttacagcttaacctcttcaggtttataagaacaagccagtttgaccattggaaaagaaaaaggagagacagagcaataaccacagtctgtgaagaggcctactcagtaacggtctagtttatgcttaaaaatactggaaggcttgcatccctcaatctctcagtcaattactttagttctttgaaatcaccccattaattaggacaaatcctgcgttttcttatgtctagatttatcaggggttttttgcatctctctcttatccacagtttagttttatataatacaacctgatagcatcttgttatcattttgccttgatttgctttgtgtcttattacataaaaggggtactaatctttgggaattcactccttattagagtcaattgagatttgtaacttgagatgcaagcttatatttttattataaataattgcctacaaaggaattcctagcatgatatgttatcagcataaattactatgttttaattgtaatgtattttttaaatatgcccacaggaaaggtttttctcctacttagttttgtagaagattattttgtgtcttcccacttcattcctagtatggattccaaatatatcacttgcttgatggtagtataattttataattatattgttattggcaattcagaaaatgatttctatagtttctttgacataaagtggataaccagaatgagttgattttcatttatctttgaagccaattataattttagtaccaaccaacagttggcacttaatttgcctggtctacagataaccaagaaaagatattgccattcattggtctcctcactctcttctataaccagaagctaggctgtaaattgccattttctgtaaaagttggcccatttgactccctctcttaattaccgaacgctactggttgtgatggttttaacttgattatgtacagttgttaggcaaatgccagttaggagttgtgaatgttttagaaacatttcctcagaataattgtgctcagtttttaaggataggaactggaggctagtcagatatacatttgataaacaaccaattactcatctcatgttgttctttactgggggtatttctggttttctagggtggaataaatacagaggatggttcactttgctctgtctggatgagaagctttgatctccaggatagttcttttttaaatgagatgaatgaattttcacctttaagtagggtgcttatataatttattattcaaatgagaaaacttttgagaacaaaagaggttattgctaactgttatgctgggagaactggcatgaattggggatttatgccaggcaaactgtattacatggtctgtcactttgggacaacatggagatttgcctccccaccacttctcccaaccctgtccctctccatccactcacaccccagcctaagaaaatgttctgtgagacatatatagctcaggggatctttgaacatactgatgtgtgttcctctgcagggattacttaaaaaataaaaatccccctactcatctatcttcaaatcagtcaaaacaaggtttttcattatgtttccatgtctccctcctctgctgttgtatccctttaacagtcagactctcagacaaaagataagataccatgctctttctaaaatgtaaatctaatcatatcactctactctgtaacacacttcagtgggtttccattactatggactttgtgatccagcccctgcctcaaatcccaccattctctacctccctcctattgccaatcgagaatctctttctgttcacaaagtagcattccaaagacatagaaatattcatattgttatatcctagctagtaagaaatgtacctacacatgaaaattgccccatcatctagcacggtgcctgacgtataattggcatttaataaatgttgaataaaggaatgaatgaagagttaaatgccctgagagaaattttatttaaggcaatctatttaaaatatgaatgagtatatagcagcaattatcctcttgatctgcttagttaagagttaactatattgttgggctcttttttttttaggcaaagcatagagatattgctttataacataacattccccccactgtcttaaggacctttaatatgcttaagggaagttaatgtattaataatagccatttcctagggcctaattagccatatttcaatctttgtaattccgtatgagaaaaatatcctcacagagttcaagtatctgcggcatacgttttggcctcttatatatctagggtgaaaagctaacctggtaaatatgcattccagatggctttcatcagataaatctagtgaataagaggcccactgataaaaatggaagttataaaaattaataagaaaatggatgttggaataaagacctgggataaccatcacagatctcacaatgatgctttacattatagcatgcaaaacacttttacagacattttcttcatttaattcttggaattgtggggagagactctgtaaagtaggtaaggcaaggtagttgtttttatccatgtttcgcatatgatgaaactagcttatgatattttgttcgtttatttcagccagtgtaactaggcttcacttatttatgagacttcagaatgaataataatcatgttatagggtgcctgaagaaattaatgatatctaaggaatcgcagtccttagcataactttggtttatttaaaatgtgctgatctgtaaaaccaaaccactagggtttgaagaagactggctgtatctaaagattagcaagataaagatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatgccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagggggaagggatagctttaggagatatacctaatgctaaatgacgagttaatgggtgcagcacaccagcatagcacatgtatacatatgtaactaacctgcatgttgtgcacatgtaccctaaaacttaaagtataataataataaaataaaaaaataaaaaataaaaaaaaaagattagccaggtcctgttggcaacttattctgaatacttaataggctcaattggaagctagtgaagttttaatcagttgtccatttaggacccctcatcagcaccagttcatagggcctgtctgaaatattcttaggtagcagaggttgtacagaaagatctttgtgttactcttccctcctaagcacaaaacaccaaaatgaataaatgaataaatcaataaattatacactctaatcttgacctcagtgcataaaagttaagtcgagctctagaccaggtataatcacctggcacttcaacagtatttgaattactgaattgtcaccaaaatatatatcaagtattttttcacgtttaagacattgtacaacatgccatagagctcaggagaagatgaggaactttgacagtgacatttttttaaggtgcaagtggcatatttgtgagttatgagccttattctctgtagtcctaataatacatttatccctcatagaaaaagggtttcataaatcagccatggcaatgtgcaatattctcaaattcaggtatggagatatatgtataaatttagtattctcactggttgtgctgaagtgttgttgaatgtgtgagtgtgtatgtgtgttttctccagattctgactttgatacaaacattcaaaatctttaatagacccccttttcagggttagcaaatcttagtaaatgtctgttggctctactctttaagtctatgattcttttttgcatccattttaaaattgggataactgctagaaaataattagaactaatgtactagcgtaatcaaccaatgagttctttctgcctgctgcacagacaaaatcaattcactaggactgcagcaatgcagtaaagaaagtttaattgacacaaggctggccacacgggagaagaagttcttgctcaaatcagtccccctgaaggctcagaggttaaggtttttcaaggataatttggtgggcagggagctagggaatgggtgctgctgattggttgggaatgcaatcataggagtgtggaaaatggtcctcatgcactgagtcgtcttctgggtgggaggccacaaaaacagttgagtcctgagtcatgattctacctctgggtgggatcagtcatttgccagaatgcaaaagtctgaaaaatatttcagaagacccatgataggttctacaaaagtgatattatctacaggagtaattggggaagttacaaatcttgtgaccttcagaacaatggcttgttgttgtttaaccacacctatatcttagcagaattcaggtccctcttataagcctaacctgtggccttttgttagttttacaaaggtggtttagttttgggaagggctgttatcatccttgctttaaggttaatctataaactaaattactttcaaagttagcttcatctacacccaggaataaccaaaagcagcttggacattagaagcaagattgagtaaactatgtcatatttctcttactgtcataattttgtaaagatggtttccctagttaagagaaattttctaagattctggtgatcccatgaagacctcaaatcaataaatacttttgagtgtaaaaaaatacatattactatgctaggcactttgacatatctcttctcatttaatgtacatgactacactccgagggcattatcagcctccctatttcataagtgaggaaactgaggcacagataattaaaatgacctatcttaatcaaaggtctttaacaagtcattgaataattttcttctttcctagaaagtaagtataaccagattcacagttgatcattttagcaattgagatgatgtttgtgaaatggctttggatactctgaactgtcatgagaagtttgtttgttgtctagttttaccagtagtgctggattgcctaatgggcaggctaatcatgcatttatggcattagcaatgcagcatatctataagtcttggtgaatctttttaaagcatgaaagtagccattagaaaaagatctttttggatttgctaaaacttattttatattttagagttgtgtttactttgaattacctgtttgggcatatgatcttttcagaactgaaggcctctaaatgtcttaatctggctccttattgcattttgaatgtttgagaactcatttattcattcaatcatttaccatttctaaaatctacaaagaactgacttttcctttcttctcatattcttagagaatcagtcacccttctttgagagtcaactggcattatattagtttaggccctcattatctcttacttgggccattgtagcagcctagtaactactctcccatgttcagtctttctcttcttctaacctatttaattgctacttataaatttaccttaccaaaactctccttctttcatcaggaacctgtaaaggatctctattgtttaccatatcaagaccaacccctctgcagtattttcaagatcttcaaatactgactcctatccacctatttagtctctttttcactgtgtccctagtcttctgttctgcttaacctgattttctcattgttttctacagaagctatgctcattcctacatccaagattttgctcttggtattgctctgacatgtgatgttttttctccttttctccatgtatccaaattttcaccaaccaccaacattcagctcaagttctgaatcctctgtgaagtcctctctgctacttcaggtgatgctcaactctccttcctctggttaccctattataattgtggcatatattttagtaactaattgccttctaattattttatatgtgttggttttacctctgtaaccaaactgtaactccccagaaagtatagcagaatactacctagtaaatactaaataaataaatatttttattggtttattagccaagtagtatagagactctatgaattttaaattacctaatgtgactaaatggaattaggaatagtgattagaatgctttgtgtctttttaaaattcataaatatatatataggctttattcaaacactcagagtttgaaaccggaaaccacttctcaaaccagtctgccccctctgaggctgaaagggttctcacatatatcctcatggagccatcataaagaaaaagagatattcttaattttttttaattaaaaaaaaagaaaagaagagatattcttaaactcattttagagatgagtagaggctgagaagagtataatgaggaagagatgatttatttcgtaagaaagaaaggtgagaaacaaagacattccagatgtatagagccctggaaaagagacatcatatatcttcagtacattcagtgttgtataaatagtacaatatggctggaacctcaagttgattcaaggcaagtgaatgtagggaaataaaagatgtggtttgaaaaaaatctcagtgtgtccgaaattgagctcatcacatttgtcatccccttcccaaatatttttatcttccttctcagtgattgttccaccacccacccagttttttaagtcaaaaattcagatgtcatccttgactttctcttttttcttctcttctctatacagccaaatgctaggttctgctaagtatgcatctaaattaacctgggaaattgttagaaatgcaaattctaaagttcaacaccagctactaaatcagaagccctggggttgatgcccagctctctgttttatcaagtcctccaggggatttttttgcatgagaaagtttgaaagccattgctgctggcaatgaggagtcattgagaggcttgaagcaggaaaatgacctagtagaatatgcattttagaaaggtcattctggtatttgtatggaagatagatggtaagggagcaaaattaaaggtaacagaactagttagtagaatacaaaaaataagataataaaagacatagaggaaaagataaatttgtgaggtattaaagagctaaaattgatcaatttatgttaccattcggatgcacagggtaaagaagagggagtgataggtgtctggtcttgcacactaagtaaatataatgatcagggtttggggaacaatcatcaatgccccttccctccttcctttttttaataaagttgagatgactttacggtaatcaggtataaatatttttttaaacagttgtctccttgagtctggaccttgggagagaggtcaggcttatcgataaggattttggagtcaacagtatactagctggtaatagctactgtctgaatggattaaataacgtaaaagacaaatcttttcctctatgtcttttatgttatttaatccattcagacagtagctattaccagctagtatactgttgactccaaaatccttatctacaggcctgacctctctcccaaggaaggaagcatttcagggtgagaagagaaccaaggatgaagtccttgataagaccaatacttaagggaggtctccagggaatcctgagtaatggttaaagagtaagggagagaaccagaaaattgatatcatgctggtagaggaggatagaatttcaatgagactaatagtgttgaatgccgtagataggtcaagtaagatagctaattagttatattagttagtacataagttccaaacccctgggtcatgtaccagtatcagaaccaggccacacaacaggaggtgagtgacaggtgagtgagcgaagcttcatctgtatttacagctgctccccatcactcatgttactgcctgaactctgcctcctgtcagatcagcagcagcattagattttcgtagcagcacaaaccctattgtgaactgtacatgtgagggatctaggttgcatgctccttatgagaatctaatgcctgatgatctgtcactgtctcccatcacccccagatgggaccatctacttgcaggaaaataagctcagggattccactgattctacattatgatgggttgtgtaattatttcattacatattataatgtaataataatagaaataaactacctaataaatgtaatacacttgagtcattctgaaacctgccacctccccagtccatagaaaaactggcttccatgaaaccagttccttgtgccaaaaaggttggggtcattgagttaggggatcactgtctttagcaattacaacttcaaggaagttttgagaacagaaggtggcagtacattaaggagtaaattggaataaataaatggaatttttagctattactagtttatgaaaggaaggaaagaaagagggagtgacagctagattgagacaaaacatcaatggaattttcttttattgaccaagataattgtgtatgtttacaatctgaaagaaaaagtgaattgggaagaaaaatttgaagatacatagagaaacagagaacttgatggaataagatctcaaagaataagtgaggggataagatccacagcagagtaggaggtatttgctttaaatattgtatttttattgtctcttaatgcattggcctctcccaagtaaattgagaacccctcaaatgaatagacacagtctttttcagtccctagtttagggctcaaaaaattttttgctgaatgaattaagatcatttcttgatttactttgatgcttcttctctcccccacttactctttttttttccccaattttccatccttagctctcttctcttgtcactgtattcagttgctccaggagatctcaaaaatgcctaaagtttctttttctgagacaggagaggttgagatgtgactagaccttttatactcagagtaatgctgaatcattaattataccgtcccttcctgtttgccttcccatggagccacactaagtagaattggattggatttgagggttgttttccaacatgctgcagacacttgatatacaaccttttatttttttatttttatttttggcaggccccttcttaaccctacaacctcagaaactttccatttttgtacctgctcagttcttccagtagaaagtaacccttgatgcatagcttcttggactgggaaggtcattagagttttttgatgatgattccaaatgcaacagagtagcttgcctgtttcaatagattttcctttgttttgactttgttgacctatcatttgctgaatgatataagcagcttcacaataaaagagggtatattatacacaggttgaagcagggtaagtatttttgtcctgagagaaaaatccgatctaaagatatatttgatttttttgtgtgtgtgtgtatgtaattaggaatgaccatttgaagtagaagcagagatgtctgagagcccaattttcaaagtaataatttgctatatttatttcaaagtaaggctctatggctaattttaggaaaggccttggaaatgaaccaacatgctttaggaagattcagatgtttagttttaaacctttccatacatgctttaaaacattctaatagttatctgtgaaagaaatgcattttaaatataagaaaaaaatgctatttccttttcagtgcctttctacagcaactgaaagttaaattagaatgccagctgttataaggagcatgttaatcttcctctagggcaagactgttcttctgatcttctcctgttttctctacagtgcccaacacagtgcagagaaaccagcggaaacttagtccatacttgttgacttgacagtttacagaaacattttgtcctctacaacctccttcagactatccctgtcgaccctatatttagaaaatgggttcttgtctaagtctggagacaaggttatatctgtggaacagatgctcattatagttcacatgcatattgaacaaaaattcagaaaagcaatgaggtgaattttataatcttcagaaatccccttgaaagggccacaagaataggaagctggtgcatatcatcctcataatttgtctgctctctaattggcaccaccaatgttttgggttccaattcattgacccatttttttattcctctgctttttcaaaaaagtatataaactttaaaagacactctgttactatttactaatgccacttgactggttactttttgtacttgtccttataagcagtgtataggtcaaaatcaatgtaaacattacctatacctctcaagcagtctctccccttaccatccctatccttcttagaggtcgcttccttaatactccaaacatatgcttctctctatcatagaactgatcaccctatattgtaattgcctattatgtttgtctgtgtcccccatattgaaccacaggcagaaactatcttccatttttgtatctcctgtacctgacacaaagtctggcatataataaaatattcaatatatatttgttggatgaatgaatgtatgatgctccaatataggcaaatttgccagtctacttttaaggccttcattaatctgatgctattttaatttttcaacttcatttatttatgagcacctattatgttccaagcactgtagatataatggtaaaaaaatagaaattatccctacttctataaaactaatagttcagtggaggaggcagacatattatcacacaaataagtataaaattacacctgtggtgtcttgaatgagaggtacacagtgctgtaaaggctaataatggggcagggtgggaagttttcctaatttaggaggaagtgatacttaatctgggatctgaaagacaattagcattagttaagtagaaatcaaaagaaaatattctgggaagtgagaacagtctcctgtgcagtagaatcccaggcagcagaagggagagatgaagctggagaagtaagcaggtgctaaatcgtgtattaccttacaaaccatgttaatgagcttttgtctttattctaaaagcaacagaaaacatatcctacaacattcttggtctttctgttctttttcaaaaccacaaatcttagtctttgtacttctaatcatactatcctctacttgtattatagtcaccacccttttccactgattcaaatcttgttttttgttcaggtatagttcaagtcttatgtccttcaagatgactcctttattagttcagtctagacagaataacctttcatattgtatagcacaaatttatactgtttatatacttattgtgcgggctcttatatcatcctaccttatacttttatgatgatttcatacatggcttttcactcaagagactgtgtaatatttgttttctgaatccctcttaaatatccatagcccagtacttgattcacactggattcccaagatatactgagccatgaaacttgatataaaccaaatcttagaatatattaagggaaatactttgatcctaatgctgttggtgatgacacaagtgcatgcatttgaaaaataaaaaatgcagttatattacctggttttattggctacatcatagcaactacttcactaagttaacttgtcttttcactgcacttatcaatctgcattttactcattcaataaaaatatactgaatgtagattttgaagcagctaccgtgtaagtaaggactgggaattaaaaactgaatacaatatggtcttgactattatcttactctgttttgtgctgctataacagaatatctgagactgggcaatttataatgaacagaaatgtattggctcacaattctggaggctggaaatctgatactgaggtaccaccaggtttggtaattctgattccaacatggtgccttcagcactgtgtcctccagaggggaggaacaattaatattcacatggcagaaggcagaagatcaaagagataagaagaggacaaactcattcctttataatggcgttaatctcactcatgagggtgaaaccttcatagcctaatcacatcttgaaggtcccacactttcatattgttaaaattgtaattacattccagtatgagttttggaggggctgaacattcaaaatatagcaatcatcacagagctaaaaatatggtgtccaaagctattaaaaatcacatttctattgccaaaaggttatatgagattggttgacactcaggatccttaagcagagtacaaatgatatatttcattttcacaggaaatgtagcctcaccataagtttatggatacaaagtctggatattgtggaatgtgctcagcattaaagtaatacaacaaaaataatttcctctgtgagtattatagtctttgatattgaacctttaggcactgtacaggtaatgctctgtgaaaagcagagttttatagggataacaattcatctatacttttcagtaaggctaggtaaaatttcttccaactgggaggcagtccagagctaggactcccttaggttggtgattttctttatgaagccattaagaagttatgaaggtatctagagatagagatcatcaatcagtgattgattattagcttttttaaaagaaagactttggccaagtatatgaaattctgattatttactctaattcttatgaaatcttagggtaactgttaatataaagtaattgacattaaaacattaatataaattcttaataatttagttaactctttgagttaaccaaaacctgactaaaatctttgtcctattagaggagacacagaaaactacttattctattaattagcatacattttaaagtatcctgaaggtaactagcaaagtttaggtgcttgaaaaaaattgtcactttcctaatctgccatttgaagaaaaatgctcctaaaattaaactattactatgttttgttcatgggacatgttacatcaggggatgtttcctaaaggtttcatagaggagtagtcaatacaactttcaaaaatgaaaataaaatttaaaaataacctaatattaattttgactccttttttaaaatcttcagttatttcatctgaagtaatacagagttgcaaggcattatcactcaatcataaggatctttcaaaaattataccaccctgctatgaaagactcaatttcaaaatattaatgattacaagccagagcttctgtaaacatacatctcaactttgaatactggcaacactttcagcaagataaggatgacaagaaaatgtactttcctagcctgttttcaaagcacatacacatttttaaaaggtcaaggggagggactttgtaagaatgtattattatagctttttactgaactgatttgttttaggtatctttttgttcatatcttttatgtctccatcatagtaattgtattcttatatgatgaaaataggatgaaacaaaaccactgagaatacacacactgtctttgttcctgaaggacaaacggtgacccaagtcatgggctgctttggctttgattaaaattaaaatcttgtacagattccagttctgaacatatgtctcatactctatgtgctcacattagggtgcgttaaaaatattttatgctaacagattacagtaggtaacagtatgcctttgtttcctacaaaagaatgagtcagtaaattgttctacttaatggataaaagactagctcaagatgcaaatatatcccaatagctctaaatcccactgtaattcttcctaatttaaggcatttattaactcataacagaggctcaagctattcatatttctagcttattttatttatctttctcttattacctgttctactctaagctttgcaaatcttgaaaatcctaaaaatgtcaaaggagagacttcaccaattaaagtgtgctgcaacatagtggagagaatggaaccattgtgtggttcatattgaactgcatgatttatatgagttttctttccttcccatgatttgttgtagcaaccaacttcacatagtcatgtaaaaattagagggttctaagttcttccaattggctctgtatttcaaagtacctgttgaactaggcaaacagaatagcatcattttttttaataatcagtgatttggtgaaacaggtggaagatacatttttgtttccaaatgctttctaagaatgactataaatgcacagtttattaaagagattcaacaatgccatttccctggtgcttctctaccaagtaaatgacattttgaaatattattttttttctaaagtataaaagacccacccagccattatataaaatgagggaacacttcttgttgtgttaacatcttgaatctagtctcagggaagctgttttatgagatttactggtgcaatttggttgcagatgctcatgatttatagaaaagctcatggaaacagacagaatctgtataaagaaccaaaataaaaacaaaaacattaggtaactcacatgaggtggatgtcacattaatcatgtttttgtcattttggtttaatgttcatgtcttggggagtatttgagagtgatgctatgtgaccttcagatccctgtagagtggttcaggttcaaactcctggaaggctcacatgtgataaggtttgggctactacctttctcagcctgtgaaatttgagactttccccacattttcccctaaccaatttatccaaacctccacacctccaaacggccattaaattttgaactcctactgctcttattctctttcttccctcttttgttaacgtaataatttatcaaccagtttttctttaggaaacaaaaatgtattgctgcctactctgatgtttgcacagtgttttagaaggcaaacttcttatagatggtatacagcctggtgcttctcccttccaaagtgccttatacagtgctagttataaagttgatgttcatcattggcttattaattgattgatccttgtgtcctgtccctcaactagtcttagacattgtgtttagaagataaatagagcagggaatttttcatctggcctcattgttcctccaaccacagagatgtgagcccacctagtgacaaagtactagaaaagagagcaaactgtcagcttcatccttgtctgtcagagcatgagactggtttagatgactttgcctagttgatgttaagcacattctcatttcccatgttaagccttacagatcaactagactagagtagtgctgtgatatgttctcacctcttttcccagcccctaggttacctcatcacaccaccatggattagactgttagtatttgttgcttttattacagatgatttctaatatgtaattcattttcattaaaggatgatgctttattcttccttgaaattttctgttctccctcccctttttttcctattctgttcagggacaggagggatgaggcacatttattcccaaaaaggagagcagatgtagtggttggtagggatggcaggttctcctgaacttacaattccatattttgcatatttatattcaaatggttcaacaaatatataggaaaggatcctgcaggaccctacagtttccagaactgatgatttgtcatctgaaaaggtatttttcttcatagcttgagaagaagttaaagcaaggctcttagtatacattcaatctaaaattcaacaaaagattcttctcatttacagaatgaaataaatgcatattatttcgccatactttcacaagattttatttgctactacatagacacctaggttatatgctaccctaaccaataaatattctatgaccaagtttatgtatttcctatacaggcagattttttgtatgttttgaaacattctaagacagtagtgtttattctcacatatggttatatacatatatatagagagagagacttgtttttgataagtgatgtatggttcatgtaagtgtctttacaatgtattatatttaaggtttgattttgtagacatgtttagtttgatttttggagtttcaaagcttatgaaaatcattttggttcagaataataaaataagttagataatgaaatttatatgcattttcatatgtctgtacagaacttgatataaatactcaaacattcttcctttatatacctttaggtttaactttgatttgatttggtaacataagattaacagtgatataaattttggttcctctagagaaagaaatacttgagaccactaaaattaaaaatcttgcattaacatcctataattgtatgaaaatttaataagcttcagaaaatataatatatttggagccttttataacatagtgtagcatttgcttggaacatggaatgaaaattaagagtgaatcccaggttttagccaagggcaggaaggtggcaaagggaggcgaatccgagtgggtggagggaggggaagggcgagaggagaaaaaggtgggaggaggaccaggtgggagggtggcggctccctcaggacccagcgggggcagcgcgatgaggcgggtgaccctgttcctgaaaggcagccctaagaacggaaagagtaagagacttaaatgaatatgactgattgtcacacaaaagtgtgtcctacttcaacactcagcattcaagaaatatttatcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagaatcatttattgatcctcagacagattctaagcctcctgagggattgttaggattccacacagactggctgacattaaatgttggagggcggtactttacaactacacgcattactcctaccaggttgtagcatgcatctttttgagagagcagctgggatcgagtatactcttgacttaaatgtgtttgtttataaagacaaatggagaaatcaatttgtttccctgaattctaaggagcactttagtgaataaagaacctgacagtatgctggcccacatgtttaaggacaaaagtgtctggggaaataagcaatatcatagaggcgctttcttaattgaccgaagtcctgagtactttgaacccattttgaactccttgcgtcatggacagctcattgtaaatgatggcattaatttattgggtgtgttagaagaagcaagattttttggtattgtctcattgatctaacacctggaagtggcaataaagaattctcaaccaccggaggatcattcaccaatatcccgaaaggaatttgtccgattttttgctagcaactccaaccaagtcagaactgcgatgccaggatttgaacttcagtggtgctgatctttctcgtttggaccttcgatacattaacttcaaaatggccaatttaagccgctgtaatcttgcacaggcaaatctttgctgtgcaaatcttgaatgagctgatctctggatcagtacttaactgtgcaaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaagatgcaaagttgaagaactgtaacctcagaggagcaactctggcaggaactgatttagagaattgtgatctatctgggtgcgatcttcaagaagccaacctgagagggtccaacgtgaagggagctgtgtttgaagagatgctgacaccactacacatgtcacaaagtgtcagatgagaattttagaggctggaggaagatgtacaagatgaaaatgttttccttatcacttttctttctccactcactcagttgtctagaagaaataacactgtaaggaaattaaaaaaaaaaaaacacatttagaggattatgcttgttctgagcggtgcataagggaaaaaactgactttttttccatattctgatttttaacagaaaagcactcatttaatagatgtagggaaactagatattgctgccttttgaacggggtaggggggtttacctggttttatgaccaggaatagtatctattatatttgcttttaaataggaatgatgtggaaataccatcttggtttgagatgcatttgaggattttaatttatggaaagtacaacatatgcaattatatttattgaatacctagatgcagtatggatatttaaattgttaaaactttatgaaaacttggaaaaggttgttcaggtttataaatagctttagtgacgcctcccctctttaaatacctgtcataccatatgaatatggtgagattagactccctaagactcttttcaggttcatttttataatgtttactttttaggttaggacaaaacagtagctaaattaaagtaatatccagttcttactgattgagacagagtggaaagaaagacatcgttgtacttcactgtcattccaaaggtacagtggaactccggatggaggaataacttacctatcactacaacacttataaatgagaatttctcagaatttcattctaggcaagttccactcaacaccagaccaagcaattctatctatttacactattagcttagttttctcatacaatcatcacaagcataggaagatacttcaaaaccaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggagaatgaggaattttaaacacacattttattatagccaccaaaaaacagatgtaaagtaaaaataaaggcatttggctggtccaagatgtaataccaatcagtcagcacctgtgattcttttacttatattttttgtgtttttttaaacaaattttagcccaattttcttgagtcattatctctctgcagcagcagaggaagggcctgtacctccctaccaatgacctggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttgttatttttaccaagacagagaagtattgtattgagagataatctattttcataatcaatatatgcctaaattatatttaaatcatttcactctgtactatattttcaggaattatagaatgtgttattcattcacttaaaggtacctctgtagaaataacctaaaactgcagaaggatctgaaagatctaaacatggtgtgcttagaaactgcagattttagatctaatgtatacagcattaataaatgatataaagtgttgaaaaaaaaaaaagagtgaaacccaggttttagatatacctctaccagttacttgctatatgattttgggaaaactatttttttgtctctgagctttaatgccattatctgtaaaatgcagtgttacaatagatcattgtaagttatagccaatatcaaaatttttcttatggctgataggaggtttatttcccaaatctctctctttagaaatgcttaggtatgtctacaagcatatagcttaatatttcaaacaaaacattgatgtttacctttattaaattttttcacagctttaatttttgagtacctatgcctccaaaccagtcaaatcaatttttccaaacctatgcctccaaaccagtcaaaataacttctatatattgaagtttttgaaagcacatgtaaaattcaggataaattaccattgccatgaaaaatgctataggttaggtgttctttaaaaaaattatatacatctaacaattatttattggagacactactatgttctaggcattgtcttagaagcaggtgatacaaaagtgacagatagcatctctgctctcacaaagattatactcttttgggagagagaaagtgaagaagaaaacaaaacatacaaaaattatcagctagtggtaagtgccacccagatgaacaacatatgtgatgtggtagaaattgaggagatggaatggaccaggtagtaagggaaagcagagatctgaatgccatgaaggagccaaccacatgaagatgagtggggaaaaaattccaggctcatattatgtgaaggcccaaagcaaaaatgaactcagcatgtttaagaaattgaaagattagtgagactgaagcttagtgggagaagtagagaatggtaggaaatgaggtcagaaaggtaggcagggaccaaattggctttgatttatagatagatagatagatagatagatagatagatagatagacagacagacagacagacagatagatagagtgtggggggggggttggaaaacatattttaaacaaacagtatagatttggggtatgcttaagatttagagtcaacagcacctgttagtgagatgaatatgaacagtaaaggaaagagaaattggaaaaacacctagaggtttggtttgagcacctggataaatggaggtgccattaattaagatagcggaagacttgagggaaaatcaagtgtagggtgcaaagaagtaaacatcaacaactctatttagtcttattaagtttgatatattaattagccatccatataaagatgttaggtagatagttacatagagaagcctgagtttctgggtagaagtcaaggcagtagatccatatatgggagtcatcagtatctatatgttatataaagtcatgaagcagaggaggagaagttagcaaatagaagtattggttggtgaggtaggaaaaaaataaagagagactataggaggaggcaacaccaagagaaagagagcatttaaagtgggagggattagtaaactatgccaaatgttactgagaagataatgaggatgagagctgagaaatggctatcagactgcgcaaagtggagactattgagtggtggtaaaggaagcctaattaatgttgattgagaagaggatatagagtgaggaaatgaaatttcttcacactatttcccctcctgggataggcttggtacttataggccaggagagaattggaagagatactcaaagtacttaaagaaaaaataaatcagccaagaatactatatccagcaaagtaagttatccttcagaaatgaagtaggaataaaaaccccctgagagaaggaaagactgagaaaattaaccaccacaatactggctttgcaagaaatgcttaagggattcatacatctggaagtgaaaggatgacatctaccaatgtgaaaacatgtgaaagtataaaacccatcagtatagataattccaaaatcacactcagaataccccagtgctgtaatgttgctatgtaagtatttcagtcctctagtatgaaagtttaaagttaaaagtgtcaaaagcatcaacagctataattagtggctaaggtagaaacaaagataaagttataaattaaggcaataaaatacaaattatgtgggaggagagaaaaatctagagcatttttatgcaaccaaagttaagttgttatcagcttaaaatagtctattgtaattctaagattcattatgttagttccatgataaccacaaacaaagaaatcacagcagatgcagaaataataaagagaaagaaaacaaaacttaacaccacagaaaaccaccaaaccataaaggtaaacaacaagagaggaagaaaggagcaaatgatctataaaacaaccagaaaacaataaactggcagaagtaagttcgtacctatcaataataaccttgaatgtaaatagattaaattccttagtgaaagatatagagtagatgaatgcattaaagaaaaccacaaaacccaactatgtgctgcctacaaaaggctcacctcactattaaagacaaacatagactgaaagtgaaagaatggaaaacaatattccatgcaaatggaaaccaaaagtaagccggaatagccatactcatatcagataaaatagactgtaagtcaaaaacagtaaaaagagaccaaaagattattgtataatgataaagggatcaattcaacaagatgatataacaattgtaaatatatatgcacccagcaccagagcacccaaatacgtaaagaaaatattattagatctaaagggaaagatagactgcaaaacaataatagtaggggacttcaacaccccactttcaacaatagaaagaaagtcaacaaagaaacgttgaacttaaactatatcgtagaccaaatgtatctaacaaacatttacagaacattccaataaacaactgcagaatacacattcttctcaatttcacatggaacatcctccaggatagatcatgtgttaggccacaaaacaaatattgacaaatttaggaagaaaaagagcacatcaagtatctcttcttatcaaaatgctataaaactagaaatcaataaaaagaaaaactttggcaatcttacaaatacatgggaattaaacaacatagtcctaagtaaccagtgagtcaatgaagaaattaaaaagaaaacttaaaaattcattgggacaaatgacaatggaaaacacatcatacaaaaacctgtgggacacaacaaaagcagttctaagagggaagttcatagtaataaatgcctacatcaaaaaagaagaagtatctgactccaatatttattgtagcactatttacaatagccaagatatagaatcaacccacatgtccaacgcagatgagtgataagaaaaatgtagtatatatatatatatatatatatatatatatatacaatggaatactattcagccataaaaaagaatgaaatcctgtcatttacagcaacttggttggacctgggggacactatgttaagtgaagccagccagactcagaaagacacataccataccatctcactcatatgtggtatctaaaaaaagaaagttgatatcatagaagagtagagtagaacaacggtaataagggaaacagagactgaggcagaggtgggagaaagaaggaaggatgtggcgaagttggtcaatgcatgctaagatacaattagaaggaagaagttctggtgacaatgcttatcagtaaggtatagtgtattacaaaagagctaggagagagcttttgaatgttctcactgcaaagaattataaacacatgatgtgatgaatatgctaagactatgatttgattattatacaacatttatgcatctaaacattgatttgtactccataagtatgtacaactacaatatgtcaataaaaaataaaaattattctgatgaagaaaaatatatttggagtttagcaatttcttctaattgactttgatttttgttaaattcaaggaaaattactgaaagtaatgcatttattcaaaatataatatggaatgttaccctattttttaaaattatttttctttccaattttctatctatatctctacatagatggctggaatgatgtttaataaatgttaataatgaatgtttcagtgtggtaagattctgtattacagtatatgtaatttattttctgtgcttttctatattttatgaatttctgtcataagaacgtattgtttttataaaatatcaaattgattattttaaaacattgtgctaatgtcgataacatgggtttttttccccatgtggtaaacagaataatgtccccctcaaaaatattcacattataatcactggaacatatcagtatgttatgttatatggaaatgggaggagtaaggctattaattagctgaccttgagatagggtgattatcctatactatccaggtgggcccagtgtaatcagaaaggtccttataagaagaagaaggcagaaatgacagaatcagagagatgacagcaggagagggagtcagtccagctctactggctttgaagatggagccatgggaccatgagccatggaatgtgggtagcttctagaagctggaaaaggcaaaggaatggattttttcctagagtctccagaaggaatgcaaccttacttacaatttcatttttagctcatcaggactcatgctggaattctaatctatagaactgtaggaatacattcttgttattttaaatcattacgtttgtggtaatttgttaagtagtcataggaaacaaatacactcacttccacttaactattatctaatttattctctactcagcagccacaacaaacgttataggcctgcattgtccagtataatagccattagccacatgtgctaaatgagcacataaaatgtggctggtctgaaatgagatgtgctgtatatgtaaaatacacactggattttgaagacttagtatgataaatgtaaaatagctcattaataatttttaatattgacttcatgccaaagtgataatatttgggctatgtttggttaaataaaatacaatactaaaatttattttccctgtttcatgttacttttaaaatatttgtctacaggaaagcttaaagctacttatatggcttacattgtatttctattacacagtgctgatatagaaggcaaataagacactatcattttcttttttttttgagacagagtctcgctgtgtcacctaggctggagtgcagtggcgcgatctcggctcactgcaaccgccacctcccggattgaagcgattcttctgcctcagcctcccgagtagccgggactataggtgcccaccaccatgcccagctaatgtttgtatttttagtagagacggggtttcaccatataggcccggctggtctcacactcctgaccttgtgatctgcctgcctcagcctcccaaagtgctgggattacaggcatgagccactgcgccaggccaacactatcattttcttattaaaggccttcaatgtcttcccactatacatgcaatattcttcaaactccttaacttgaatttataagatcttgcatcatctggcttctggtacctgtttagcctcatcttttgcctcttatactccattctagtgggccaagcttgtttctgcacaggggctttccatgtgaggttcagtagacccaggaaactcttcatttcactattcatttgattgaaaagctctcatccttccctctcagctcaagtgtcactcaggtataccttctctggaatcccaatgtaggtacattttgctgcctcattcatagcatgctgttatttttgttaatggcacttttcacaacatgtaatgataaagtttttgtttatttctaaaattctctttgaaaatgataagctcagtgtatgctttatgtattaggcaaagcacagatgctcagtaaatattaaattaatgtagaataatcaaataagataatgtttatgtgaacacattataagctataatttactgtacagatgtaataatagtaatagtcatagaaagagaaggaggaagataagggggaggaagaaggtaagaaattaaagtctttgctttgcatcaatttttaatagatttttttccagtctcttatgtctttaaacatttgggaataagtaacacaataagtagctatattccattgctttaaaataaaagatctattttcaaagacatatcccaatttcttcttaaaggaagttttctaaattgtttgctggtgactcgggttcccttctctaaggcataatatgtatatccacagtagtgaacacaatgggaatggagtgtggtggagtaggtgttggagaaagcaaagcaaaaccagcattaggatggttatatataataggaatggttatcatataataggaagtcagactgtgcaaatatttgttactgctatacctactctcttaaatatgggagtagcattatttgtgttctaggtgaagctgtccagagctatatgtctatttgagattgttagtttttgcaacaggaacatgaaatttgtgtccctaattgtaatgctcaacagtcttgctataaataagtataattgcactgtactttctttatatttttttctaattagaaatttatttttccctgtcaaagtcagagcttaagcacggcctttcttaaatgatcttaaagtaaattttcctacttatgtgccttttctacaatcatttctgacttaaagttaaccttataattagcattttaatagcccaaaagccttccttgtacttagtagcacattacgatctgcattgaaataggaatgttataaaagaacaaaataaaaaaattacttatgttagaaaagttgtttttctaggttttgtttttgtgttttccttatggcatatcctctctatatattagacaaagattaaaacatctctttttgaagttactgaatttattattggggaaagttatcaaaaccaatcctctacctttaataaaaatgccttaatgtgatattttaaaaataatacccaggaaatgatgctttcaaaattaagattgatctactcatttccaatttggagaaccaaaggcaaactaaaaccttttggcttatatttgttagttatagatagatatggatatggatgtaggtatagatatagataaaatcagacttgagacagcattgaaaaattgaagtgtgccattattataagataccatttaataagccacaataaaaaaaatcttattacgtgattcctgtatatgtgacactgtttgccttagatacatctctatcttttgctgctatttccccatccactcatacacacatacttattttatcaatgtctcaacacctgaagtactcccacttctgcctctgtgccttgtctaatcatcgcatctccaatcagattgcctgagttcaaatgttcttttcacgacattatttgctgtgtagccttggtaagttacctaacgtctctgtccttcagtatttgtatctgtaaagcaggaaaaatgatggtacttcttcatagaattgttatgaaaatgaaaagtaatgcatgtaaagtattttggcataatcttggcaataaatgtaaactattatttttactcctttaaattatacgattaatactactgctactattttctctactgccagccctctatatactctatatttattaaatcagttcttaaataatccttctctccgtagccttcctgtattaaagaggaaagataagagctcttttctcaccccacctttgcttctgtttcgcttgcttctcattgtcttaagaaagagacttgcggggttaacagcagcatctctggctgatgtaatccaaacctcaaaagcaacatattaaaaataaagcagaacatcaaagctggttctttaataagtcctctgtttccttcgggtcccacacctaggcgacagtattttttcatactttgttcttgtcccctattccatgtcttgcagatctagctcagttttgtaaattgcaaccttttctcctttcttctgtagttagttcatttcatttgaaataaagcatttaatgatcatctagccctgtgctagggagtcaggatatgagggagagttcttaaagaaacaaaatcgtgagatactgcctcttctttcaccaaacaggaaattagatttgtataagatttatatgaagtaggccgggcgcagtggctcccgcctgtaatcccagcattttgggaggccaaggcaggtggattacctgaagtcaggagttcaagacagcctggccgacatggtgaaaccccatctctactaaaaatacaaaaattagctgggtgtggtggcgtgtgcctgtaatcccagctacttgggaggctgaggcaggagaatcacttcaactagggaggcagaggttgcagcgagccaagatcacactgttgcacttcagcctgggcaacagaacgagccttcgtctcaaaaaataaattatgtgatttatatgaaattattagaaaatcctgaaagaaagagtattcatttggtcagcattcatcacatgtactaaaattatttgtttttacatttttctccattaccatagtatgagttcccttggggaaaagtcagtgcctcagtaatactgtttatctgctcaagttcctgtcttgtaggaggcattgaagatattttttgaatgagtaaatggcaggatgaaaagatgagacctagatcttatcctcaagaagcttctagtctgttagaaaggatcacttgtgtacataagtagtagtaatccttattctagcctacatttatagactcttctctcctctacttcccaatgtacccagtccatagagaatatgacacgtatgcttacacctctctttcataatttcttctgctgagaataccctttcctctttttccacttatgaacttgtattcatttatcaaggtacaactcttaatagtatcttatcagtaaagtcttctctgagtcttttccccatgtagaacaaatccctctctcctctgcccacttacagcatttttcatatacctcgcttagctcttagtacattaaatcataattacttatcattttttcagctttaatgtgaactccaaaaagagtgagaccttatctaattgatctttgtaattctagggcctacaaccgtgtctggcttatagttagtgctcaacacatagttgactgaaaaaaaaaatgaatgaatggatcaatgactcaatgaataattgtgacaaataccctaaaagaagtgggaaaaaaactgatatatgattgttattttgtatagtagggtcccaagagccaaattcaaattccccctttttggttaaagctctccctgcctcagtctcactccttttttttcagttcctataccttctgtctgttcttgactttgccataaccgttgcctgttatgacagattccgtgagcatccagcacagatgtatgtataaaaacaagtaagattaaccataggtgagattttgtcacttgaaacataataatatcatgtataactaattgttgcatgttctaattaattgcatattttgattaattctttggcagggaataatcctggactaattttcacagaattagaaggcagtaaaatatactcaccactgcaattatactaaacatagttgaatggagaagattggtttgaatctacactaatcccaagatgtacatgggaatttgttctttaaaaaaatacccagcatacttgtcatttatcatattgttataaaactcaagaagagaaaagaccccaattacttttgctttccagttgtttggagatctgataaaaggaggtattttgaaaatggctcaacaacaactgacaaaagtccctaatggatcatatgctttgtcatcctcagtagcatcactggtttactctgcaaacattagcagtttccttaatctccacagtcattggcttgagagtgaaaacactgcatcacctagttagaaccacaaaaactagattggttttatatttaagtgctttgaaaatttagaataacacctggtaacttataacaattgtccagggaacatctataacgtgcaattgctcagggagtgtttcggtaaaatttatcctgaaacaagttggccagcagccacatcttgaaaacatctatgttataaagaaaaatttcatcatactggtacatttttccatagagtttggcatgtattatcaatccactattactttagaagtataatcttaataatattttttgaaaccacaaggtttacatttatattttcctgattttctaggaaaattagatggacctgtgatagaagtagcattcggtataataagtatattttacagtcaccacatacacagttactttgaatatctgtcttcattctatatctaccaaggattccacgtctcactatttccagaaggctttttcaaagcacgaattctactgaattgagaatggggatgttgtttgttgttttccagaaatagacttgcatgctactatattttgagcaaatgatcacaaacacatccgcatgagaaggcaacagatgtaaagaaaaaacttctatatttattacaaaccaagggagcaatgcaagtatcacagcaaatttgtaccaacaattatatatattcttttgctgacagcttggtctgcaaagctgctagagtgcagaatcagcaagtctaacccagaggcaactccaatctgatggataatatttgattcagtaaatgaagtcaagtaggagtttaaaaaccagttacatcttctttcatcagacattgcttcatcttgtcagtctttttttgtagactgtaaattgaataatacaaaatgttatctgcaaaaaatttttcagcttgttataaagtgagaccatttgtgaaaggatgaaatagttacaaatgcgtatttgttactgataaatgatggcatgtatgatccagtgttttgaactttcctccacattaaaaaaaaatgttggagataagaaaactaacccaggtttttttttttcttctgagtacaacagataaaaggaaaagttagcctgggagggatttttgaagttctttggttcactgattttctaacctgctttcacattataaagcacctaaagtactttttgaaaatatagtgttaggctccactctgaaattttgattcaggaaatctgaaactacctactaagtactgtcaccacaacaagtctatgcacttattcagaactactgatctaattcaactccttactcaatgcggaatcctctttacaaaaaccttaaaatgtggctgttcactgactcaaggcagcatagtccattgttggacaattctagttcagagaaagtttttatgtattaaccccaaatcctagaaacttctccccaatattgtgtgtccagcaacttcacatgacccttccatggtcacacatgtgcttggttcatcagggactccttattttgcttagccaattctgtctcagggcctaaggagtgtgcgtatcaaaaaacaaaattgcattaaaagttacatttatattgatgaaacaaaatatccacaggtttatgtccctcaattagtagctatgctggattgagctgttcactcagaaatggcttctaataacttaaatgttggctgagtatttaagattaagatttgccacttaaatgacagcaacacttcattcagtattgggaagtgtgagaaatttgactgacaagccccactagcctatttacaggtatcagggttacagttgaatttaaccttacactcaggcttctccagaccaaaagagccccatcttctgaacttcctcaaaaagcgaaagacagatctgagaaacctgtgccaagacaatcacatcactgggaataagaatagtactgtgaaccccagaaatctaagacaggtctcagttaatttagaaagtttattttgccaaggttgagaatgcacacctgtgacacagccttagcgtgtcctgatgacatgtgcccatggtggtcagagcacagtttggttttatacattttagagacatgtgagacatcaatcaacatatgcaagatgaacattggttcggttcagaaaggtgggggacaactagaagcaaagacaggacaactcaaagtggggagtgggcttccaggtcaaaggtagataagggacaaaagatttcattcttttgagtttctgattttcctctccaaatgaggcaatcagatatgcatttgtctcagtgagcagaggggtaactgaatcaaacaggacgcagatttgccctaagcagttcccagtttgacttttccctttagcttagtgattttggggccccaatatttattttcctgtcacacattcccccttctcattttaaaaatcttttggagaaagcattttagaagaaaataagtctatgatctcaggtttcgtctgatagatcatggctagaatggtttattcctagatgggtaggtcctgagttattaggaaagttcatttttagcaaattgtgaagtctcatgtttatgaagagaaaatagggggaagaggggagaaaaacaacaacaaaccaaaggatgagtctttactcatcctggaaaatcaatataaggcacattactctgaagtccatacatcagtaggcagctatgaaaatggtttatgtaggtaaataggttgctgttattttcttctgaagtttaagttgtctagcttcagttcacagggctttacaaaagcacagcttagttttcagtgactccaagttagaaaaatgtggggaaagagaaggagaaataactgaaaacattattttgaagacttacagccaagaaaaattagaattcattccaaactatagaaaataataaaaattgaaaaacattaggcaagactagaatctaacaacacgtttactacagttttttaaacatattttttctctctccagttttccatttttactaaagacaaattatggtaggactgatttgttttattatacttggcctgattatttgtatacagtgcagcaagaataacattttttacagaagcttttaaattggctttgatggaattttgtttcataggagtctcagataagacttttaaagctgagcccagccttggatttataccatcaaatgcctatgatttgggtgaattcctcttctcttgaggttccaagataaacctgggggctcctggtcctgtcagaaagtgacattctttacttaccccgggttaggacccctgtacagggaatgtgtagacaaggtataaagtcagttttcccaaggggcttttattggctccacaattcaagtttgattccttaaaggaaagcacaccattccagtcaaagccttagtaaaataaccagtttctccaattgcgtcctgttatagaggaaaacagattgttatttcacttgtgcaaataacaaatattaagaatactcataaatagcttccaaatactggagaattcaggtagagagaaacaaatatattctaaattttgttcatagaagtataataaattgttaaaagctgccaatagctcaaaagaaaagtttccttgactctggaaaaacagaacaaaggatcagcaacgttttaagcaaaaagtcaaaaagattacttccgtcttctactagttcagtccatgtagttaattcctgttctgcttgatattcatgaacatttcagttctccatgagttctaaaagttttacttctgttctgatgttacaatcttcaaagttatcagaaacttgtattcaagagcacctgtgggagttttatagctgattataaaaccaccttctaaagaggaccaaaacaagacaacaattgtctgcagatgacaaaaagttttagggcagccagagtcaaggacacaattgacaaggaaatttgttgcctttgttgcacacaaaaaattatgttaataatttaacataacaattataattattactgataatgtccactaagtcatatcagaattataggagtttcccattattttggaacacatagcaataacatatgtatacaaacacggtgcaaagaaaactaaaagccatttcatatttgacagtgttttctgtataattttcataccgaataaaccaaattgtcatttttggacttcaggaaacctaatatcttaaaggattaattaggtcagaaaaagacataatttataatttgattttggtaagtttgtcaaatatccaaaagttagaacacatgatatcacaggtcattgtaaaataagtcattcatttggccaaagtgataactcaaggatttcaaacaaaaagtgagaaccttcactctttgagagatttctttttcctttctcttttgcagctgtgaggaattttggccatattagagagactttgttacccataatttggaattctcactcagatttgacccagtcaggtagagttggtcaaatctgatgggagaaagaatggaacaaacaacaacaacaacaaaaacccaacaatatgatcactgagcactctaatggtaaggagaaattaagacaagttagttgttaaactttagccaaggcaaaaccccaattcagctacttacctagggatggttctcaggctgaagatggctttctaccattctagaagcaggagaaaaaatcctcaaactcatcttccctactgggagcgaactcaaactccataaaggagttacctaccttccatcatcatggaaacaggaaatcttgccttccttgttggaaacaagtaaaaaaaaaaaaaagggtgttgacagcaaaataaactttagatcttgaccaaatttggggagatcagggattatctggagggggtgctcctagacctaagcaaattttcctattggtttgagccataaagttagttcatacttgtaccaagcaccagtaggagatttgtcaaaaggaaggggcatctttattcagaatcccttcatggttaccaaaatgtgaaccccaaaaatctgaaacaggcctcagttaatttagaaagtttattttgccaaggttgaggatgcacacccgtgacacagcttcaggaggtcctgatgacatgtgcctaaggtggtcagaacacagtttggttttatacattttagagagacatgagacataaatcaacatatgtaagatgaaaattggttcggtctggaaaggcaggacaactcaaagtggagaatggtcttccaggtcataggtagataagagagaaatggtggcattcttttgagtttctgattagcctctccaaaggaggcaatcagatatccatttatctcggtgagcagaggggtgactttgaatagaatgggaggcagatttgccctaagtagttcccagcttgacttttctctttagcttagtgattttggggccccaagatttattttcctttcgcagtactcaaatggagcaggaagtggaatgatacagaggacgtacattgaatctggggatgggggtactgtggagaagctagttaaacagtaaacagtcccagctactctggaggctgaggcaggagaatcgcctgaacccgggaggaggaggttgcagtgagtggagatcattccattgcactccagcctgggtgacaagagtgaaactatgtctcaaaaaaataaatgaataaaataaaaaataaaaattaaaaaaaaacagtgaacaaagggattaagtgtgtactgataatccttttctttccaccttgtcttccttcttggtggtaagcttagctcttgcttagctcagttcacacctctgccatgccttgtaattctgtgggacatcacccgggggagtcctattttggttgccagctgggcttggaagtacaggctctttactctgggtctccatccaactgagccaccagagcagggtcagacttgaaagaaatccagggcagctactgtcctgacagataacccagcatctttcattccagagaacagtcaaattagaggagagagatttaaatcttaccttgctgagaagaggctgtcacaacccagaccgctcactgagaacagcattctgactaaaccttggaagggtatggacatagtaaaggagattacttgggtttgaggtcaacaactctctgcactgaatgcaatgagggtgccaaatgtcatcttctaaattaaggacctggccaacttaatgcaaagacaggcaggggaagaaaaagaaaaatacggaggaggaaacaaagacgatgagagtaaagtcaggaaaagggaaattgagtatacaggaaaaaggaaaggaatttgattaaggtgaatgggaacatctccttccccacccccacctcaggaattgttaggactgcagctgctcttttaactttttttttttcctgaagtcaatttttatgcataggactcaggaagtttaaaattaaatgacacttgccagttttttgactcagtgtaacttccctctcatgttatcctttttttttcctttgctgattcgtgtaagcaaacccattatctgaacaaaggggagctgacagagtgtcctgaccttatcttttccaactcctaattattttcacaaggtactgaaatgaagttttggatttattttttaagttggggaactagaaaataaaggagtgaaattgtgctatctctgatgacaccaacaattttccagatttaatttagtttattttaaaaaaatgctacaaaaaaccccatcctaacaccaacaaaaagaacatcaacaaaccagcctgactaagcccagacccctgtcaggaaatgaaattgattaaaggtgccccctcttcctgttactgtctgtaacacttgtctatttctgccaaaacatgtatcaaaatctgtaattttcttgtttattttttctgtttttttttttttttatgttttgcctgtctccctcccagtagaatgtcagatccattagggcagggattgattaattaattgttttgctccctaccatatatatttctgaactaggaaagtacccagacatagcaggcactcaataaacattgattgattgattgaatgaatgaatgaatggtgaggctcactgaacagacagaacaagcctttaggagagatccaaaccactagtctgtaaagtactatgtcatctgacccctgcctaccacagcaacttcataatttactctccctctgacctttgaactcctctcacacactatattctacctacctcagggtgtgatacatgagatttcatttacctgggattttgggatgctcttactggcttggcaacttctcatctttctgatctcattataaaggcacctacatgaaaacttcttggccatcccaagtagccaagtagcctctccttagcccctattctactccttgttattctctctcattttacattgttcctttccttcaagggattattttttgtaatttataattctatatttatttacttctttattgcctgccccctcccattgttatattcataacgactgggattatgttttttttttcttaactctgtatccccaacatctaatacaatcattggtacagagtagataattaaatatttgctgattaaatgagtaagtaaatgaataaatgaattgctaatgttccttctcccacacctcattgtgcagacatgccatcctgaggtctggtgtttttatacttttggcatggccatgtaccctcagaccccaccagagaaaaccttgggctaggaaagcctggatagtcccaattacacttcaatgatttgaaattaaggttatatgaataatttattttgaaaggaagaaatataaagaagggaaacatttttgttttcatttcttatgctcaaagtggtttgggttcaaagttggatttttgttgtaaatacaccacacttgcagcaatacaatataccatgttatttttgtcacaaacagcagatttcctaatgggagctagagagtcctttgggaacttggccaaccaggcctagtaagccattttgatcatgtcatcttggattaattgctatttgggctccatgctttctttgcctggattaggggacagggcttgtgcaagctcctgatcaggcctcctgctgccagcacaatactgtctcccactctcctcaaattctttatcttcacctgttctggaactctctaacaccctatgacttcagcagctgttgtctctgcccctgaatcagacatgtgttcaatagaggggtttatataactaggccctgagaaggatttttccaaatggaactaccccatatattttatttactttaggatatattgcttctgtctctgtatccttcctagtaaatatcatgtctcttaactttctggagtcatgtttataaatgcagcagatttgtgtactatgtacagaccttgctgatttgcagctcctagcaccaatccttgtgtttagtagacattcagtaattattgtttaatcaaattggatcaaatctgaaagcgtattgatgccattagaggaagaagaatccaaaaagactgtcttcctaggaaggaaacttcttcatctctttgacattttgagaactccttgtgtgagggcaacatgtgtagatgagatttagattatggtttaagactaactactaactgctggcctctatcagtaacaggaagggacagttagcaaaatggtgattgagtttctgattcagtttctattgaaaggatctaaaataatatgtatacaattcattgtaactagatgttggaggtttgaaatattccgaaaaggattctaatttaaaatattgaaaaatatgctttgaatatatacaaattcaaaacactatatgggaaaaatgaaaataaaatagaaattgtgaataaaatatattaatgttacaaaagaaagtaaaattgaatcatatagtaacatctagctttattttcagaaagtattatcaaatgaagaaaacactaatatctaaaacaaaaaactacaaaatatttgatgcaccaaataaattgaactatcaagtatttccaaaggcctaagatttcttacatatagacagtactaatataaaatttgtgtgagttgtaaaaactgcccagttccagactccaagggatacaaacaaatatagtagctttctttttctctgttgaaactaaattttactaactcctggacttattctcatttccaggtcaagattttgttaactcagactttatacttcgtccaaatgacatttgcattgacaatctcagaaaccatttttgtcagagttcccgacaacatccaactctgtctgagattccccctaaatctctaggggtcatctgagcccaccttcaccctgcatctcctgctccttttattcacttctgcgaaaagagggagttgtgttcaccttctttttgcatttagcaaatgaaaacaatcaatggtatttacaatttccaacatacataattaagagacaaggcagaaaagatttaaagcagactttcaagatttagtcaatactaaacctgtggtacatttgtatagtttgctgatctggatgctttgaggatataatgtccctcctatagaactaatcattcatgctgcttagccctcatttattttctgactcctaagagcaccatgctttacgtaaaatgagtgcacaaaggtcaggtggcttgagaatttgtatttagttcagagacttgaaaatttggtaggctatgcttgtatttttttcccctaaatctgaaaaacctgtgattttcctttccccagaggcagtctgctggattagatggagacacgttctgccccaaagacagaaactaaataatatccggaaatatcttgatctgaagcaaaagccatgccaaacgttactgaagaaagctttgaaatataaaaataagattagaataagaatcccagtgtcctacactaaatattttaacaaagaaatcgttcaccacttagcactttgtgtaatactgtacagattctaaataaaaatgggattacataattagtacattgatcaaaaattgtgaaaattagcttcaagttcttaataagtcatagctgaacctcagcatgggcaaactgctgaatgttcaagggatgaaaaatagaatttctgttatgtagctctaggagcatcatgaaaatattcaatcaatctggcagattaaagatactgcaggcatcctttattgtcagagatttgattcataatctatacttatcaaatttggtgacattaaacagtggttttcaaaatttaatatgcttcagaatcaactgtcatgcttgattaaatgcagattctttggctaatacaaaaaacagtctcattcaatggattggtgttgacccaagaatctgcactttaacaaacaaggcaggtaattataaaactagttgaccacagactatgtttggcaaacaatgctctagtaacccaggggtcagcggacattttctgtaaagggtcagatagtaaaatattttctgctttgtgaaccaaatgatctgtcacagctactcaactctgcccttgtagcatgaaaacaacaatagacaatatgtaaacgaatgggagtgactgtattccaatcacattttatatgcaaaaagaagccttagcttgagtttaacccgtgggctatagatagcatacttttcagaaccttggtataaagaattaactcttgttacacacctaataccttcaatctcaggtttttctttttgtatctggtttatagtagagaggagcatctgttggtcaactgtgattttagagtctggctccatttgctattgtaaataccaaataaaatagagaacaaaattttttgagctgtctacacaaaataaagggaaattctcatgacctattttccagaaaatcttcttggattaaccaagccctgtctgtagttaaccaacacattctcctgctcatgttttctctacaattcgcattaatgattcttaaccccagtatgacaataatatggggcaggaagattgagcaagctcttttgatagaacaaggacaaaacatacctggcatttgtgctgccatttcaattcacaacacccatagtagacattgccaatcaccggtagtactctttccttctgagtgcctatatggccacaaagtatttctcaagaattccaggtactcattaccatcagactagagttgtcatgtgagataaaaattatgtgtcatcccttaataagctagccttactatatagaatttttattatctggggttattctatttggaggcacatagtattatttctactatatcttaatccatataattatgagccttgcttaatagagttacataatacacattttaattggttgtcattttctgttagaatattagtatcaaatttgaggactgtgactagtttatcatgttataccctgagatcattcgagaaacacttgttgccaggtttgtatatcatcttttctcattaaaatttctatattcatcatgtctatattcatcatgactatgatagtatactgaaaacttctgctaatagttacctaactaaagggcatttgaaaccatataaactgacattattggcaatctgtaaattgaattgacctatagtttcttttctggaaagatatcattgcaactatagcatatctttgaagtagcattttagatctatttgggttaatatttactgttaaagaattgtttggctgcataattaaaatgttcacttactaagcacaatgtagtttctagcattaaatggactctcttgcacagcatgctaccgactctgcaaactcatgaagtcatatgctagctatttcagtaaaacttatttagtaaaacttgaagaaaaattagcatttaatgaagcaaagcaattttcaaagcatttacaattccatcctggcacataaagttcatgtgtaatatgactttatctaaatatttactgaggtggtagcaagtgttttactgttggcaggattggttatgaaggatttgacctgaaactcaaattgaataggatgaaaagttaagtacagagagcgaatacggtctaactaggtggcttgccacaaagtttctagcataggcaagctggcatgtgatctgagaggccatctccattagacacccagcttttcacctagcaaatttgatagaaactcaaacaccaaaatgaagcagatggatagtggcaaccttctgtatctagtactggtgtttcagcaccataacctcccttataggtattctccaggcttttcctatagacttctgttatgccttggggaacatgatctgacctctgatatttccaaatctccataacaggatctgagtttgtttatttttaaccaagcttcttcccttaaaacattaaaaatctcttctagctgctcaacaaaactttcgacggctttaggcaaagagagagcatttgttagaggttctaggaagacccaactccagaaataatatgttccccatccttatagttctgatgtctgtctttgagacacataagaaactgtttactctagatattctctatacttgacatttatcaagaagatatgggaaataaagaggggttataagtgaatctatgagaatgaagcacatgcaactcgtgcaaatttcagagagagaagagagacagtggaacagaaatgttggtgcaaagggggccttgcaaaagaaagtggggttgagaaatctgtaatggacgctttgaatactgcaggaaatgagatccaggtgggttttggacatgttctggccaaaattgtgaccaggtttatcaactattgacaagcttagtttaccaaaccaagaaccttcttgttctaagatttcagtacacaggactaagcttccagaaaatttgggtagtagattcagtgtcttcaatttgcctttttttttttttttttttttttcacttttctcactctggaattttcccaccacaacaatcacatcttgtgcttaatatcctccctaggcattcagccactctctttggaatatcaaaacatctggaaaatgttgggtgagctcatttgctctaaggtgttaatgatgggtgaaaagcttaatatgttgcctttcccatgtgagtgtgtcttgggtccaaaaaatgactaatgagagctattctgaacattcttcagtatgggagaggtataggtgatatagaaggttttcttactgtcactgaaatcacagtcctgtaggccactgatcactcataaagtcttccctgtggttggctgtggaaatacagataggaaaaatgtggctggttctctcagtgtttgatctagaactatcattaagccccccctttttttgcttttgtttggttcaatttgcttttagttttttgaaatcaggctctgataagaatgctagaaaattctgaaagactcatctcaagactttctagacaaacaatgtatattttattttttgtacaaggttatttggggagtgggataagggagaattcagagagttcagggcaaaccctaggatacagataccaatttcagagtgccagccaggccttagaaaatctacttaccatacccagggaacccattgctaatttgaatgaccaatttgttgtttttaacccaaagttttctctcatcaagtcattgtctctatttaaacaattatttgccagtctgtataataattgatttttttgtcttggtggcagatgggaaactaacacttgtaatgttatagaccatgtctgagcatgaatctttagatcaacttgaattttaatatacaaggttatttttgtctttaataaatgacttgctcattggtatagaagatacacttttattatccttttattactttccatgtagttcaaagtttaatatgctagtctagctatgattggttaagaaattgacacacatggctattattgagcacaatatagtgactatcaatatgtgttttttcccggagtgggaaaaaaccccacatttctcacatttgtacactttgagagttggaaatcatcaaatatttagctagttccattgatcttagcttattaaaacttcttgtcaaatggtaggaattcttagtttattttactgaagcaaaataaacctaaatgaattaaatggttctgttagttgcggcatctataaaattaggaaattgggtgagatgaatataaggtgccatagctatgtcctctaatattccttcaagcaaacatctatgaatccatgtttagatttggctccataacaataatgccttatatgtgatagcactctctaatttacttatgtgagcttaattgacttgcaactaccctattcctttacatatttactaagttcctactaattgtccacagtgtcattaggctttgaaaatataaagctgaggtagacagtcccgtgattattgtccccattttagaaagaggggatcacagactcaaagatgtttagtgaccagagattacagttgtggagctgggacagaattccaagcaatttgacttaacctgttcatactcaccttctacctcttgtgtgcaagtagatggaccagacagaaatgcaaaagttaatgatatggatatgtcaccaaaagcatgatccataaaagaaaaaaaatgataaattacacttcatcaaatttaaaactttgctctgtgaaagacactggtctttcatgaaataaagaaagacaagtcacagactaggaggaaatatgtgcaaattgcagatctaacaaactcgaatttataatatttaaagaactcttagactcaataataagaaaaccaacaacacaatgaaaaatagattgaacagatagttgaccaaagaagatatacagatgctaaataagcgcatgaaaagatgttaaatatttctagtcattagagaaaagcaagttaagaccacaatgtgctaccattaacattcattaaaatagttaacattaaaaaatactgacaataccaagtgctgacaaggatgtgaagcaactagagccctcatacattcctggtagaaatgcaagatgatacagtgctctggaaaatggtttggcaggttcttataaagttaaacgtgtacttgtcatattgaccagcaatctcagaatgaaaactcacatttgcgtaaaaatatatacatgactgtttacggcagcagtattcataattgccaaaaactgggaacagactaaatgctgttcaacatgtgaatgaatttaaaaaattgtggtgcatccacacaatgaagtgccacttgacaatgaaaaggaagaaatctttgtccactttgtgatgggattgtttttttcttgtaaatttgtttaagttccttccaaattctggatattagacctttgtcagatgggtagattgcaaaaattttctcacattctgtaggttgcctgttcgctgtgatgatagtttcctttgctctgcagaagctctttagtttaattagatcccatttgtcaatttagcttttgttgcaattgcttttggtgattttatcataaaatctttgcccatgcctatgtcctgaatggtattgcctaggttttcttctagggtttttatggttttgggtttcacatttaagcctttaatccatcttgagttaatttttgtatgaggtgtaaggaaggggtccagtttcagttttctgcatatgactagccaattttcccagcaccatttattaaacgggtaatagttttcccattgcttatttttgtcaggtttgttgaagttcagatggttgtagatgtgtggtcttatttctgaggtctctattctgttccattgatctatatgtctgttttggttccaataccatgctgttttggttactgtagccttgtagtatagtttgaagttaggtagcatgatgctccagctttgttcttttggcttaggattgtcttggctatgtggacacttttatggttccatatgaaatttaaagtagttttttctaattctgtgcagaatgtcaatggtagtttggtgggaacaacaaacatatgaaaaaaagctcaacatcactgattgttagagaaatgcaaatcaaaaccacaatgagataccatctcatgccagtcagaatggtgattattaaaaagtcaagaaacaacagatgctggcaaggctgtggagaaataggaatgcttttacagtattggtgggaaagtaaattagttcagccattgtggcagatggtgtggtgattcctcaaggatctagaaccagcaatcccatttgacccagcaatcccattactgggtctatacacaaagggatataaatcattctattataaaaatacatgcacacatatgtttactgcagcattattcacaatagcaaagacctagaaccaacccaaatgtccatcaatgatagactggataaagaaaatgtggtacatatacaccagggaatactgtgcagccacaaaaaggaatgagatcatgtcctttgcagttacgtggatgaagctggaagccatcatcctcagcaaactaagacaggaacagaaaaccaaacactgcatgttctcactcataagtggcaattgaacaattagaatacgtggacacagggaggggaacaacacataccggggcctgtcagagtgggggcaagggcagagagagcatcaggacaaatagctaatgcatgcggggcttaatacctgggtaatgggttgataggtgcagcaaaccaccgtggcacatgtatacctatgtaacaaacctacacgtctgcacatgtatcccagaacttaaaataaaaataaataaataagaaaaggaacaaaccactgatacatgcaacagtatggatgaatctcaaatgcacaatgctgaatgaaaaaagccagacccaaaaagttacatactttattttttccactaagatgacattctggaaacagcaaaactatatggagagagaagagatcagtgattaccaaggggttaagggagagagactgacttcagaggccagcatgagggcaatcatgctggggtgttataactgtcctatatcctgtttgtggtgatcattgcagtcatctatgcatatgttaaaactcgtagaaatatatatccaaaaattgtaataaaataattattacacattaatcctgacagttaaaattggttctagccaaaatttaaaaataagtgaggtttgaatttagcaataaatgcttcctttacttttttgttattagagacacttttctatgtattgtctttcctcagttctttctctcagttttcaggatatgatttaataaccaattcacagaaaagtttaaatgactgataatagctacatgtgtttcctctagtagggccatattcatttgagcaggttaccaaaatcttaaattaaaataacgcatttccaacagtaggtgggatgccaagcaacagccaaaggataaaggagttggtagggataaagagtcagaacagcctccattacattactgaaatgaagatatatttgctttgaaattttaattttggaggttgtataagaatatcacttagtctatatggtactatagacaaatatatagaaatgtagataacactcccaaatactgatgaatgtgctcagaccaggaagggaaatcttacatggaacaataaaaataagtgtcttgaaatcttaacttcttaataaatcatttagttgattgatttttacatcaaaattctgaaactaaactcattgtaaaaatataaacgtatatatatatatatatatatataccatatttattgtcactttctgagagctgagcaactatagttgcatataaatcactttaaaacttatgtaatagtgagaattcatttgtaaattatagtatttttaaagcaaaatgtcacccagtactttatttttacctacatttacatgtcaggtttccttaaagtgaggtatacctgcacaagaatggggaagttttgagcactatagaatttgcttacttcttttttattcttattaatatcaaatacaggtaaaccagactttacaagcaatgctacaaacagtgtagaaagtgtctctacatctatcatataaattcatgtttattagatctcagtgagagtaataaagagtttcaaaataaattggagctgcagttcttttcaaagtgaccccggtaacaatgtgtctgaattggaatactttatctatattgatttttattttcatgtcaagtttgaaaaatatgtcaggtgtactttgaggatacataaagcatatattcctaattgtatttatttttttgctactgtctatgtcaggtgtactagaaacatagggattattaaaattaactaaaacatggcattattacccatttagaaacaggtgctaggaactctcaatcttgggttctatgtacccagtttcaatcttactggtcaattctgtttaaaagcaatccaaaccagaattttctctgaggagaacaacagtaaaatataaagtgttaccatgggttaaaaaaaatagttgagtggatgaatatttagtcacagccattaacctttaattttaatggttttgattgaggaagaagtttttgtttttagcatgacacttaagtaaatgaatggtttgatcaaaatttactgttataggctaaaagtatgagattaataatagaatatcagagatgccagtcaagccactgaagaaatggattcaacctaataaagagcataactcatcaaacttaaccatgacaagcctaaatattcccatttcatcaaaataaaatggctataattaagtgttttaaaattaatgttatcagctcttcattcatccagtcattctaggccctgcttcccaactctgaacaacttccacctctgcctgttccctctaactagggaaatgtatcagactgagtgaagatttgagcaatggcacagaggttgatgacgtgagaaataatgacctggttaagtaccagataatgggtatgtgccaaagattaaggggagcctttggctagaaacaaggggatgtttgaattagcctaacatataagatcccgaagcacccagctccagataaaaagaatcagggatattaaatcaggagggaaatagtagaaggaggtaaaagaccaaacttgataacccaaagtattataaaactctgttttggggttacattagaagatgacttagggatgtggtatatgaatacatcagggagtagtggcgtgttggacaaaaagaaccacggaaatatagaatctctttttgtgcccataatttagactaagctgacatcattgtggctttcgcttctgttagatgggctcgtctgtgatgaggcccaacagatttggctttacttaaaattgagttcttcaagacttcagagtggcaagattacagggtatttatgtggcatccctcctctcccattagtcttcacaacctcaaggagaagacaagtaactgagcataaggaattgatgcagtcctcaggttcatgtagaggtccctctttcctgttgattagtaacctgcttgtatgtttgacattgcttggctgtgtgtgcccacccaaatctcatgtggaattggaatcctcagctgtcagggagggacctggtggaaggttattcgatcatgggggcggtttcccccacgctgttttagtggtagtgagggagttctcacaatattgatggcttaaaagtggcagtttccctggcactccctctctctcctgctgccaggtaagacatgccttgcttccccttcaccttctgccatgattgtaagtttcctgaggcctttgcagccatgtggaactgtgagtcagttaaaccattttgtttataaattacccattgccatgtagtatctttatagcagtgtgaaaatggactaatatagtgttcctaccctgttgccatttgtgagcttgaactttatctcttctgactgtgatcttggcttggctgttggctcagctcttgtgtatttatgatttacttcctttttgctgcatgtgctttacttcagatcctgattgatcctgtatgtttgagcctaaaagtacaactacaagtccaaattgccccttgggcaaatgtttggcattttttttagactctactatgattcttgttaatcctactatattggctcaatcagaagtgcccaagaccgttccctttacaatataacttttgctgtacaaaaaaaaaaaaaaaaaaaaaatggggtaaggaaaaggatggaagaaaaaatgatactaaggagacattaagttaggagaacctccttaacattttgtctattctacaggaaccatcttctcttataaaatattttttggtacaggccagagaaaaacacattgcactgcatgggatggataatttctctggcccagagcgatgttttgtatgtgtatgtctggaaaggagccaggctcaataaggacagaaaatatcaatgagaatgggataggaagttgaatttgaagattatttcgggtaatgaaaaacatctgatgaccttggccgactactaaattaaatctgagttaaaagatagtttggggctttaggaacaagagtccgcaggtatatttctctgttgataactatttgtgatggaagaaatgaggtgaggaatgcctaggtgaatgtctttcacagctaaattgaaacatacagactcagacagaaatggtcatggaggtttacttttaaaaataaattcatataccagctcagaaaacatcccacaaaatgacagtatgtgaagggttatcctcttggaaaaggaattcaattttgaattatccatactacagaccttgggagtctttagtcacttcatccaatgaaaaatggagatgtttgacttagtgacagatgatctgctcaacaatgttttctttcttctattgctgcttcaattgtatatttagtgaattagttgtgattgatgatagcattttaagcacttgatatttttttctggtgaaaagatggcataatttaactatattaatagttttaggtttaagtgaagcacaatatatttttataatccttcaatagtgaagtcacaatttatacaagtggattcattctgtctttagaccacggaactctgacaaaaggatgtcatttaaagtaatgttgctcatccttcagagatgcaaaactgaaggctacattgctctgatatgaaataactttggagttttgaatgcctggcaaaatttgtatatgccactaacagtaacttaagtggtttgtacagctggagccaaatatgctctgcagagaaaaatatcaccaactgctgtaattttcacataagtaataggactaaagaaacagttttgttcagaaacaacaccttctctaaaatctgggcatgaaatgttcaatcggtgatatggattgtctgtgtctccaccaaaatttcaccttgaattataataattcccacatgtcaagggtggggccaggtggagataattgaatcatggggggtggtttcccccatactgttcttgtggtagtgaataagtctcagcagatctgatggttttataaatgggagttcccctgcacaagctctcttgtctaccaccatgtaagatgtgtctggcttcccctttgccttctgccatgattgtgaggcctccccagccatgtggaactgtgagtccattaaacctctttttctttagaaattactcagtctagggtatttctttattagcggcatgagaacagactaatacaatcagtgtcaatgtttattattaataacataattatggacaacgtaaagtgctagtaattacaacagattagagagctgctattttacctcaggtggtattatttggagtctggtatatatcagatttagggtgattaccttaaaaccttagaagaaatgatattaactaaatgttattttctacttagtctgttacttcctgcagaataatagtttatgctcttacttagtaaatgtcacagtaggggagaaaatataagagcatgcccatatacccacacagtctcctttggtgtaactaccacatcacagtatcttagtgctacctgaatgccaatagctaagttttgtaaatggagatgaaagagaactagggaaattaattgatgtgattatctttcagtagtgctgtataatgacgtatttacctaagcttgtaggcctttaagtggactctcaacatttctaatattgaatgaacccagacctctcttaaaacatgccagttcatacatattatgcttataagattcaaacgttctctcatactgatagccttcaactgagatatatttagattatcaatgtcaaattaagacatgacaagttcccaaagacatataaacatgaccctgacaaatgaatgtgctggaagctggatcttatgtagaagtaatagcttccattctgttccagatctggggtgtatgtgtatgtgtgaagttgactgtataaatgtaaaaatttatccaaatctttggtatgagtttctgtgggacctttggatggtacctcatcataccatgtctgaatggtatgtcaggaacataccgttctgacataggtttgaagactagtcttaatactaaagcatttccccacgaataattttatttatagtattcataagtaataactacaaaaaggctcattattatgaattgggttcttctttattttttattttattttattttattttttttggagtctcactctgttgcccaggctggagtgcagtggtgcgatctcggctcactgcaagctctgcctcctgggttcacgccattctcccgcctcagcctcccaagtagctgggactacaggtgcccaccaccatgcccagctaatttcgtttttgtatttttagtagagacggggtttcactgtgttagctaggatggtcttggctagtcttgatctcctgaactcgtgatccacccgcctcagcctcccaaagtgctgggattacaggtgtgagccaccgtgcccggccatgaattgggttcttattacctaccaggggtataaaaatgtgcagtcttctgatcctagctctaggcaaacaaattcataaggtgcaaacattgtgtaatcccttcaatactgctctctgtcactattcacaaatgttagctccctattatccccaaactttgtggcacgtttttaaaatcagtccctagcctgtaaaggccccaaatgataccaacctcccatctcttgcatgcttatattttatacttctgacagaggacatgtaaagctctgcctacatttctattatttacacccgaatctttgtagcatttcataccccaagccccttaataatgtgcagtagaagctctgtgcccaaactgtattggcatatgccacatgctggatcccttctactttgagtgaggacaaagagtcttcatacaggctgggcatggtggctcacacctgtaacctcagcactttgggaggctgaggccggcagatcacttgaggacgggagttcaagaccagcctgaccaacatggtgaaaccccatctctactaaaaatacaaaaagtagcccagcgtggtggtgggcacctgtaatcccagctactcaggaggctgaggcaggagaactgcttgaatccaggaggcagaggttgcagtgaggtgaaattgcaccactgcactccagcctgggcaacagagcaagactccatctcaaatcaattaatcaataaaataaaaacagtcttcatacaaagggtagattataacctatggtactttattggtagtgtcttcattggattgataatttaagtttcaattgatttctttttaaaatgttttaatttttaattattgtgggtacatagtagctgtatatacttatgggtacatgagatatttaggtatagacaagcaatttgttataatcacatcatggaaaattggatatccacccctccagcatttactatttgtgttacaaacaatccagttatactttttttagttattttaagatgtacaattaaattattattgactatagtttctgtgttgtgctatcaaatactaggtcttattcatcctttctatttcttttatacccattaattttccccacctctcccacaatcccccactacctttcctagcctctcgtaaccatactttattctctatcaccacgaatttaaatgttttgatttttagatcccacaaatgagtggaacatatggtgtttgtgtttctctatctggtttatttgacttaacataatgatctcaaattccatccatgtttttgcgaatgacagtgtctcaatcattttatggctgaatagtactccattgtgtataagtacatttatccattcatctgctgatggacacttaggttgtttccaaatcttggcaattgtaaacagtgctgcacaagcataggagtgtagatgtctccttcatatactgatttcctttttggggggtatgtacacagcagtgggatcgctggatcatatggtaattctatttttagttttttgaggaaactccaaactgttctccatatttgttgtactaatttacatttccaccaacagtgaacaagggttcccttttctccacgtccttgccagcatttggtattgcctgtcttttggatgaaagccattttaactggggtgagagtatatcttattgtagttttgatttgcatatctctgatgatcagtgatattaagcaacttttcgtatgcctgtttgccatttgtatgtcttcttttgagaaatgtctattcaaatctttggccaacttttaatcagattcttagatttttttcctatagagctgttgaacaccttatatattctggttatgaatcccttgtcagatgggtaatttgcaaatattttctcccatcctgtggattgtcttttcaccttgttgattttttcctttgctgtgcagaagctttttaacttgatgtgatgacatttgttcatttttgcgttggttcctgtgcttgtggggtgttactcaggaaacttttgcccagaccaatgtcctggagactttccccaatgttttcttatagttgcttcatagtctgaggttttagacataaatctttaattcattttgatttgatttttgtatatggtgagaggcatcatgtttcattcttctgcatattttttaataatgccaaaagtataattcattattaatatataataattacaaatatctgtaggtaaaataatattgttttatttatatgtatttattttttaattttaagttacaggatacaagtgcagaatgtgtaggtttgttacataggtatacctgtgccatggtggtttgctgcacctatcaacccatcatctaggttttaagcccagcatgcattagctattggtcctaatgctctcccaccctgttgaggatttttgcatcaatatttatcatatatattggcctgcaggtttttttattctcatgtgtctttgtctggttttggtgtcacagtaaaactaaccttatagaatgagtttgaaagtattcccttatcctctattatttggaatagtttcagaaagattggtattagttcttcaaatgtttggtagaatacagcagtgaagccatcagttcccaggcttttcttttctgggagactttctattatggctttgaccttgttacttattcttggtctgttcaggttttggatttcttcatggttcaatcttgatagtttgtatgtgtcgaggaatttatcagattattctagattttccaattaattggcataacttactcatagtagccactaatgattatttgaatttctgcagtatcagttataatgtctttttttatctgttatttatttgggtcttctctcttttcttcttagttgggccaaagacttgtcgactttatctttacaaaaaaacaaatttttgtttccttgatcgtttttatttccttgatcgtttttattattttcttcatttcagattcatttatttctgctctggtctttattatttcttttcctctactaatattgagtttggtttgctctcacttttgtagttcttttagatgtatcattgggctatgtatttgaagtttttctttttttgatgtagggacttacaaatttttctcataatactgcttttgctatatcccataggttttgtatgttgtgttttcattatcatgtgttttaagagcatttccaattttcttcttaatttcttcattgaccctctgcttattcaggagaatattctttaatttccatggattttacagtttccaagattcttcttgtttattgacttctagttttattgcaattgtagtcagagaagatgcttgatattattccagtttttttgaatgttttaagacttattttgtggcccagcagcatatggtcttctttggtttatccatgtgctgaggaaaataatgtgtatttttcaggtgttagatgaattattctacaaatttctattagatcagtttggtctctagtgcagattaagtctgatgtttctttgttgattttctgtctggaagctatgtccagtgctgaaagtgaagtgtgtaattcccctgctattattatattaggatttatctctctcattagctgtaatactatttgctttatatatctgggtgctccaatgtcaagtgcttatatatttaaaattgttatatccttttgcagaattgccccctttatcattgtataatgaccttctctgcctcttcttacactttttgtgttaaaatctattttgtctgatattggtgtagctattcctactcttttctggtttccattgccgtgggatatctttttccatccctttattttcagcctacatgtatctttctaggcaaagtgtgtttttgtaggtaacagatcatagagtcttatttttccatctattcagctactctacatcttttgattggagagtttaatccacctacatacaatgttattattgacacataaggacttattcctcccattttggtattggtttctggttgttttgtgtcctcctcttccttttttccttccttcatgtcttccttttagcaaaggtgattttctctgctggtataatttaatttcttgatttttgttttttgtgtatctgttgtatgtttttaaatttgagattacgatgaggcctgcaaacactatcttataacccattattttaaactgatgacaacttaacactgattgcataaacaaagaaaccagcatgcaggaaaattaataagaaatccacactttaactttgtctctccattgtttctctttatgtcttattgttctatatatttgaaagttgttgtagttattatttttgattcgttcatcatttagtctttctacttaagtgaagagtagttcacacaccaccaattaccatgttatactattctgtgtttttctgtgcatttactatcaccagtgagttttgtaccttcaggtaatttcttcttgctcatcaatgtccttttccctcagattgaggaactccctttaacatttattatagggtagggctggtgttgatgaaatcctttaccttttatttgtctgcgaaggtcttcatttctccgtcatgcttcatacatgcttagaatagtatatctggttaaaattatatatatatatatatatatatatatatatatatataaatatattatacatataaatatataaatatatataaatatattatacatataaatatataaatatatataaatatattatacatataaatatataaatatatataaatatgttaaaaatataaatatataaatatattaaaatatgttaaaaatataaatatatataaatatattaaaaatataaatatataaatatataattttaaccagatatactattctacggtaaaaggttttttttcttcagcactttaaatatgtcatttcaaatgtctcctggcttgtgtggtttccactgaaaagtctgctgccatatatattgaagatccattatatgttatttgcttcttttctcttattgtttttaggatccttttatcctttacttttgggagtttaattattaaattcctgaggtagacatctttgggttaagtgtgctgggtgttctataaccttcttgtacttgaatgctgatattttcctctaggttttggaggttctctgatattatccctttgaataaactttctctccatatctctttgtctacctcctctttaaggccaataacttttttttttttttgatacgttgttttgctcttgttgcccagctagagtgcgatggtgcaatcttgccttactgcaatctccgcctcccgggttcaggtgatccccctgcctcagcctcctcagtagctgacattacaggtgcccaccaccatgcccggctaatttttgtatttttagtagagacggggtttcaccatgttggccaggctggtctcaaactgctgaccttaggtgatccaccctccttggcctcccaatgtgctgggattacaggtgtgagccttcatgcccggcctaaggtcaataactcttatatttgccctttccaggcttttttctctagatcctgtaggtgtgcttctttgtttttttcttttgtctcatcggattgtgtattttcaaatagcctgtcttcaagctcaccagttctttcttctgcttgatcagtcctgctattaaaagattctgatgcattcttcagcatgccaattttattttcatctctagaaattctgcttcattttaaaaaattatttcaatttctttgttaaatttatctgatagaattctgaattccttatctgtgttatatttaatttctttgagtttcctctaaacagctattttgagttctctgtctgaaaggtcacatatttctgtttcttcaggattggtccctggtgtcttatttagtttatttggtgaggtcatgttttcctggatggtgttaatgcttgtaaatgtttgtaagtgtctgggcaatgaagattaagtatttattgtaatcttcacagtctgggctttttttgtgtctgtcttgggaaggctttctaggtattcaaagggtcctgggccccaagctcaatggcactgtggtttgtgcagacttacagaggtactgctttggtggtcttggataagatccagatgtatggctgggtgcggtggctcacgcctgtaatctcagccctttgggaggctgaggtgggcagatcacgatgtcaggagatcgagaccatcctggctaacacggtgaaaccccgcctctactaaaaatacaaaaaattagccgggcatggtggcgggctcctgtagtcccagctactcgggaggctgaggcaggagaatggcgtgaacccgggaggcggagcttgcagtgagccgagatcgcgccactgcactccagcctgggcaacagagagagactccgtctcaaaaaaaaaaaaaattagctgggcgtggtggtgtgcacctgtagtcccagctactcaggaggctgaggcaggagaatcgcttgaaccagagagtcagaggttgcagtgagccaagattgcgccactgcactccagcttggtgacagagtgagattccgtcaaaaaaaaaacaaaaaacaaaaaacagaagtattctctggattactgggcagagactcgttccttttccttactttatcccaaacaaatggtgtctttctctctgtgctgagctccctagaattgagagtgtggtgctgcaagcacccctatggccatcaccactgggattgcaatgggtcagatctgaagccagcagagcactgggcctcatccaaggcccttccctttagtgcagtgagttccccaaggacctaggcatgtccagagatgctatttgggagccagagatttggagtcaaaaaccttagcagttcacctgatgttctattctactgtttcatccattgggatgggcgattcccctctggctatgggtagtccaaatgctccctccattcacagtcactggctaagcccaacatggctttattcttcatggtgacagggcagcgctgagttcaatgtaaagtccccaagtcactgcactcgccctctgggagatgggggagtggtggcataggcaaatcgagattaccttttctgccctcctcaatacctcttttggtgatattaagttaccaccaggtactgtgattgtccacctgatttttggttcttgtgacagtgcttctctgtgtgcagatagtagttaaaatttcatgtttcagcattggggaggaatggtgtaggcttctattctgtcatcttgctctgccatccttgattgtttctaattcagtctaacagccaatcaacaactatttaaatccattaaaccagtaataaatttagactttgcttgtctgaggctagcctcagcctctcagttgtcctcattgagcatgtaataaatagttccagtgaagaactctgggaggaaggagtacaactatttgtattgaagtcttcagtatgtatttctggggatttttcaagagttgatgtttgcaagaaaatcaactttgagtaatatagaataataatctctttcattttagtaaatctctacagagaacattgacacatactggtggatttgatttctacaacaactttgcgaggaaagtagatgttactatttctattttccaaatgaagaaacttaatgaactttgtcaacagagatgtaaataacgaagaccacaactcagtcttaggtccgagtgtgtgtgtgtgtgtgtgtgtgtgtgtgtgtgtggtttactgctctgttagaattatgattgttagtgttgatatgagggttttttcccccagtgagatggattaattaatggcattgctaatttatatctccttatagtttcacagtatactctcatgtccagaatgttctctcccttttctcctaggcttatctcctccatgaaaaactctgatattttctatggatatcttctctctcagaacttctagagcacttctagtttattctctaaaatacagcacttatttctcttatattttgtttatagtgaactgttagaatgaaatagaaactgctctcattgtacgagtggctttaaacatcgctatctcttgacctctccttttattcccatggacttttctaatggcctgcttagacttatccctcctccaagaaagtgtcagatttatatttcttttagttttcttgtctgccagttggagataataattactatttcaaaggactgtgaggattgaatgataattacttcagaagtgcctggcattgtttctggtacacaataaatggtagcttttgtgtataagacagatattaaagtgttaaagagaatgagaaaaaggaaagatagagttgtaagtatctcttagccttcttagtaattccccttggctttaggcatgcctcaagtttcaccatttcttccatgaacatctgtgctttgattacataaacattcttgtttcccagattagtctatccataataacatctgtgaaaagatgaggtatgtgtgcaagcataatatctataaagagaagttaaaatcacttctgcatacatattgtttgcaggtatccatgtcattaagtactaattaatgctgccttttgcatgtgtgctgaatggaagatacaaagaaatttggtgaattacccattaaccacattcaacagagagagaggtagagttttttccctacttataattatgaacttatagacactatctcccgattgccctttgaaaagtcctccaatatataattactaatataaatatagtcacgtggcctaaaaaaccctctataacacttttaaatgcttcctacatttccaattgtacctctttctataggagatactaaaaaactgcttcatccctggcaaaatctccagtgttgagtcctctcttttattgtaaatattaccattgaaaaagttttgcatcatctagtgatgatctaaacttatgtgcacattaaaatgaagggtggaaaaacctgttcatatacaaaagaagaaacccctgcaattttgaccaattttagaaccaaataaaactatgtattatttttgagaccgtttatcttttttaacttctttttttctagtgatgaggtaaaaacagaatacagttatcagaaataataactgcagattcaagaaagtttcagaggtgatcctatctgttttcctgcccaaactagtgaataaaattgcacaactaataatttaggaacactgcctatggaagccatagtgaagtcatagtaaaaacatgaattttcagcaattgacatttcatataacaaatcatattttgaccttttgtatgccagtcataaaaagatacttgtgggaatgacctggtattgttgatgtatctgaaatattttttgtacttttattgggctctatctttgttgctgctgggagagtgagaactctctttttcacttacatccaatagataaaaggggggggacattgattgtcttaaagattcttattattatgaataataatcttaagctctcaaagaaccagaattctcaattaaagatttttctatattcaactctacctgtcatgtgtagcttgcatgtaccagttgcccatcccacaaaagaatgaaaaatgagaatcctgacagatttggtgttggattttagactttaatgcctttagccctgcaatgggcattttactggcattttgaagatatttctttttaatctgcaaaataaagatttgaagtgacttgacaatgatagtaagatgattagtggtgcacattcactataaaaatacaatttgaccattgtagaaagtctttaaatggtattgatacttgcctttcaggagtaacactgagatattcaatgtaccctacctccactgggaagtgaaactggaaaataatttaagtgtgtgtttagaatctctccaccccactccccgtatctatttttggtgaacgtccatcaatcaaaggtcttataccttcacattgacacaacagcacacacagaatcttccacatctttgacacagggtaaactcttggtaaatattggctaatggtaaggataaaggtttctttggcctaattttagtcatattctcccatgtgcaaggctacatttgtccagagttctacatttaggattccaaaataagttaaactttgtatacttcatgtcaaatcagtcatctgagattcatttattttttctgaccattgacacagtatataatgcaaaccacttgttcagtcccatttaattatgaagtcaaatcacatggtatacccaaaattttcatcccagtgattttgtatttccaaaaaatcaaatctgatagactttttttgcaatgcaatgtattgcttaaccattgactggtaaacattcaatccagccaggagtaaagatacaggcttatgcaaattaataataagtgccttttcatcttacattctcccaattcccttcctctagggcaaggaaaatagtcatatcctggatattttctttcatgctgctgtttaccttcatggtgtgtatatatgatactcctccagtaattgctctgaagtgggcaaaattagcatggaaagaaacaaatgctaaatacagtataagttgtttaggattagatattgtaaaaatataaactatacatccaggagagatgtcatcaggatgcctgactagaggtgctcaacactcatcttcttcacaaaggaggaccagaacaatgaataaataagtgcgattcaagtagagtgtctatggaagaacactggaattcagcaaggaagggacaaaattttctgaagcacagaaacttgggatgtcagcatacgaagcaaagcacccaactgggatcagctcagaaccaagagagactccccattaggataaaaaagtaagcaggagatctccagcagccccccgttactaatgcagatgcctgaaaccctatctacaagagaaccccacagtccttgcaggccctgatcccagtaaagggagttgtctagagttaatgcagctgtattgctccagagacagaactaatgctgtgtttcccactccttgggacataacttgcaacaatatggtgtcattttgagaacaaagtcatgctggagtacatcctgccttgaggccgaagagcccctgtatctccatatcccttggtcccacctgtcattccaccatgccaacacaaaaggctataatgtcacaaccccagatagacccaagagtacagttatgacaccaacacttgagcctacacagtaccctacacctcaaaaaacaggcagtccagcacagagtataggcttctccccaaaccaaaggagccaacatgtttgttctccagggcatgagaaccacctactcaatgccctctaccgctggtgaccttgtacccttaaccaacagagctggttatcttatctaacttatatagcttatataaacagatctaaccagagctgctgtacactgtgcatgcaaccagaggccaggggctgacccacccagtacaagctgcccctggcaatgctgtctgtctctgtaactagtagagctgccacaactggtgccctacccccaagtacttcagaactggcctacacagcaacccctatccccagcaacccctatccccagcaaagccatgctacagtcttaaaaactgcccacagcccagactactgaagcactagcggataccactgacattaattacagatgaataaatcacaacaaagactccactagtgggactcacccagaattaaagccaaagcaccctgccctactcatactttaagatacatatataggaaaaagtacaataattatcctgtaacagacctcaaagcaaagtaaatatataaactgcctgaaaaggaatttaaaataataatcctaaggaaatatcagtgagacacaagagaatacaggtatattgatacaattcaactaatttaggaaaataatttatggtctgaatgagattgcatagtttgcaaaaattgtctcccattctgtaggttgtctgttcactctgttggtaatttccttctttgtgcagaagctctctaatttaattaaacctgtttgttgatttttgctttcattgcagttgcttttggcattctcatcatgaaatctttgcctattcctgtgtctaagatggtattgcctaggttgtcttccagggtttttatagttttaggttttacatttaagtcttcaatccaccttgtgtctatatttgtatatggtgaaaggtaggggtccagtttcagtcttctgcatatggatagcccattatcccagcatcatttgttgaacagggaatcttttccccattgcttgtttttgtcaggtttgtcaaagatccgatagttgtaggtgtgtggccttatttctgcgttctctgttctgttccattggtctatgtgtctgttcttgtacccgtaccatcctgttttggttgctgtagctctgtagtatagtttgaagtcagttaacatgatgcctccagctttgttctttttgcttaggattgccttgactattcagtctcttttttgcttccatatgaattttaaaatactttcatctagttctgtgaagaatgtcattggtaatttaatagaaatagcactgaatctgtaaattgctttgggcagtgtgatcattttaatgatattgattcttcctatctatgagcatggaatgtttcccatttgtttgtgtcatctctgatttctttgagcagtgttttgtagctatcattatagaaatattttacttctctggttagctgtattcctaggtattgtattctttttgtggcaattgtgaatgggattgcattcctgatttggttctcagcctgtttgttgttggtgtatagaaatgttagtgatttttgtacattgattttgtatcctgagaatttgatgaagtggtttttcaggtcaagaagcctttgggctaaggctatgagattttctacatataagaccatgtcatctgcaaacacggatagtttgacttcctgtcttcctgtttggtgctctttatttctttctcttaccagattgccctggctaggctttccaacatcatgttgaatagtagtggtgacagagggcatccttgtctagtgccggttttcaaggggaatgcctccagcttttgcccattcagtatgatgttggctgtgggtttgtcatagatggctcttattattttgaggtatgttcccttaatacctagtttattgatagtttttaacatgaagaggtgtcgaatttcatcaaaagccttttctgcatctattgaggtaatcatgtggtttttctctttagtcctgtttatgctgctcttttctttctactttcttgaagtaagaccttggattattgatttcagattttctcttgattctaatataagcatttagtgctataattttccatcctagtatttctttagctacatcccatctattgatatgttgtatgtttatttatattctgttctttgtatttttaattctttttctttctagtttgattctactatgactagataacagaatatgtaagatttcaattatttttaattttagacatttgtactatggtgaaagatatggtctgtctcattttaaagtatcctttacatactttaaaattgtgtattctaaggttggtggagtattctgtagatttcacttaaaaagattgattgataatattttcagttttcctgtataattgctggttatttatctaaagttatacacacacacacacacacacacacacacacacacacacacacacacagagctgctgaaagaggctagagcagtttcaatctacttaaaagaactggaaccacagcctgcctagacccaccctgttgcacatggaagaaatgtcatgaatatcacatttatatttaaggtaatcattaattgtattatttgttgctatttatatggtggtaaatatacataacataatattcatcattttaactatttataaatgcacaattcagtggcactaagtgtattcacaatgttgtgtatccatcactgctatctataccacaaatttttaaccatctccaacatgaactctgcacccattagataataacttgtaattttccattccccctcagcctcttgtatcctctagtctactttttgtctgtgtacatttgcctattctgggtacctcatataagtgtaatcatacaatatttgtctttatgtgtctggcttacttcacttagcatgatattttcaagctccatcatgttatagcatatataaaaatttaattgctttttatagctgaaaaatattctattgtgtatatgcatgtatatatatgtatgttttatatatatatgtatgttttatatatatgttatatatatgtatatatataaaacattttggctttacattcatctgttaatggattcttgaattgttccatcttttggctattgtaaataatgctgctatagacattggtgcagaaatatctccttgagtttctttccagttcttttggacatatgcttaggagtggaattactgggtcatatggtaattctatgtttaactttttgagaaaccaccaaatggttttccacagtggctgcacagtttacattcccaccaacaatgcacaaaattttcagtttcttcacatccttgccaatatttaatttctgggctttttctttaaattataaccaatctaatgggtatgaagtagtatctcattgtgggtttgatttgcatttccctaatgactaatgatgttgaacatcttttcatgtgcttattggccatttttatatcttctttggataaatgtctatcgaatttctttgcccatctcttgaattgggttgtattttaatgtttttgttcatctgtaggagtatttttaaatatatctggatattaccattaccaggtttgcaaatattttctcccattctctaattgtctttttgatttcttgatagtgtttattgatgcacggaagttcttaatttgtagtttttcttttattgcctattctttcagtgctatatcagagaaattgtagcaaatccaataccactacaatggcatattattcagtaataaaagaagaatgaagcaaattcatagataaaccttaaaatattatgctaatgtattatgttcacagagttatgcaaccatcaccagaatcaattttggaatactttcattacctcaaaaagaaatccatacccattagtaaatcttctaaggtctcttctgggccaagtatacagttttgctcatgtgtttgaccttctaaatgtttaaagcttttcaaagccctctatggccatctcattacccagtttttcctttttacgtttttcagtcagcctcttatcaattcccattgatggtgtcacccgaggcatctgtgaagtcaaacaattgacactgatcgtttttgactaattctctgtgaataaaactgttcacctggtcatagaaatcatgccctgagaatgtagcttttcaataagctttcagacaggtcgaatagagacaattttctgtgtatgaggcttctggattgctctaaatccattctgcttcctccaatggctgctaggctataggattttataccacagtagtgaggctattggctgttaaggataccagggagctggggattagggccaattaaaacaccacgaagctcattgttcttactgaaattcagccacttttcttgaataaacattccttgtatcgttgcaagcctttagtttgtttccagagttctgaaaaagttgactttggcagatttttgccaatgttctcgttgcttttatggaagagttgatttttgaagtccttactccaacattccagaagtgccctcttggatgaatgatcttaaacactttagttcaacatagaataaatgtgtgtttgtgtgcatgtgtgtgtgtgtgtctctgtgtgcatgtgcgtccatctgcctgtttatctgtctgcctatctgtgtctgtgtattaatatttctctcatatgtacacattttttattgtgttcatctactttgactgtaaaccttctgtctgtgtgttggttcttgaatatttatttcaaagaaatgttatttttacaacattgttcttgttctcctttaaaggtcagctacctttttccttatattttcatccatacatctgtgtttggcttttattaagtagcagcagtgcaatattcctggttttatctttctggcttaagcatgtgagcaagacacaaaggataataatacaacatactttaagagacaaaacaggttgctataataatagaagatctatttaaatatatttagcatctctttatgtagaaactaaaacaaatccaatattaatagcattaagcatttggggcatgtgtgtgagaatatgttttctgttcaaaaataaatttttattatccaagtcctttaaatttattttttccaatttgctttgctaccctagctgggatcattatccaaaccaagcatcaaaattcacaattatatgaaaaataaatatatactaactacatttccacggggaaaaaattagttggcaaaattggtactagcctaaatatgactataccaacttaccaatataatccggtacttcaattattttggctatgctaaatcaggatgccacaattcctcctggaatattaaataatcctttgccagcagattgtccaacagccagtcatacttgctcagcacctatcttgacaaaattgtgaagcaggcaaagttatgtcttcagcacctgcccatcccctaatttagttccttttgtttcttctttcataataaatggacaagcaggcgactcacctctttacaaggctctccatgtgaccacaaaaatgttttaagaatagactaccttatttaatgaaggagacaaaaactgtaagaggaagtacatccccaatttgaaaaatcttatcgtatgtcttattgtaaaacagtgcctcctgatgctttcatgtctccttccttctttccttctcactcttcttctctctctacatctctctctcctttattcttccttctccccattcttttctttctttctctaccctgttcttcccccctctcatccttctttccttccaggcacatgtgaaccacttctttttacattgggtctctcaaatatggagtattaatcacataagcacgtaaataatggcatgctgttcatctgggaatttttccaagtaatggtggttagcaagctgtgtaatgagcttcttgtaaccctttctcttccctcactctgaaattaaaggtcagggatctctcactagaatattacaatgctaaacataccaaaagtatctgaaaatgtttagttaccaataggcaagaaaagttttctagtcctttcattttcatttaaaaaatatctcttgggaaacctatttcagatcacgaagttttacacaaatgtatagctaaaacagtcacctatcgatccaaatacctattaacagataaacaacagacaatgattcactcattcacccaggataaagccatgtctgtgtacacacaaggacaatgtagttaaaatgggtgactttagtttgttgctagagatatgattgaaggaacacagacacttgagtcagacagacatgagcttaagtctattctctcttatgtatttgctagttttttatgtagaaaatgtgaatttcctatgttacgttgaggtgattgaggagaagaagattaaatgaaatgataaatgcaaagtatcaaacactgcctggcacatagtaagcactcagtgattactgctgactgctgctgacattcaaggagtttccagtgtctcaagtcctgtagatgcccaaatgagtcactccacactttgcagattctttctgtagtatcagttgcccttagtgccttctaggaagagaagaacattagtccccttcagctcaactgtgtatatagataggataagggacttgggcaagaggaagctagtgctagtgactttctcccatgaacacttttcctttaagtctttttatcatcaccaaaatctatttggtttagagtttctgtcttactaaatgttaccctagtggcttgaaagggttagtgccatttccaaattgagtatattctgccctaaaaaaaatctgaacacaaatccctacacatatgcatacattaatttcagcctgcttttcttccccgcccaaaggctcaggctgtctgaagagtaagcttctagcttctcttaggcaatctgtattttaaaaaatcactgatccttccatcagaattacttcctttcatttcagagaacaatcctatcctgtcaaaaatacactgcaatagaaataaagaggaataatagcagagtataatttaatagaaagaaaggagggtgaggtaaactataggcaagaggtatgcaaatgcttaatgtgacacacagaagaaagaagccatacgtaggtatatgtgtgttgtgtgtgtagagtagtgtgtgtaaatgtgtataggagcatgtttgtatgtgtgtgggggcatataatttgtaaattggtatagtgcataggaatgaagcactatgtatcttgttaaagatactgcttttttggttcttgaataaggaggatgctggaaaacatccaccattatctgtactcttggtttgcacaatccttcctccctgctatcccctgccaccatgcaaaactttcatactgcgtcattaattcttccagcctggggatagtccccaaattctctcattactgggctgcttagtgccatcaaaatttggattattaaggagctgcatgaggccttgtttccttataatgaaagcacaatgaccatctagatagagattaatatctcacttggggttatgtaatattttctttattccattctagttgcagtccctcttcctaatttttcaaaatgccactgaagcccatttcatgaaattgcaaagtaatctgatggtgatgaatcacttttagaaggaaaaaaatttgccgaagctatggatttgcattccccatgtcattttagttaaaatgaggaatgcttggaatttatatataaacagcattgtgttttggccttatttattacaaaagacacttgagagagctgcttgtttcaattatactttgccattgtgtgaagagagaaaaaaagtgtcttcttttacttacatatttgctatcagtttaggacttttaaggaatagtttgttaaaatggctattgaaaaatttggggtcctaatgtttgttctcagagacaaatctatgaatttattttctacctgataattcatcaaatctgggcctctgtgaaaggcaacccagttgtttttaacatcaatgctctccctcactatcttcccatctttcttttctaatataattcttctgccccaaatcaaaattagaggttaaattcttcttccccagcacacatggtcttttgcccaactcacttcacactactcatctttggttcaaatcccaacaacagtcttctaatctccatctgcagtccttacccccattttctcttccctctaataggtgctagaaagacaagttcagttttctgtctgatatcatgaaacccctaccatgaaatcactgaataatctacttacctgaatgattaattctgtgaagtttgattctttaatataacaacagataagaatcttattaatttgatattttcgggatcacagaaagtttcactagtttttttctttagaaacattgtttgccttctatggaatgggtgagtccatggatttttcaccattgctgaatcaagccatgaagttttccctttattaataagtatttattgagcccttagtatgccatttatccaatgaataataaggagtgggagagtggattgagacaaaggatgcaaacagtgtggaccctgctcataaagacaaggataagctcttgccttcgtttgaaggaattgtattattgatttgataatcttcccaggacctagagaggtgctaatagttagagttcagggttctaattctggtttgctagtaatcaagtatttgatttaggcaaagtctctttataactctttaggttcctgtttatgtgaaaacaggggattgggctagatacacttctctctctctgtctgtctctctgtctctctctctctcccacacacacacacacacacacacacacacacatgcacgcatacacttgtgcccacgtggaagacatataaagcaagtagtcagcagtgagaataatgagtcaaagaaagctccttctaggaggtaagatttaaattttatttcatcacttatgtgtacagagtaatggttctgctgagtaatgttatcttaccttaagtttcagtttaaactaaacatatgatgaaattactttcaacacgatcttagtatctgtcctcccactttggttttgcatacagaaagtaattttggatgtttgatattctagtacttggcatatcctactcattatagattaagtatttctggcttctgccagatgccatttataaccttttgccaaaacttgtttacatactcaaaatttgactatccactccttgaaggcagagacttcaaaatcttctatttatttatagtgcctagcacaatgccaggcacataatattctctcataatcttctgacaaagatgtctttgggaaattatattgagagatgacaccaatgtttgggcattcctatttgaattttgtaaacattataaattggaccaacagaatatgatatggcaataaaatcacatcagcttcaatttatcaagttcttactatgtgccaggcattttacatatgttatctcatttaattcttataacaacactataagataaatgctattattctcacttacttagggggaaactgaggcacagagtggttaaatagtttccataaggtcatatagctaataagcacaataagtcttcacttaatgtcatcaataggttcttggaaactgtgactttaagtgaaacaacatagaatgaaaccaattttaccataggctaatcctaaacaagaatttcaacagcatatttctggtcacaaaaacatcatcaaacttctaaatgaatacaaaaacacttctaatattaaacgttgaaataaatgcgagctatacatacatttaagaaacattagtaaaaacaagtaaaataattattaaccccaaaatccaaaattcctttctgtatataaaaccaaagtgggaggacagatactaagatcgtgttgaaaatgatttaatcacaaatgttagtttaaactgaaacttaaggtaaggtaaaatttctcaacatgacacttattccagagtcatgggtaactggagcctatcctggcagctcagggcacaaagcagggaccagccctggacaagacatgattgcatcatatggcacactcacacactcatacactaactcagactaagacaatttagacaccccagttaacctaatgtgcacatctttgggatatgggggaaaatcagagtacccagagaaaacccacacagacatggggagaatgtgtaaactccacatagacagtggtcctgaccggaaattgattatttttcctcatcaacatcataaaacaattttgaacaaaacaacattatttgaagaccttctgtaatgaagcttggaattgaaaacctgtctagctagaaaccctttaaccactattgtattgactacttggcattaaagcaaaatcattttctgtgaactaatccatagtctaattccacagtcttcagttcccctctcatctagaaagaagacaacatagcatttgcttccttttccatcttcgaccttgaaagatatctatgtttttcctctttgaaattgactctaagaaaagtcttctttcctgagaaagtgaagtgaacttagtatcaagaatctctttgaatggagaagacgcattctcattttgtactatcaagtcatagaaatgtgtaattttagattttgagagccagatcctttaataatagattattagaaactattgttgatttattttcctctgttattatttaaagacagacttgcttttaccttaaaggcattgaaataaatgtactaggatgttaatattcttctcaaatttcaactttgtatagaaacagaccctggatttgttggcagctaatcaattcattctggttaggactgcttcacttacccctgaattttaacctgaatctgaatactcaggaagcaaatttaaggactaagaaaataataattttcccacttggtagattggtagcccaccaaagaaggggctgttaacattttagagtgggaaaattaacctgacttttctgtgcaaggggctttctctctttgttcaaggacaataggcctttatgcaaatacttctctgtctcactccagtttaaaagttcttctggctgcttgttagctgtcagtaagtattgttctctagttttcctatcttttaagggcataagatcccttgagcaggcttggcgggcatacattatccctgacattattgttgcacgtatatcttctaaaccatcccaattggcatattccaagaattctcaagggatagaggtgacaccagtgaaagcaagaactgatggtccaagttgcccagtcaagtggtgattttgtttcttgaatgagaaatcagaactctgtaagtccccttccatggtatggtttataggaagctaacatttgtggaattagaccccttggtgatacgacctttcagaatacctaatctcaaataatttcaaccttttttttttttggctgcttttcattgttaagacatattcagtcaaaatatttttggaaaacatatgtttttagcataaatgaatattatattgactcaaattggttggaaatcacaagttaaaactgctctgtcttctgtagctaataattcttggcactgggattatgtttcaggatggcagaacagtctgcatgagtgctctgattggttatagaatattaattggctgctgaggtagtgtttagagctccaatttaaggttgacaagaatgatagctttcatttgtatgcaaaaacttcaactgtcccttcaagaaagatgatcacatcctacttcatctgtcactctttctttactttttaatagaggaaaaagaaaggagaatgaaagaacctttatcaaacatgattttcaagattgccttgatgcaaatgaagtgtctcaatgatcttgttgcttcactaaagcatacttatttactctttgttggtaccttagtccattttctgttgctataaccgaatatctgagactgggtaattaaaaaagaaaagacatttatttcttacatttctggaggctggtaagcccaaggtctagaggccacatctggcgcgggcctttttgttgatgaggaaacaaggtggtgcagggcatcccatgactagggagctcacaaaagacagccaaacccattttttttaacagacccactatcacgataactaattcactgtcttaagccattaatccataaatggattaatttattcatgatagcagagccctcataacccaatcttctcccaaaggtctcacctctcaacactactgtattggggactgagttcctaacacatgaacttttgtgggacacattcaataccatagcaatcagattaagaagtacatgaactggaataaggtgaagctttcattcactgaaaaatatcaactacagggtattgtctctgagattttcaaactttaacagtgatttgtttggcattctgtgagacatttcttattagccaaagataaataacaatctgatttgaggtactagcaaaatgaagtactgacttccatcatctccatcatgccactcaattgcttatacaaagttgctcagggaagacctggttctatgtgaaagcagagaccaactgtcagcttaaggaaatatatataatggaccctgaaagaataccatattccaacataattcactgtgattttggattagattctactacatataacagaaaaccctgcttatagttgttcaaacatacacgtattgattctctcaagcaaaaagaaacagaaattaggcagtccagggttggtatagtgacttcaagaagtcatcagggatctacacttttactttcttactgctcctctattgtttgcatctgatttccatcccaaatttacgagatggcctatggagctctagacataaagtctgtactctatggaacggattaaagacatgtggtaagtgtcaccttggaaacaggaaccaggaggaaatagaacatagggcagggggcattgtaatagggaaaataacatggaaagaaaaatatagagcaagtcctcaaactcgccttatcatcagaactagctgtgggagggcttattaaaaacacagatttctactctccattccagatccactggattatattgtctagtagcggtacctagaaatgagaatttcaactagccttctaggtaattctggtaataaggcaatgtattatctagagtgatgatagcagctgtagtaagcaaaccgaaagatgtagaatggttgagatatgacagaaatttattttttctcatacaaaacgctagcacgtgttcctaatttaaggatctgggttccttcattcttaaagtttcatcatctttagcatatatcttccaaggtcaccattatcacctgtatcaagctggtggaagagaaaatggtatgaaacatcttgtgtggaagatttttatgggtcaagcctgaaaggggtgcatatcatttccacttacattgcactgactaaaactcagacttatgatcacacctaactgcaagggaggctggcaaatgtgtagtataggtatgtgctcagaaagaaaggagacaagttttactgaaaagccagcagtttctgtatagtaaagtttgggaacagggctggcctcagggcatgtgacctatgcagctacacaggttcctgaacttagaagggcctcaagtttggttgaatgccctgatgttactctcttaaatttcttaataatttttgaacaaggggccatgtttttcattttgcactggaccctacaaactggaccctatttaactggtacagcttaggaaagaatgacccagagtgtgaggcagagccagaggaatatggcacagttcaggactttgggcagccagcaggtactgtacttcagaagtgttcattaatgaaccaatgttcttggccaccagagagccttctctcagagtgctatcctgttctgcattttttatctgtgacttagatgacatataaatgatatttatcacattttcagatgagaggaagttgggagggacagttaatactttggagcacatatttcttttcaaaaatatctcagtagtttggaatgatgggttgaaactaaccagattacatttaataggaaaaaaatgtaaagcttttcattcaggtccaaaactccaactgcaaaagcacagtcttagaattttatttggctgagagcacaagcagtgggactagattgccaaaaattctaatttagtcttagtctgcatcacagaaaggtagggtccagaacaatagaagtattggtttaattgcactttagatgacatcagaaattatgtgttcagtttattgtaccatatctaagaaacccattgatagattagattgtgtccaaaaaagattgtctaggatggaaaagggttttggaaaacatgtcacctgaaagacagtgggcaattgaggaaactaagtgtttagcctgaaaggggaagagcttttagaagggaagggggtgaaagagatcaagaaatctgtctgcaaatgttttaagcattggtatatagaaggtgtattgggtttattctgtgttgttccagagaccagaaataggaccaagaggtataacatacaaagaaacaaactacagctgaacataaagaagaaattttaataaagttattccaaaattgaaatgattgatgtcaagaggcagtgagcctattgcagaaaagttatcaagcaaagactgaatactgggaactgtggagggaactcatgtattaggtaggaagactagagtctttgtaattatgactgtctaagactaagtactattgaaatgatgcaaattgatcaggatcttgttagtcttatattttaaaaggactatgaagccagactgcctaaattcaaacttcagctttgtttcttattacctatgtaatcttgggtaggtcacctaatttcttaatgcctcagttttttcctataaaatggagataataatagtatataccccatacataaagttattgaaagcattaaatgaattaatactggtgaagtccttatagtaagcattttgtaaatgttatatattattattttccagaaatatagttggtgataattcttctatctcttcttcaatgaatgtagcctttagtacaattagattaatttacactagacataaaatagaatgctatggtgacaaaatcctttaaaacaccaaaacaaacaaacaaaaaactgaagtggtcctgtagatattcttcacaggcaccctgagaatggcataagatagctatatctctgggatgcaatgttggaagttgtgactttaggaggacatttccagctttccagcttatatatttagagattttataaaaacctcatagggctttttatatttcttaggtcacttgatcctcatattaactataaaactacacagggcagttaccatatccattttgaagttgaggaacctaagcaatagaaaagttagaaaaggtaacagaattgttcaaggttacactataaatttttagtggagccaggatcagaacccatgtatcttaagttctagctcagagctcagagataaaccaaatgggtagtaagttgcttttagactatctagtctgtggaagaaatttcataaggctgatgaagtggcttctattattttgccagtaacttgcctgtttgctttgcagcaaaattgacatcagcctgaaaacccagccacccagcttaatttcctttttggctttgcataggttagggggagtcaataaaatcagtgacttatgctgagtgtattatccacacagacactatggaaatatacttgccagctcaatccattttttatgcattattatagatgattttgaagcttgtggagaatatgtggtcctcttaccaaggcagaagctggctatgtgagttttagatctgtatctatttgtacaagtactgtgatagcacgtggtattgcagaatcgaatttttgaagtgagtgagtcttgctttggtgatcctgatgctctgtatctctatctaccctactctcacttcttcccttcggtacctggcccttgtcctttcaaccttcctctcattggtgtacctattaggttggtgcgaaagttattgtgaaattacttttgcaccaacctaaatatttacagccattcatttactgtggggtaattaattgggttccatccctaggagaatatacagctcgatgttctctttaattggcaaatcaatgtttgctaccatttattgagaactaaactatgtaccaggcctctgcctagcactttagaagcatgatcttatttgatcctcataataatcctaaaaaatgggtactattattatccacagttatgcatcaaggaaatggagtcccagaggagcttaggaatcatgaccaaggtcacaaagtaagtgctagagccagaactaagactcaggtgttaacacagaacctatgctttcaactacaacatcttagagttctgtgatctagatagtgggtggcagatgtttttgaaagttgagaaaggcttttcctataaaataataaacataagcaaccatttgctctgaattagactgagatcagcctgatgctaatgaacatcacagacatttccaaggtctagatacacataagacaggtggggatgaggagcttctgctgtcccaggaactgaattcttttctcacgtactatgcagtgccttttttttttttctcccaagctctctgagattaaatggatatatgctagtgagcactggctgtcaggctgatgctaaagcactaatgggtcattagcccatagacaaagatcctaaagggttgggttttggtcagacaagtaactagccttcatgttaaaagcatagcagtagacactgagtcacctaacacagcaagatctatttgcagggttttccctgatttgtaacctcaggtaataacccccacaagagtttcctgaaaagccttttgttctctcacaaatgacctgaccactttttgactaaagatactctcagagaaagtgcatatttgctgtagaaacatccagtggcactagatcaatttgtcataagctcagagcagttttcacacctgggtttccatctgtacttgaatgttctgcagaggaagtgtcagtccagactagggaataatgggatgaggttggggaagtgaggggtgggatggaggggtggtggtggtacagacccttaggtgaattagactatacttggaagctgcttcatttaaaccagtacagaaaacactatggtggaatttgattcccctgtcaaagaattagcttgccttatggtatttcaaagacgtattatttagagggtcaggatatcctttgaacatcgaacccaatttcttgacaaagttatatcaggagatgaatgataatcacagctgactaaatgcttattctatcagagaaaatggggccatcaaagctccacagttaactggcaagtttactcaaaaagttgattcaaaaaggcaagtcaccctttttcatgagatttggatcctactttgaaaaattcccaagatttcctatctcagtttctggagacaacaattcttgctttcctagtctccgagttggacttaatgagataatcatgggaaagagaaagtgctttgtaaattcagttaatttttttcctttctcaattcttctgtatccagtaatcacatcttgaaatcacctagcttatattttttccttggaactatgagcagtcataattggctccatttgaaaatcaatttcaacatcatagatcatcagcttatatttgattaattaaattagttctcatcggtgttacgaagacagggaacaagcttggaaacctcccagagagctgccatcatgtgggaaattaatcaagatttctaagagccaggtcctgacttcagtgatggaaatggaaagtaaaactactttattttcagagactgctctagtatgatttagttcatttgaaatattattacatattcatccttgaatgattctgggggaagatctcagctttaaagccaaacagacatagatttgaatgatagctctgccatctttgctagcaaggtaaccttggtcaagtgacctaacccctttggcctttaatttcctcaaccacaacaacaaaaaatggaaatagtggtactcatctcataggaatgttgtgaggattaaatgagactgggagactacagaataggagtcaggaaattaggatttacattttggttctggctcttagtagccagaggttagtccttaggagagtaaattaacctgtctgaacctcagtttcctcatctgcaaagtggaaataacaccctgcactttatagatttttgatgaccatgcatttggcttgttgtcatgtaaacaaataggttactcacaatcatggaaagttctctggtaatgtaaagctgacatggaggaggataaagtgataatgccttgtgatttacactttattttctacctcagatcccaaactaagtaagtctttatgttagaatggttctcttctttctgagctctaaatatcacatcacaaataatgtttaccaaacaaatattctgtgaattagaaaattatccctgtcatgaaacttttgattttttgaaaaatgcttatttaatatccggttgtcatcctcattacggactgttagcacatccaaacaactgaacttaagtgatattttgcttttccttattcttttgtattgcaaaacatcatgttaacaagttatgaatgcctaattagtttgaaaaccataagtaaataaaccattagactgaaaacagaagtatcaatacctgcccaatctagtcaaataattgcctttatgaactttggtttgaaatgcaaagattatgttcaaaaactgatttggctgaaatgagaccagtaaaaaagttattttcataaaaatacaatacagacaatatgttattccatatgacagccgcaatgtcatattctgcttctttaaattttatctatattttatttgattacttcttgtggcatggtagtaggcagaataatgccctccaccccaaagatgtccataatctaatctgttaggaatatggtaggttctatagcaaagtcaaattaaggttgtaagtagaattatggttgctaatcccctgacctcaaaatagggaaatcatcatggattatccaggtaagctcaatgaaatcacaggtttccttaaaaatagaagaggtaggtagaaaagaaagaataatataatgtcacaaggattcaacctgcccttgctggctttgaagatgaaaaatggccaagcaccaatgaatgcagacagactctagaaggtagaaaaggaaaaggaattgattttctcccagggcctccagaaaggtatgcagccctgctgacaccttaattttaatccagtgagacccacattagacttctcacttcccaaacaataagataatagtaaatatgttgttttaaactactaagtgtgtgatagcttaccagcagcaataaaagttaaaacagtcaattaccactttttgtcagttactacagccattttatacctccgtttcttctactagattaagccttttgatctgactctgtgtattcttcaaatttatactttactgcccccaacgaagatatacacactagttggtagagtacctttctgtaatagaactacaaacatttgttaactgattataagaatgaattacaccaagtaatccaaaatcgaattttcatcccattctttgacctgtggaattttgtggatacagctaaaggaggtattcagtcaattaatccccaaagctcatcagtttagtgaagtgtttaggtttctttctttctttcctttttatttatttatttattttttttggtgatgcttatatggagatattttggatgtattttgaacacacacacaaaaaaacagtcttaaaaaaaaacacggaagaaatatgacagtatagagtagtggctatgaccttggactcaagggtgagatagactttggttgaatcttggacccaaaatgtatttaccagcaatgtgactttggacaaataatttaaactcattgagcctcagttttcttatctgtcaaatgttgataatagtaggacctactttatacattgtcatgaggatttaatgagagaataaatgtaaaagggcttggcatgaaatccctgcttaatcaatgttagccatggtgcagtagcaagaatattgaacttttaattcaagaaacttgggtttgggtcttctgttttattattaatttgcagtatgatattgagtacattcctccttttctgcctttcagtttcttcatctgtcaaaatagccagatgaattagatctctaagggtttgtctagctctaaaattatccatccttgggtatcatattatatttttagacatcactatctaggccaaatttctagatcctgacagatcagtcatcacagagccaaatgatgatctttaagcaaggtaaaaattcacccatctcccatgtttaacctttcatacttattttaatactaactatatcccaagttctgtgtgaaacctggaagtatactatcttgtgaaatttctttgataataactatatgtggaatttgtttgacatcaacaatataagggtccagggagtactattttagagagagaaagaaaaatcttacttgaggggaaaaaggcaacagtgaagaaaaagcaggaactgtgaagaaaaaaaaaaaaacaaaactaccatcataaccactgtttaagtttccatttcccccaaggttgttttcttttcaaatttgaagaagttgctttatgtctgggcagatttgtgctgaataaacattgttctctccagagaagggccttgtgtcaaatggcattgagaagaaattgccctgccttatacttaagctttcccaaagctcatgcactgctcaaaactcaaatattagtggaaataaatgtgggatctagagaaaagggcaactcagggcaacttcacagcagccctgaccattcactaccctcagggcacatccactgaattgcaaggcaggacacaggctctgagccagttgctagggaggccctaagctttgcaggggcaatggtcaggtaagttgcccagcactttcccagcagtttaacctctatttggtaaaggatcacttatttattaaagacaataactgactttaagttctatgctaataaaaggcaaatacttcaatggctttaaataatggaagggatatttttagtgaaactggaatgtgttttaaaagcaatgtaatcctctgaatataaactttcatgtgtttgactctcagcagttctcaataattttatcttccaaatatacatgtgaggaacatgaaccattgtcatcagtaacagtgacttaatgaagcgaattatttttaaagggttgtagtaggtagggagatgagggagatacatgtaaaagtatctgaagttggagccatcagtgatttgaaaacaaattttcaaataattctggggatcactggttctgttttttgtggtgagcctatcacaaatgttctattatagctgggacacctagagaatatatcttctctctagattgagttaataaacagtccatgctgatctgtttcctcctgttacaaataagacagacaatattataattttggtagagaaaatgattataaaatattaattgctacagtggttagttgatggaagtaataacaagctgaaataaaaacaaagcttgattattaatgaacattgattttttaatttaacatatgcctgggctcttttcctaagatgttattatgaactagaagattcactcatagtaatgctggttagaatcttgaggaaaacagctttacttgtcttcatcggcttctgcagaaggccaccctgtttgttggctaacatcaatgtgaagatagtaagtcaagaaaggggccctggtgcccaatgtgtgcctacaatggactaaagtctttcattccacatttagagacaatccttcaaaagcagctagccttatgagagaaggtacaagtgtcttaagttcacattaaggtttaaatggcagatgcttttttgcagcaggttttgatcagagtcacaactttgtgtgcctaaaagcaggatggagaagaaatttctctaaaatagagatcacaaaattaggaatattagggcaaaggagatatattgtaaccaaggctggtcctgcttgaatttacaggtttggaacattaaggatgatattgaataatcatgatttttctatactttttcctggataatcatctaaattacgggactctcagcctggtaattctagaaataaaatatttttatcgtatggagctttagattaagtggccagtaaattgtgtacatcataatacaggattaggaagactatgtagttaattgagaaagagagattccttgcctcaagcaattatcagctaatcacaataaaaaaatgacaagtattccaaagaataatagctcttatgatgtgttcagagctcagcaatttctgcattcattctgtgttcaatttatgaaatcttcaaactagtcaactacctaggctaagcttggcaaatctccattcatgattacaggaaatttttaaggtattaacaggatctctggctctccgtaaatctgatttgctaagtaaggacctccattttgtcttctcacatgaaagctattcccaagtctttcttcccaaaatcctcaattccctcagaacaataggcagtctgtaatacttgtacatctgcgcactttcggacaaagagccataaggctgctattgctctcttttggaattagctcatgagcttaggtgatttggaagaggaaagagcccatggaatggttgctacccattgacaaaatccagtgactatttcagaacttgagaagtatttggcataaaatattattgttttaattaataaaattgtgttttattaatggatgtgtgtgatcaatgtcacttctttgcacaacttcagggcatcccattaatattatatgctcccaggaatgccattcacatggaaactgatgtaagtgtgcccctggagttgggcaatgagatggtattgcctgttacctttggccatctagtatttatttctttttctaacacaacctaagttttctttaggacagtggttattaagcaggtacaatgttattgccctcattacattttgccaatatcttgagacatttctagtttcacaactgggggaaggtcctactggcatctttgggtagaggccagggaagctgctaaacatccaacaatgcatgggacagtcacctacaacaaagaatttgctgttagtgaatgttatctcgctgaggttgaaaaaaactgcttttaggagattcttctcttcttcatgatttgcatataatctttcctaggcctggagctcaaaacttgttcattcagcctgtcattctgggattttgaatcttgatcaaagtgaaacaaggacaaaacatttaaccaagatacaacacaataaaagaaaacatattaaaaaaaaacaacaaaaccagttcaattcaatgagggggtcaagatgaaattattgtatagtctcttttgcttgcatacctagacctcgcctggtttcttttctgttattaaacctagttccccaaacttcctggccatccttgagatatacttctgataaattcccttttggctttaattagcaaaagtttgattctgttccttgcaatctaagaatgctatgggaagcacagttttttagagaaagaataccaccgggaagttaatttggagattgtgtttatttgttccccaatgtcacatactatcttctttgctgaattatatgagacatgatctttatcctccaggagcttaaaaatatagttaggaagacaagacatacccatgtaatgtgaggtttaatttgtattcaaagtagtacatgtcatgaaccaaatgggtggttcaaaggagtagtcaatgctttaggatttaagagaggagaaagattagcttggactgttattaaggaaggctttctggaggattcaagacttaaacaagtttttggaggatagctaggacttgggatgaaaaaaagaaagggggaggtcttagagtattgtgggcctggtgaaatcagacagaactcaattcaggtcccttctttagattcaagaagaagctgcttgactttgggcaagttatttgtaaaatgtaatataaaaagtcttgaaacagcctagaacagtagatattaagtaaatcataactatggtagctgtttttgtttgttaccaaacttagaggaagagtttaagccaagatgcatagttggaaattaatgcgatgtgaatgaggaaagtaagttgtctatagcatcaataaaatagaagataggtgggtaaaaaggcaggaaaggctgggcaccgtggctcacacctgtaatcccagcactttggaaggccgaggcgggtggattacctgaggtcgggagttcgagaccagcctgaccaacatggagaaaccctgtctctactaaaaatacaaaattagccgggcgtggtggtgcatgcctgtaatcccagctactccagaggctgaggcaggagaatcgcttcaacccaggaggcggagattaaggtgagctgagattctgccattgcactccagcctgggcaacaagagtgaaactacatctcaaaaaataaataaaataataaaataaaataaaataaaataaaatataaaataaataaaataaaataatgacaggaaagttattaaggctagactatgactgcctttatgttcccaggtgacaagttcagagtttatcctcctgtaaatgtaggaaacattggtaggttttgaatggttaaatgttatgacgaaaatagtgatgttagaatgtgattttagtgctgctatgctgaatggatttgggaggatccatttcattgaccataacatacaaattccaaaatagcttcattcacagaaattaatgagtttctgtccttctactccctcccacttggtctttctggccaatctaattaaacaggtaagtcaacaacaaaagaggacaatgaaagttgtcataacagtaggtaacacttgggcaatgtagtcaaattcatttattcaattaaacaaatgagtctacttattttttaaactaagttcatggaaattgaccaatcatttcagtcaaaccagttgatctggttgtacatatagataaaatcattgcctatcatggaaaagaacaagttattttgagcattcttctcaggaaagttagtgtcaaacatataaaacctagttttaggaagaagaaggcagtaatagtagtagcttcactaacacgttaagactagtgtcatggtatacacagtagagcaattatatttaaggataattaaatataagcagctactgaggaaagtgcattggtgaaattgtacattgaaacgttagtaacaaaatgtatcctttgctcccattctttcaatcaaagcatgaagcttaagcagcaaattcaaagattagctcagaccccaattagtcccccttgaggtccaggataaaattcctaataaaattgtaaatctctgccctgttgtttaggggacttggtattgacagttctttctttcctttcacaattagtaactgagtttcagatgagatttaaaaataaaaatgaacaagaaatgagcttgcctccctgtggcagcatgcactctagctaatctgcaaatgctataattatgcaaggtgctgatagatttgtctctgggctggtggtcaggatccaattgaactgctgcagttgctgctttatcatcacaaatgttctgcacttcttagcaattctcaggcctaaacatgatattggaatttaaagaggcaccatagccttatatcccattgagatgtgctgggttaagtgccagttcatctctttccattcacaggtttagggggaaaaggtgtatatgtgtggggtgtcctacagggatcatgtttcaactggctgtttgccacaaagccattcccattggactaggaaccctagtgtaattatcgtagagtcaaagaggctaaaaccactgactcagtactgagctctttacctgtctactgcctacaacttatatcctgttttcctattcatcttgcaagtgggggcttttggtcccaaggggacaccaaataagacaatataagcttcatttaacttcatatctaaattggccacatttgtaactgtcttctttaccttacaaggtcatcatgaagataatatgagctaatgtatctgaaagcactttgaaacttatgaaccacctataaatgtaagatgcttaaaattatcattaatattagtgaatgtcacttcagcaattgatatttaacaataataaaattagggtaaatacatccatagtccatggcggaagataagggaaggggaaaacaatgaccccaaactcatcctgctgaaagcagagcaagattgtcatttccatacatgaaatacattccttacaattgcttcccacctatcacattccagttaatttatttggaagaaggaaatattttaaaataagattgcccaagaatagtttccagcaaactaaatgtctataatttggatgtgtaaggtaaattgacaataattctataaagaaatcaaaatgggttttttattaataaaatgaaaaatggctggatttaattttatttatgttttgaatacatagcatatggggatggttcaaaatataaaggcatatagtgaagattaaatcttccttctgcctgcccatgacaccctttccttacccaccacagttactcagccatccactccctctcttcagaggacaccactgttaccagttgcacatgtatccatctagaaatatttcatacatatacaaacatttatatatgcatatgtatgttttatactcaaaatagcatgctgcgcatactatttgggaccttgtttttttcattaaacagtatgtcttggaaatattttcatatctaatctacagatttacctaattattttaaacagcagtatcataatatgtcattatatgaaatcaccacaattgtaacaaggctcctactattagaaattgaggttgtttccaatattttactattacaaataatagcaaactacaacaaaattgaacatctgatataactggattttaaattcaaacatattcattttttttaaagtagatccctcatgtttccaataatatttaaaaatcagattattaagagtaactgtagtatttatgaaatgaagactagacattatattagtaggtctaaattatgccaaagtcaattaaaacaaaaatgttgttcaattccataaggacaatacatattgtatgtcatcttgaatgatgtgttggaaaaatgaaggcaattaattcactgaaatttttccacttcaggcagctcaggtattaggaagagaaagctaatgtgccataaagctctttcctaagtatatttctggtgcatttgtttattatcaacaactattttgggaatctctccaaatttgtatagttccctaaccttacctgtcctgtaatcaacttttatttctctctttcgcttctaaatattcttcaaatagtatgagatcttctctcatgttggcagggaattcctaagctagtcaattaatggtggcttaatcattatagcacaatcctatgctattcctcctgtgaattataaagaagtataaaacatttctttttagtaggtaagagttcagttggatacttgaagcaagacataaatacagaatcagttaaagggaattcaggatataaacaatagtttgatataagtaagggttgttttatgacaacaatacacatgacattatgtatctgcatactgagtcctctcatttctttcttccaggtgcctctcagatttgtcctctcattaaaaaaaaaaaaaaattccccaaactccaacctggtgtgactgctcaccaccacccatccccacacactgcagcattgtttcctcaacctcttagtttttgttcttctctcagcccattccacatatcaagccaatcatcattagacatcacttcctttgagtcattttttgtttcaagatctacaatgacactccagcctagaacatcatgtccaaattcctctgcctgttactcagagtcctccagaattcagccccatccaatctatctagtttcatttttaattcatggtgctcacaaaaccccttctcatcaggctcattttcctcaaagcatattatgcttgtgaagttctacttttgtgccttggtttatgttgttaatctttcctgataatcttttgaaaatctttttgagaatcttctgagaatcttttcttctttactctctgcctttccaaatcttctccactctctgcctttccaaattttctccatcccttaagtttcgtatggagatccattctcttcataaaactttccccaaaccttccagcgaatattaacctctcctttctccatttctttaccacctatatatagccttatagctcaaatgctacattctatgttccattctctattatggtgtgctagtcctgtgttcatagtcctgtgttataaattgagggcaaagataaagactttactttctttccctttagtagctagcacaagacttggagtacaaaagatgcttaattggtatttttgatcaattatcccaatgaagatatcattgctttattatattgttttggaggttgcagtggagagtgggggataattcagaggtttagaagattcatgtcactaaaaatgtccgttagggtaatatttcattgagaataccactacaaagcatatatgaggatttactatttctcaattatacttttaaaatatatatttctttatacttacaaatttataaaaaccacccaaaatagtccatttgtttcatcttgttggaaaatgtagttgtcaaaatggcctatttacagtgaatcaatggtgctctaaatgtgctgggaaatggatattgtatggatagagtaacaacccaagtaggaagtaggaacactgtctaataaatgtttacacaccatcaagtctacaaacattaaatatcatacatgatagaatctttctcatcctgtaatttatctcaatttttccattactttctttcattttctcttctagctttactcacagacaagcctcccaagccattgttccccatggagaatcagccaagtgttatagatgtccagctgggtaagtcccctccttggaataacacttcctaaacttgccctctgttaacagatggggaaaattgcatgaaccaggaaaggtttattgccactgttattacatgcaaatcaatttgtgttctgctcatttataaccctggagttcagtgcgatagcagtttaaggaaatgagtttgtattgcatcaaaaaatggtaatactaattagttacactgggtattaagtgtgctgtatgacagagctttttaattctgtgattgatagattcatgagtgtcttgcattggtgattggtacagaaaacttttcatacatgtcagccaaaatttttatttggacagcattaactcctggagaccaagcacttcttaaaataaaatacaggcttcggtttcgcctttaaaatgatttgataatattattttcaatatcacaatccagggtcatttaaaacttgtttttaggttgggatcctgaatatttatgaatcatatgatgttgggaaaagtggcaagttgacttatgagtgctattgtctttttacacactcaaataagaacacaaggtgttacacctctttttagagctcctactgctaatccttgtaattttaagtactgtaagctaaaaactcagaggcctgctaggatctctttcaaattgtggcctttaatttaaatcatgccctttaacatttgcgagatttcatctgtcttggatttcattctagtattctaaatttcttcaattctaaatagaagaaccacaagagaactgagtaaatatgcttgaaatgtattgggcttacactgaatatatgatttgttgatatttgtgaccattgtggtctatatccattatacagccagggaagacaaattgatcccaattttcactcatttagaaaggtttttctttttgtttaatttttaattattgtgggtacctagtaggtgtgtatatttatagagtacatgaaatattttgatacaggtatacaatgtacaataatcacatcagggtaaatggggtgtccatcacctgaaacatttattctttctttgtgttacaagcagtccggttataatattttagttattttaagatgtacaataaattactgttgactgtagtcaccctgttgtgctattaaatactagatcttactgattctaactatatttgcatgcccattaaccattcctacttccaccacacccaaaacccttcctagcctctggtagctatcattctactctctatctccatgagttcaattgttttaattttttagttccccaaaataagtgagaacgtgtgaaattcgtctttctgtgcatggttcatttcacttaatgtaatggcctccagtttcatccatgttgttgcaaatcactggacctcgttcttttttatgactgaatagtattccattgtgtatatgtaccacattttctttatccatctgtctgttgatggacacttaggttgcttccaaatcttggctattgtgaatagtgctgtaataaacatgggagtacagatatctttttgatataatgatttcctttcttttgggtatatgcctagctgtgggattgctggatcatatggtagctctatttttagtttactgaggaacctccaaaccattctccacagtggttgtactaatttacattcccactaacagtggacatttgggttccctttgctccatatcctctccagcatttgttattgcctctcttttggatgaaagccattttaactagggtgagatgatacctccttgtagtttttggaagttttgactcaacttttgatctttataattcagttgggattgttgaaagcttatttatatcttgaaaataagagacagaaaattatattcctaatgttcacttttccaaaatgaaatatagcaaatagtagtttttaaataagcctagcaatgtgagtaccaaagttaagcattttaaacaaaacaaaaagaaattaataaacatgttatcaagagtggactgtgcaaatggtaaatatttggaaataatgaagtattagactgtggctcttcttatgtcccctatattgttttgcagtcattatattttgttagagccaaatctagatatgctgatacccttactgactgtatgatacattttacttacatttctctaccttgaactgggataaaaatattccaagggaactttgtggttccaggggttacatggagccatatgacggtctcgtatcattagtttacatggaaattcaagtggataaattgatttcatttggtatgaaaacaatttatccacatatatatctatatatctatatctatctatctatctatctatctatctatctatatgtagaaagcaacatttgcatgataaaatgtacatgataagcccaggccctgtggctcatgcttgtaatcccagcactttgggaggccgaggagggcagatcacaaggtcaggagatcgagaccatcctgattaacacggtgaaaccccgtctctactaaaaatacaaaaaagcagccaggcatggtggtaggcacctgtattcccagctactcgggaggctgaggcaggagaatggtgtgaaccctggaggtggagcttgcagtgagctgagatcatgccactgcactccagcctgggtgacagagcaagactccatctcaaaaaaaaaaaaaaaaaaaaatagtacttgataagatacacaaataaaatgtgagtaaattttatgtttgtggtccctggaggaataccttctgtactctcctctgctattaggcacacaacagcaaagtttgaaaagtattgatccaaagcaaggagaaggaccattgtagaagatacattccattcagattcactgggtgtaacacctgtatgtactgttcaggacatctacaagatgtgcactttgtataaacctgtattctaacatagatatatatgccaaaataccctaccaagtactaccatcctataagattactaaaataatttacttccaatttacattagatgtaaggctgaacttttcgggttttagtttgtaacacaattggaaacaactttattgacagaaagatggagacctgcttatttttcatcccagaaaggctgttactctgagatgttaaacaaccatataattcagagaaagaaaagcaaaatcagtcaaaccagatctttggtgtttcaaggagcacatgactgattaattttaagtgattttaactctttcacggatttatttagtaccatttattcacaattggaaatccttttgtaagttgctctcatacctcaatagtcagatgacattatgagcactataaatgtcaaagagctcctccgtgtgagtgggagttctgcagtcagaatcatgaggcattagaaaacaccatgtgtaaaaaagagatagagaaagataactgggactactggatatctctgtctatgtctggaaaacttgaagaattcagtaaggtaatgaaaactggaaattgttttccttcagtttctgaagtttatcaaacacattcaattctggacatcctcaagctagaactaaaattagagctgccaagaaatacgaaaatccaatccatatggctaaacacattatcaactttgggtttcccaaatcacattacttaaaattttagacaacatcatggtagattaaaggtggccatagatttttggctactcctaatatctaaacttgatttttcattcttctcccgttgaatctgggttggccgtcgggacacacttgaccaatagggtgtggcaaaagtgatgttctgaaattttagaggctgaatcaaaagaaacttgcaacttctgtcccagtgttttggtccactctgaaaccaccatgctgtttgaagtttaagccacatagagaggcactagaggatgagacacaatatggtgggagagagaggtcaactagcaccaagacaccaatataagtgaagaagatatcttggaagtggatcctccagccctagcttccctggcttatgccatgtagatcacagacaaaccactgagctgaactcttctcaaatttatgaccccaaaattcatgagcaaagtaaagtgattgtcatttgccattaagttaggggtagtttgttaagtaattagtagataacctgaacaaacattaatcagtttatctagagcattattaattttatttttcccatggacaagaatttcatgcagcaattttatgcaaaatgagacacgttttaggaaatacttgagtatcagcttcaaggtagttttaggaaacatggtctggaataagtgtttatgtgttcatttgagggttacactctgttctcagttctgaatatttctaaaaggaattcattaaatgaaaaatttcagtagaaataaatacttttcatgcatggagttggcatcagtacagatattttgttatgtctctagagaaaaataaacatcttgactttttcctatagtggaagccattagtcatctgcaaagttctagaaatttagatacgtttttgctgatttagtgatgacagtttggttgttgctaaattgtgttcacattgtaatactgaaagaagatgaatctttaccaaataaccatatattttgagatgataaacacattcttaacaaaataatctgaaaactattgctctcacaaaacaagtctatgcaactaacgttccctgtggtaatgtatgatatataaaagataaaacaatgtacaacacgtacgtgcaaaattccaatttggtcctgttatcctttattttttctctctctgaaggtaaatttagctttaaattcgagaaataaaccttgactataccagggccaattcttttctcagcagttgaaaaaaaaatattttcaataattttttctaagtaaaacaacactgtattacaatatataaacttattttacacctttaatacaaatttattaaaatattgtaaggacatgtgccccatttgaaatatattcatgctagatagaccctttttcataaactacttcttttcatgagacccaaatgcatgctttacaaactgtaacacactcctggaagctttgaaaaagtcatgaacaaatttgcatgaaagatttgagatctgctatctaattttaattaaaggtgagtttcaaaatgtgctctgttcttctgactgatgatgataattttcttttccttccttcctttctttctttctttctctttctttttctttctttctttctttttctttccttccttccttccttctttctttctctctctctctctctttctttctttctctttctttctttcttttctttctctctttctctctctctctctctctctctctctctctctctttctttttctttctttttttcttgagatgaagccttgctctgtcacacggggtagagtgcagtggcatgatctcgactcactgcaacctccgcctcccgggttcaagtgattctcctgtctcagcctcccaagcagctggaatcacagtcaggtgccaccacgcccagataatttttgtatttttagtagacattgggtttcgctgtgttggccaggctggtctcaaactcctgaactcaggtgatccaccagcctcggcctcccaaagtgctgggattacaggcatgagccatcgagcctggccgataattttcttcttggaagttttttaaaacttgaaataagctagacagcattatgcagaaaatacatataaacatttactttctctttctgtgtgaatcaaaaaggaggcctggggggcctaaggtagatcagaaaaacccagacaagtagaacatccaagctaattgggttacttttgatgtttcaaaaagccaatagttcatttctagacaaatctgatccagtataaaagattctttttcttttctattctcattcagaatttattttatttttacaggctattcaaattcatatttcatgagtgtgttatatgctattggctcaaactgtctctatatatgtaagaagtgttaatcttcatcagaaatcgatttccctagcatatcagtttctactgaaaattatatcagatcccttaagagaccagtgtaaaagactctacaagagaatatatcaaaatataacatttaattcaatactcaggactagaaggcaaacaaatacccagtttaatcccaaattaggaaataagctattcaactaaatttatgttttttataaaacattatttacctaaaaacatttattgagttcttactggatgccagcatattagctcctgaaaatacagaggtgaattaaatgaatttcttggccttaaggagttctcaatctagtggggaaacagatgtgcataagtagaattgcatcgcaatatgagaactgccaaaagagggaaaaaggaaaatgatttttcttgtggcaggacctcatgttctatatgcttaggctttcactaaaaacaatgacaaaactctgtagcttcaacccaattactagatttatctgaaaataattaagaattaccaagaatagaaccttttgaaatcataaattgtccaccatttgctttaatgtggcaaatactaaaaatggaaatttatgatacccttgaatcaattaagtttaacaaaattaatcaactccttctaaagttgaaataaaatgaacaatccaaagcaagtcaacaactgagctaaatgtcaaactagaattattgtattttttatttttttatttttatttttttttatactttaagaagaaaatgtggcacatatacaccatggaatactatgcagccataaaaaaggatgagttcatgtcctttgtagggacatggatgaagtagaattattgttaatgcaaatagtaatacatggttatttcattagctggagtcataacttggtatatgcattgtgtgtataatggtggaagcaagggattttttaaattttttatatcatattcttaccctcttagtttcaaataactccttaaaaacttttatgtaatcttgaataactgaacactatggagactttggagagtaagaaggagggtattatgaactaactcagttttcttggcacacgtaatgggagctagttcatggcagaatttcctcacccttgtagacattctagggttagtgagttgtttccaaaagacctatttattcaggataacacgcacaagcttagcgtgagctaccccaaactgaaaaccattctattgcccagatcatataccatgtgcattatttacagctttggaaaatctggaccaagccttttccttaagagttggctgcagtattgagtgagactgaaactggttcccttactttgtctaagtttctataacagctgtgcttgttttgagatttttaagaatgaaatgggaaaaaagttaacagtttactaaatagtgtctgttataatctaacaatgtgattacgaacatctcttaaatagcatgattgttaaccagtcctctatgcatacattggtgtttgggggcattgcttaggcttatgtcttattgagatactgatacaagtttgatggtgtttcatcatatttttaaaaagccaaaaccattatttcatatatttgaaaccaaaattatttgagaatttactaggtactaggcactaaaatgggtatttgcacatacagtgtcttattactcataagagctcaaagtagtagtagatattgttgaattattttgcagatgaggaaacgtaaccacagacaggtgaaatagcttacatgatgttacataattagtaagtgacaaagatgggatttcaacaagatctgtttcactccgaagttttttctttttattatagcacactgggtatggtaacattatctagaccccaaactctatcctaggaaaaaactatcattctaataaggacagctaaataatattaacaactatagtaattattatttaataacagctctactattacaaataataatgttattactctacttagtataatttaataacatttctagtactgctaagaatagcaattattattataatcttatttaataataattctactactaataataattattattatttgtagtgataatatcagtagtagtagtagtggcagtggtggtggtggtggagctgtcacttattgattgcttacagggtactaggcactatattaaatactttatatagcttattttatttaattttcccagcaactctttgtgataaacccaactacttgcctcattttaacagttttattattatattagtcatataccgtacaattggcaatttaaaacatccatttcaatgatttttggtctattcacgatgttgtgcaagcatcaccagaatttcataacattttcaacaccccagaaagaaactctgtacccattgacagtcactcctcagtccctcagcctcaccccatcctcagctttaggtagttattaatcaactatctgtaactatagatttgcctattctggatatttaatatgaataaaatatgtaacatgtggtcttttgtgataggcttcttacatttagcatagtgttatcaaggttcagtcattgttattgcatgtataagtacttcactccttttcattgctaaataataatcgaccacattttatttattcattagttagttgactgacattttgatcatttgtattctgtggctcttatgaacaatgctgctgtgagcattcatgtacaaatttatgtgtggacatatgtttccatttctcttgtgtatacctaggagtagaattgctgggtcattcggtcattctatgtctaaccttttgaggaactatcagactgctttccaaagagactgtaccattttacattcctatcagtaatgcagaggttccaatttctctacattcttgaaagcacttgttatttttttatttttaacataattattctaatgtgtatgtagtactattgtggttgaaattgtgttttttatttatatttccctaatggttaactatattgagcatcttttcatgtgcttgttggccatttgtatgtctttggaaaaatgtctatggccccttttttaaatgaggaaaatgggctcggagaatttatacaacttgtcccagctagtaagcagcttgaaagtagtgaagctaaagttgtcactcttaaaccttgccgtattcctactaatattagtagtattgtttacaaggtcctcttgtacttctgctctttcctaaaatagatttttggacagaaggtgagtgatcatgtatatggaagttaaaggggtgtctagtgtgaattgattcagtgagaaaatagaaattattaagagcattgctttaactttaaatctttgtaactcaagccacaactcctttttaaataccaaactaatttgtaagcagtacatatgcctgaaaactagctgtgaagcacaagacaatataagaaagttttctggagggatttacagtatacttaaatggccaaaaattgtatgtaacccagtatctgaacagagatcaagaaactaatttgtatcattcaacaataggaagtatagattaaagagactttaaaaataagttagagaactctccactgtttgaatttattaggaataagtgtcaactgagtgcactgttccccaaaagcatatgatgtctgtgttgatatcaataccatcagctttgcagcacttctcagcagcttcatcttctaacccatcttattcagtgggttatagatgctttttaaagatctggaaaagaaaaaaaaataacgctacaaattttgactatgtctaaaatgccacatgaactgggaaaaaatagaattatttatgatctcttttaattcaaatattttatataattttatgtaaataaaggcagattttatggatgaacttgtagaaaattgagtaagctattatcttgcttattcataattgaggtagaagggtattctcataattgaggtagaagggtagctttgtatcatttagacaattccattaattgtcctctatacttcatttaaataaatttggcttaaactttggaagatcttttgctcctttaataatagctctttccagaaattacttagatatatcagagtgggatataaattttggtccctttttggggggtcagggtctcgctctgtcacccaggctagagtgcagtggcatgattctggctcactgcagccgcaaactcctgggctcaagtgatcctcctgtctcagcttcctaagtagctgggactacagggacacatcactatgcctggtgaagtattttttaacatttttcattgagacagagtctacacagaataaggacaaggcaggagatctgggaaaaaatactcagagatctgtgaaactacagctagtagtttatgttcaaagtagtaacttggagtttggaagcttacaggttgcagaagccccggcaaggtggtaagcaaagaagtcacgtcagaaaaaaaactgatcttgggtttctagcaaggtggaaaagtcaaaggctgaaagccatcacaaatcaggcaacaaatggatactgaaagatcaaagacaatggtactaaacctgtaagagtttgctcgattcccacaagagaaaggtattgtcactgtgaacatagccactgaaaagtaaagtttgaaagaactgggtcttagagtgatgcaaaagagggcacacctggcaattaagatcagttaaagcaagtcctttggctgaaaaaaggaactccttcaaaaagagtataatataaaataaacttggcctgataccagttctaatgaaaagtctagtctttaccaatatctgaatttcaaaaaaactgaagtaatagtatattcatcaagtccacaaaaaagctttgattttgtttacaaatgcaatattaacctaggaatagagcctatgtatattgaaatgtggtgtacatttgtaagacacttattttccaagaacaagaggagctctgactcactgagggcctgtatcaatttcatttattttccttagttgtgaaggtgttgactgtatatctgttactatagtgatgattttacatttgttgtcaagttgtttgatgaaattgtaacttggtgagatgataatcatggtgtgtcttaaggctgattgttggcaaaagaacaaaaataatgtgaacatgtgatggagagggggcctacaacaaaggagagggaaaattgtgtcaaggtacaatttgaaaactgctgtaaaccaaaaataaaattctaggcgtctctccccgccacaaccatctgagtggactcctcctctcggccagggcgttccaaagttagcatgaaaaactggttcaggccatgacaggaagggaggactggacatgtttcattatactctactcccttttagaattcaggaaaagctgaccagcatttaacatcaacacagaccttaagtctgataagaaacatatacaatctattctctctgaagcttgcttcctggaggcttcatctgcatgataaaaccttgatctccatagccccttattgcgacccacacattctttgtgattgataataactttcaaccagttgccaatcagaacattttaaaatctacctataaactggaagtcccctgcttcgagttatcctgccattccagaacaaaccagtgtgtatcttacatgattgatatctcatgtcttcctaaaatgtataaaggttgtgccctgacccaccttgggcacatgttctcaggatttcctgagggctgtgtcacaggccattggtcacttacatttggctcagaataaatctcttcaaatgttttacagagtttgattctttgtgttgacactctcttagctcaattatgggaaaatgaaagttcttgagaaagaaagagaatcatgctaactttacataagataattaaggaaagtgaagggttaactttaacaatagtacctcatatttatgcagtatgtatttccaaggcattcaaagcatgttttcaggcatcatttaattaatttctttggtagttctgtaaagtatgatgagtataagatatcattcattaagcattgacacgtgtagtgattaaggttctttgtgacacccacaggcagtttaattgagcatgctagtgaggaatcagctagatcaatagtgaataaatgattgttagcctgatcattattagtcagatcagaatttctgtaactctactattatgtatgtacacatatgactgctattatatatatgtaaaatttatagcagggatgatgtgtgtactcacttctgtgtgtgtttccacttcctttctcagtcaagtggtttgcttattaacctaataatagccattctcatgagtgaccactttgtatataaagtagctcttaaactttacagattactactctgcttgcatttactttttggttctcaatgttgattcctgtgattttagtttttatattcttttgatgtacaaagaattcttaaatatatttattgggtatatatgacatttaaaaccatataatctatagtgatcagatgaaggcaattagccagtgaaatgtaaatcaaaatcacaataaagtatcatatcatctcagttaggatggctattattagcaggacaaaaaataacaaatgctggtgaggattagaagatactattatgaacaattataaaaactgaagaactttgtcaacaaattcgaaaacctagaggagagggataaattcctagatacatacaacctaccaacctatcattgaaccagaaagatgtagaaaacttgaacagacaaataatgagtaaggatattgaatcagtaataaaaccccccaacaaagaagatcccaggaccagatggcattactggataattctactaagaactaattgacaatactaataataaatgttaattaaattcattaacaataactaaagaagaattaattccaacttctcttaaactcttccagaaaattgacgaggagggaattctttcaaactcattcagcattaccttaatactaaggccagacaaagacactaaaagaaaagaaaactacaggctaataactctgatcaatgtaaatgccaaagtcttcaacaaaatactagcaaactgaattcgacaccacattaaaaggatcatacatcatgaccaagtgcgatttaaccccagaatgcaaggaagtttcaacatatgaaaatcaatcaatgtgatataccacattagcagaacaaaagataaaaatctttagaacacatgaatatctcaatagatacatacaaagcatgtgacaaaattcaacaacctttcatgataaaaacactcaacagaatgaaagccatatatgaaaatagtccacagctaacatcatatttgatgatgaaaaatcgaaagcttttcctgtaagttgaaggacaaggcaagtgtgcccactcttgtcacttctattcaacttagtaatggaagtcattgccagagcgatcaggcaagaaaaagaaaaaaaggcattcaaatcagaaataaagaagtgaaagtatcactgctcacaaatggcataatcttgtaggtagaaaaacctaccaattccaccaaaagttagaactaataaattcaacaaattgcagaatacaaaatcaatattcaaagatcatatgcatctttatagactaagaataaatgatccacaaataaaattgagaaaacaatgccatttataatagtacggaaaagaataaattacttaggaataaacttaactaaggaggtgaacgatctgtataataaaaaccacaaaacattgctgagataaagaaggcacaaataaatgaaaagacacctcacatttatggattagaagtcttagtattgttacaatgtccatgattacccaaagtgatcttcagattcaagacaatccctatcaaaattccagtgacatatttttttgcagtagataaatcaatcctaaaattcatatggaaacacaaaggtccccaaatagccaaaacaatttaaagaaagaacaacaaagctgaggcctcaaactttctgacttcaaaacatactacaaagctacagtaatcaaagcagtgtgatactagcataaggacagatatgtagaacaacggaacaaaattaaaaaaacaatagaaataaacccatgtatatttgatcaaattaccttcaacaaatgtaccaggactaaacaatgaggaaaggataatcccttaaaccaagggtccccgatccctggggccacagaacagtaccagtctgtggccttttgggaactgagctgcaaagcaggaggtgagtggcgggcaagcaagcattactgcctgaggtctgcctcttgtcagatcagtggcacattagattctcataggagcatgaaccctattacgaactgtgcatgtgagggatctaggctgcgtgctccttatgagaatctaactaatgtctgatgatctgaggtggaagagtttgatcctgaaacaatccccccgatactgtccctgttcatggaaaaattgtcttccacaaaactggttcctggttccaaaaatgttggggatacagatgatcttgggaaaactggatatcaatatgaaaaataatgaaatcaggccccttctcttataccatacacaaaaatcaacccaaaatgcattaaagaattaaacataaaacctgaaactatacaactcctaaaagaaaacacaggggaaaatcataacactggtcttggcagtgacctttttttaatgtgacaccaaaagtataggcaacagaagcaaaaaatagacaagtgggactacagaaaactgaaacgcttctatgcagcaaaggaaataatcagcagaatgaaaagacaacctacaaaatagaagaaaatatttgcaagccatatatttaacaaaagtctaatatctaaaatatctgagtaactcctacaactcaataacaaataacctgcaaaaataaactgattgactacagataaaaactttgcatagacatttctcaaagaagacatacaaatagtcaacaggtatgtgagaagatgatcaatatcactaatcatcaaggaaataaaagtaaaccataatgagctatcacctcatacctgttaagatggctattattataaaaagcaaaacaaaaggagagaaaataagcgctggtaaggatatggcaaaatcagaaagcttgtgcaccattggtgggaatgtaaaatggtgcagcctcaatgggaaacagtatggcaatccttaaaaaattaaaaataaaactaccatatcatccagcaatttcacttctgaatatttgccaagatgtggaaacaacctaaacatccatcagcagattaatggataaataaaacgtggtctatacataccatggaatatcattcacatttgaaaaagaaggacatcctgtcctatgcgacaacatgaatgaaccttgaagacattatgcttagtgaaataagccggtcacagaaagacctatactgcatgattctgtttacatgaggtttttaaagtagtgaaactcttagaagcagaatgtagaatggtagttgccaggcactggtagaagtagaaattggaagttgctgttcaatgggtatagagtttcagtcatgctagatgaaaaagctctagaggtctgctgtacaacaatggatatatagataataatactgtatacttacacatttgttaagagggtagacttcatgttatatgttagttactacaatgaaaaaaaaaaaccaaaaatacaaaacagttggtgagaagtgttctaacagagatctattaactcagaaacctaaggcttaaagtatattcttccctctaccttgtcttatataatgtgccaacaatgcttagagatcttcctgcttagactgttctatattattgctttagtaacttcaaattaggatcccatatttttgctggggcaagtattacaatcaattccaaattggtctctttgcctcctctttctcatctttaataaattctcatcactataaccagaaaaaaaatctatgttaaaatgtaaatcttatgcatctttcctgatttaatctcttacataactctcccttacttgcccaaaagagaaaatactaattccttacattgattactggttgccatctacttcttcagtctcatcattcttgctatgccaaattgttttatttttgttcacacaggaactcatatcccttctcactcacaacctcctggcaaacattttttatacaccaatgttgagtttatcatcacttcccaatgatacctttcctgatccctgagctgcaatcccaggaagaaaatatgtatcccttttatgtctctactataccttatgaattatcctgtcccagcatgtatagtttttaattatatcttcatttgttgatatgtatgtatctcttactagactgtaaaactgatagtatttgcttcaatatttcttttccagcaataagcactgtgcctgatgctcaggaaatgtctattttatgtatgtgtgcacagtcgtatgtatgaacaaatttacagatatgtgaaggaatgaaaaaacaagtgaataaatttctatgataactaaatttcagatggttggcaacttccttcactgcagccctcccattaatttcattatattttacaaatccaactttactttagaaaacaaccttgtgatttaatttagtgctatctagaaccataagatcttagccttgtacgatggctcatgcctgtaatcctagcactttgagaggctgaagtgggcagattgtgtgtggccaggtgtttacgaccagcctgagcaacatggtgaaacccccactctacaaaaaatacaaaaattagctgggcatggtagtgtgtgcctgtgatcccagctactcaggagactgagctgagaggatcacttgagtcctggaggtcaaggctgcagtgacccttactcgcatcactgcaatccagcctagatgacgaagtgagaccctctttcaaacaacaacaacaacaacaacaacgacaaacccatagagtcttaaaattgcaaggaaactccagccaatataataaataaccacaaaatcacagtggcttaacgtaagaaaagtttacttcttgctaatacaaaatctagttgggtattcatatgacttcctatgcagttcaagctttttctacctagtggctttgccattctgctggatcccccacacttatctagccaagagagagaatgtggagggttgcaatgttgtttttaggttccagaacagaaagtagcgcacattacttccaaccatatcttattcagagttcaccacatgaccaacctaattacaaggaaggttgcataatatagaggaacacatggatatgggtgagcactggctgtcccaatagcatttatctattcctacttgatgttgctcctctgggagcatctctaagaatattgtctaaaacaaaagcattctatgacaatggagaacacattatctccacaaggcagcctattcaattattgtataattcttgtaatcagaaagttccctttatgctgaactataatctcactcttgtggcaagacagagtaaacctatttttcttccatatagtccttcaaatatttgaataaactagcaggatcccccagcctcttatattctttaggataaatatttacaattcttgaaaatttcttataggaactatacactattatggctaccctcttctggatatacttaatgaagagtgttaatgtacttcttaaaatatgagaccatataccagatgtggcctaactcatacagaataggatattgacttcctgtattctaatcactatgtaaaatgagatcatctgtgtgaaggcactttttacaatatgaagcaacacactcatggaaggtatcgttattattataaatgtaatttgagattgtgtgagcttattcagcagccacatcacactgttggctagtgttttaaacttgtggtcagctaaccccccaaacctttttcataggaattactgcatgaaagagccccataatcatttcttccatggtcagtgaaaaatacattctttttttttttgtttgtttgcctctgagaaaataggcttaatggtgtctagatttctggggctaagtaataatttaaaattcttgacaagttttaggtcctatccacctacacaaaccactttgaccaaaatcagtgctttaaaaaaaaatgcaaatgtagttagctaagcgtatttttttttgtctgcatgacaacaaatacctgatttaaaggcttttaaatcagtttgtggcattggtgtggggatggccttaaacttttgatttcctctttagtagctaatggtttcgtttcattaagtgctctctgtggttaagaactgcacatttttcttggaattttgcaaacagaatgagcaatttaaattatgcagaagcacagaaaccataaataatagcagccttaagattgtatgattagtacaattaaagcagagatatggaaaaacataacttttccatcatattattctccctctctaggaacattctggatcaattactactcaagcccataagtcaaagcaatctcttaaatccaggattagcagtccgtaatgaaaggagcagaatttttgtgaatgcagttattttcttagcctatttgtactccccaaaagttcccagttaattaactggactactttaatcagtgaatggctaccacattacacaatgtttgatttatattaatgcgctttggtcttggtagaccagaatttccagttctctaaataagagaaaaaagaaggaagctggctttcttattggacagtgaaaagtacacagcagttttgattaaactgaaataaaatatctctctaaatatttacctcaaggagacagtggtgtactctaaagaggtggatgactacaacataccctcccttaccacatccatgagtgtcctagggctgctgtaacaaagtgccacaaatgggtagcttaaaacaaatttattgtatcactgttccagaaactagaaatctgaaatcaatttgtcagcagtactgtttccttctggaggcaaaaagggagaatctgttccatgtttctcttctagcttctggtagttgccagcagtccttgatgtgccttgactggtagatgcatcactcagatcttcgtcatcacatggcattttctccttgtgtctccttttgtcttcaaatttcactcttcatgtaaggtcaccaatcattggattatagggctcaccctaatccagtatcatctcattgtaactctgcaaaggccctatttccaaataaagtcaattcacaggtatctggagtttaggtacatacattttggagggaactcagttcaagtcatagcaccatacctacttacatcaagatctgtatgacagtgaacatctggattagaagtaaaaccttcagtctcaaaataagaagtttgctgagctaaaatctgaatgcctggatatttaagttttcatatcattggagttcctggaaagatacactattagacaaacacataggcaggtttcatgcagatcttaaaagggaagtcctatataaaaataggctgtaacctgtgtattgaatctacaagtctcacttaccaagtgcaagagaggaaatccctgcatataaatgaagcttctttcaaaattgggccttatttgaagtattattattttttctttcctatcttaagtccatagggcttactcattttatgacagaaatatttactcatcatctggacaattctgagatcctgatgtgtttgtggagtttgtattgatgcagcaacatcagtttatagatcagaaaaaaaatgaataaaattctttcattataacacaataccgaggagagcaaaatctggtcaatataatcttaagggtatatgtacaaatctcagaagtggtatagtaagcaagtacaatttcagggttatatttctttcttaccttagccaaacaaattgtgaagaaaataagtagtttgggaagtagagcaaaatagctgacatgtatctattgttttcttgtacatagattatagataattataaatttagtttctagattcttcctgcataagggtgatgccaccaggatttctttaagtctatgcatataatgcaacccatgtcctcctagcatctaatccatggcagtgaagattccatgtatagtcactataaataataggcagttcagataatagacaatcaaaaaatactgaataaatcagtgtaatgttaccatgccccagtaaatagaggtgtagcatacaagtctattgtaattcctatatccttagtgctggtatggtaatgtgggatggtttagttcttgttctgtctagagccataaaatgaccctaccctcccttccttacctgagtatgctccctcatgtccacaaatatggcctttaccaatgtacactaatctccgtaaattttaaatagtacttcatacgcacagataatttaagcaaaggtccatgagatttaactgatttaacaaacacttatcaagtgctagtgatgtaccaggcaccattataaacactgaaatttaagacagacatggtttcttctctcatggtgattactgtctagcaggggagacagagattaaataaattaacctaccattttacataaatataaaattacaaattgttgttaagtgttatgaatgaaaataagagagaacatctattacattgtggatgagtagaaatgaatagttttagaaagttcataaggtaaaagttaaaagatgaggaggaggcaccatgttaaaattaagaaaaaatgtgcctcaattaggcagaatagcatatattaaggtcttgcagaaagaaaaaaatgttgagaatatttgagatacttcatttaagtccagtatagctaaacattgccatctgtgaagatggagataggagtggtgtgaagtgacatcagagaggtaaggagtagtcttatcatgccaaacatcacaggagggttctaattaaagaagtttcatgatgtaatttatgtacatttatactttctaacttttaatcttgaaataattgtagacttacagaaatgttgccaaagtaacacagagatgtcctatataccttttcacccaaccaatttttatgaggatcctggttaaaaggatactgcagtatttcaggcaaaagctgaaggcaattcagtctaaggtattggtggagatggaaagtgattgtttgagatgaagtaagattaatagtacttccctgaaattaacctactatacctcggacactctattgagagctggaaatgcagtagtgagccaaaaagacatgtttcttgtctttaagaagcttgtagtctagcagacttggcaatggattggatacaggtaggtgagaaagagagtaggtgtaagaaagtctttcaggtcactgagcaactgagtgagtaaagaacacttactaaagtggttatttcagttacctattactctataataccctctccccaaatggtggcttaaaagaacaatgatttattatttctcatgatgccatgggtgtccaggtggttctcttgctgcacatgattttgactgtggccactcatgcggttccattcagctgagagcttggctgggcctggaacaacccataactcacattcttgggccttgatgctgacctttgacagaagcagttaattttttctccatgtggcttctctctccacacaatattttattatgcactcttctggtacaagcttctttacttcatttctctcttctaagacagtgagaagattccaggcctcttaaagactaggcctggaatgagtgtcactttcactgcattctgttggtaaaagtgagtcacagtaccagcccaaatttaaggagaagtgaaattggttccacctctgaaaaggaggagataaatgcatataatggttgttggcaatttttggaaacaatacatcaccatggaaaagtctgaaaggagacggagattataagtcgtaagatcaaatgagacgtcagaatatttcaaactgaggagctcttaagagagcttctggtccatcgacattgtttttcacatgagaaaactcaagcccagagagaaaaacatgacctatttaagatcatacatctgctttgtacatagtatcccaggtacagtaatcccaaatcagctagtgtttttcagactacatttctgctccctctttatgtaacaaaatgtaatctattcttgaatttccctctttctttcaacattttcaagctaacatttcaatgaaatataactcatttccagggaacctcatgggtttcttacgcctgtagaagaataagtaaatggagcaccatcttaggaaaccaagacagaaattgggctctggctatgttttatttctagtgtctttttcccaaatagattcatgttgtgccattttatgttattcttactctgtcaagagaatgagttgtttgaatttgaatgcctcatatattctgtaaattacaaatagcaacatttggctatactattttgaccttttcgacaacgtataattttcagggtatgccattgcacgtctcttgtttacggcctcagtgaactgtggaaaagaggtggcgtggccatcaagtcaaaatatacaatactgagaaggtcaaaataatgtatcataagactatttttcaaagcaaggattaaaattaggataaatctgtcttattactcccttccccctcccatcatacacgcacaagcaaatgtgatttaaaagactgtgcataagatgatgcagaaattaataatataatggctaaagttgtactattttttttacttcattttgagaaggaattatactacgtataggcagactctagatccaccttacaaataggtttgatagtgctacatttatcaatcctactcttgaaactttctcagggatctcagggatctctgattatctctaattatccaaaattttaactgcaaatttaattttaatttattttgatgttaatattgaaaaaccacttagcatatgcttaggagaggaatggtttatatccagaaatcaaaataattgtagggtttaaactttaccaaagttaaaaatcattacctatttcagtggctttctccttttagtagtggagccatgtctacaaaagcaaattaaaaccaaagccctatatgaaaacacattgaggggaaacagctttagcgaaggagaaaatccctaatgagatccccatcctattaggccccagccactgcaatagatctcctaaagctctgcagagtggcttttgaaaacctctgttccattgcaatgtatagctgcctaaaagagcaactgaccctctaccaagtaaacctttgttattttgtcccaaggaagaatgaaacccaggatctccctgagcacaaaagagagttattattattattatttaaaatttcttctaaacccactatagcaaccttgacaatactaggcccatgggttagattccattcagtacttcagtctacttacaaacctcactcttcaatattgggatccttttaagagatcatattgctaaaattagcataaataactggtttcggaaacagtaaccaaagctcatggccataagttatagatgtatggatagattattcaaatcacttagccttaatcattaaattctttccctttttatcaaatcaatacataactgtttgaatttcacattgcctccatactgctacttgaatatcataaggtttacctcaagtagttaatatttgccagctctgaaaaaaaaatagtcctcaggtgatgcacttaaggcatcagaagttggaaagaacagttgtgaagccacccacagaaggcccttcagaagctggcagaaaagaaaaaaaaaatgaaagcttttttttttttcctgatgacttctgaaaaggaagaaatgtgaacttatccattcctctctatgttcaacactgggagccttatgcattgatcaagcattgacatttacagattcattctcaaagcagtgggggaagtattgaccagtaactatgaattaaatcacagtaaaaccacagaaaaataattagcaaattaccttcttaaagcaaagaatacttccctaagtgtcaggagacaaacaataagatccctgcttgtcacaaagagggttggtgatactggcaagtaatttacctctgtaactcagctttttctttctaatccataaaatagggattcattcatttaacagatatttattgaccacttgatatgtgttaggcacaattctaggcattggaggtatagcatttagaaagactgataaagtttgccctcacagaccttacattttacttgagagacaattattaccacaaacaaatatataaaatgttcacggactctaataaagttctatgaagaaaaagctaaattatatgatagaaaataactgggtgaggctatttcatataagatcatcagagaacatcttactaaagacatcacattgaggctgagaactagggtaggaatgagccaacattggaaaaagcttgaggaacttacgagaaaggtcgactttcattggccaataaggccaatattacagactaggacaaatgtgggcataaacttgagagaagatgattggcctttataacaactggacccatgaaattggcttcattggtagcctctggctaccagaaaataaacagaagcttaccacgagttaaaatgttttaaaatttaaaaattatgttcagtttcataaggcaagagatgttaagtgcatatatgtatgctaggtccttcccatagtgagcattgagcaagtaaccagtgaaaaacattgcaaaggggagatcaatgattagatgtaggttgtagccacagaatagaccaattggactattatccacttgaccttattagcactggtctctaaaagcaaccaaaactaggtggcaaaaaccttagggtagtgtttccctctaatccagcaagacacacttagaagcaagagttttattatcaactaaatttaggaaagggcttacaccctctcttcatcttagacatttatattgaatgttggtccatccaaatctctgcagccaggcatggtggttcatgcctgtaatcctagcattttgggaggccaagatggaggatcatttaaggccaggagttggagaacagtttgggcaaattagtaagacccctatctctacaaaaaaaaataaataaataaaattagcttggtgtcatgatgtgtacctgtagtttcagctacttgggaggctgaggaggggaatgcttaagcccaggagtttgaggctgcagtcagctgtgatggtgccactctagcctgggtgacagaatgagaccctgtctctaaaaaaatttaaatttaaatttaaaacagcctccgcaatatcatataataaagaaactggttgaacattgtttaattcatcatttctgtatttcaacatggaatactttacatggtaatgtgtatgtgtgtgtgtgtgtgtacatgtgcttgtgtatatgtgtctgtaggggtggcatgcatgtatgtatgtactgtatccatgtttgttatattcaccaacatctcactgagcacactgtatgaaaagctaggtatgagttttggtaatgtgtgtgaaaaccaaatggattctgtctttggtagcactgaactttaccccatgtggtggatacagtaatgcctcctcaaaaaatgtccacagtctaatccctggaacctgtgagtatatcaccttcacggcaaaggtgaattaacattgcagctggaattaccttgtgttatctgagtgggcatggattataagggtacttaaaagtgaaagagagaggcagaagaataggtcagagtgatatgatgtcatgtcagaaggactgaacttactgatgctgactttgaagatggtggaaggggtcactagccaaggattgtggcagctaccggaagctggataaaacaagaaaacagattgttacctagagtatcgagaaagggatacagtcctgccaacacttgattttcgccccagacttgtgacgtacagaactgtgaaacaataaacttgtgttgttttgccacaaactttgtgataacttgcacagcaatagataactaatagacttcatcttatgagtaggaatgcactgcactgaaagaggaaccaacaccatatagagagtccatttagtggattactttgttgatatgacaaaggaaatgtagtttcctcagctacattgactgagatacactagtgaagttgaccactcacatttacattatgaatgcaaatcaagatctaactaagctttattaggcaggcaaatcatttcacttatcaggattttcatattttttactgattctgtttaaccagctcttatgattcgagaaaaggtcattggtcatgttgacataacaattttcctatcacatcagttttggagctccacaaggacatcataagtatgaataatgtctatttttactcatttcatttctgcagcaagtattcttgggtcctgcttcttgaaagctggaaggaattttctaggaagtctctttcctgtaggctattttgtgctgtcctatatatatatacaaaaagagctcttatagacctagccccagtatgacatgtactttgagtttttttctagccacaaagaattttctctgatttacccacccacccacatgtgtcctctccataataaatagctggcatttcattggtcagcataagatgacagactgggacaatgactttggccatggaccagaaagaagctgaatggcctttataacaactggacccgtgaacttggcctcattagtagccagatgaactaagaggaaaaacaaatatttctactttaactttgagaatgactgtcttagcatcttctagttagcacaatattgagcaggagactatctctcccatttatcaaacatcttgaaataaacaccaagtggatgagactctgttaatatctaatgctcaactgaatgttttaaaaagaaaatattttgtgttttttaaattgaacacctctctatttatatattaggaactacgtttatacaggtccttttacaagtggttggctccttgagtaatacctaagagagactaaaaacttgagtaagccaaacttaaaatactttgtgtgatacgaatacttaacgactcgaatttcaaactgttaatgtcttttctctctaatttcagtcctctctaatttcagttctctctaatttcacccagaaatatggcatttctgggtgaaaaactgtcacaagcagcttttgtttttatggattattaatatgttccaattgaacaataattaaaataggtattgtaattggacacaggcccttcaactctcctccggggtttcttattgaactctggtcagtggtgagaactagctctagaatctattggtgaattctgttccaacagagctggctctctgagtcataagatgacatttctctggtgttttcctgtagataggaaacctttttctatatcttttggaaacatggagaacaaagtggtacttcaactgtggcttttcttttatttgcctcataaaatcccatgaagtattagtaaccatatttcttgaactaaaaattagaatgattacctaaattgtcttttccctaatttgtgaatttatttgtctagaaatcttacaaaggtgtaaaaattaaatcgcattttgttatatatttaacatatcacatttactgaaaagaaaaaattcatgagatgagggcagttcaagaaaaattcaagtaataagagtaattaattcttcaaaggagtgtcagacaatatctgcaaataattacgagagaaataatccagcaatgccagatttctttttctgtataataacatatagtcaaaagaaccagatgactatatatatttttatactttaagttctggggtacaagtgcagaacatgcagttttttttacataggtatacatgtgccatggtggtttgctgcacacatcaacccatcacctacattaggtatttctcctaatgctacccctcccctaggcccccaacccccaacatgccctggtgtgtgatgttccttccctgcatccatgtgttctcattgttcaactcccacttacgagtgagatcatgcagcatttggttttctgttcttgtgatagtttgctgggaatcatgatttccagcttgatccatgtccctgcaaaggacatgaactcatccttttttatggctgcatagtattccatggtgtatatgtgccacattttctttatccagtctatcattgatggacatttgggttggttccaagtctttgctattgtgaataatgccgcaataaacatacgtgtgcatgtgtctttatagtagaattatttataatcctttgggtatatacccagtaatgggattgctgggtcaaatggtatttctagttctagatccttgaggaattgccacactgtcttccacaatgattgaactaatttacactcccaccaacagcataaaagcgttcctatttctccacatcctctctagcatctgttgtttcctgactttttaatgatcggcattctaactggcgtgagatggtacctcattgtagttttgatttgcatttctctaacgaccagtgatgatgagcagtttttcatatgtttgttggctgtataaatgtcttcttttgagaagtgtctgttcatatcttttgcccagtttttgatggggttgtttgtttttttcttgtaaatttgtataagttctttgtagattcaggatattagccctttgtcagatggatagattgcaaaaattttatctcattctatgggctgcctgttcactctgatactagtttcttttgctgtgcagaagctttttagtttaattagatcccatttgtcaattttggcttttgttgtcattgcttttggtgttttagacatgaaatatttgcccgtgcctatgtcctgaatggtatttcctaggttttcttctaggatttttatggttttaagtcttacgtttaagtcttcaatccatcttgagttgattttcgtacaaggtgtaatgaaggggtcttgtttcagttttctgcaaactaatttagtttttctatcaaatcatgtgaaatggcagcagaatggggaaggcttgtgttcactaagtacaagtctgtgtgttgtcagaaaaatgatgagtcaaaaacagcctgcttttaacaaatgtcagtctactattaatgggtattttctaagaaaaattggtgtctggctaattttctaccttcagtgtttggccaactaaccaaagactgtctcactagattacaacctgaaaagctacctatcccagtttcagatttacaagcaataagcgttggaaccctgatgttgagtttatcaagtacaggagaagcagcatgatccaatgtaatctagacatgggtggggcatcaagaaactgcatgtttctcaccctgctgaatcttcagcaagttgccacatccttctgtgtcttagtttatacttttaccaaatgggggcaggaggaatgcctgttagggcatggctaaaaacaagcaaacaaacaaaacaaaacaaaaaataaaaaactaaaaccttatatgtggtagaatactttgaagcagatacaacaaaagtccagagacatagactgttatttataaataagcattacgttacaactcacgatactaagtgtagctaagatatatgagcagaaatttcccagaggtatacaggtagcccaagaagcaaaagcggacagtaaaaggaggcacatgaggagaaactactgtggcccagtgggatggagacagcaacaaagggaagcaaagagttaatagaggttttgctttacagttctacttaaccaactttctaaggaccagcagcatcagtaagccactgtaaacaaaggttctactttctttaatttgtttaaaacattaacttttgtcagccttcagggctgatccagctagatcaaatcaattgaatcagggttgaaaaggggagctgagagaggaaaaaaaacaacaaaaaacattaaaacaggaataaaggtggtgcgtaagaagaactttgtaaattgtctagcactatgaacatgtcaggaagaaaataaatagtaatgataataatgctactcctaggctctgatcacagagtttcttttctttagggacatccatgagtttgtagccatttccatcttcacagcccctgggaagtcagagaggaagtgtgttcactgatcacaacatctatttgctgaagacagaaccacagaccaagacttttctgataaggtcaaaagacactcatactacagttcttaatcatctggcaatcacagatccttttgagaatctaatggtaactaaagaaactctgtagataaaataaaatccataaactgaaaactgcatgtaatttcgggtgattcatgatatcttgaatctcaggctgcaaacctgtttatcactgccctatgctcatatcttcttatatgctaatttcccagcttcaccattgaggaggaggatcagtgaagatactaaagttttgtactttttttttctgacatagacacttagaccttaaaaaaaaaatttaccaactgtcaggtcagggattggcaacataggacacaactggaatgcaactgatgataagtgttttgggagctcactgggggctaaagtggttgaggaattttcagtgagtctcaaggatctgagctgggctcctaatatttgaatcagaagagatggaagacaatactttctcattttattacataagactatcttgactaggcaaagataggggtgtggtgggaaagaaaaccacgaacctgtgactagggagtgttgagggtggaacagctatgacctgaatcccttgacatctgctttgtggctttgcagcaggaaaatagatctagattatgagtaaaattaaaagagaaaatactgtataaacctgtaagaagtgcacctttatccttgtgacttgcttcaatatgtaatgagaagattctgggctgtgcttgaattcacagaaaatttattcctgaagaagttgtatggctgtcagaagggtttagaagtttgtaaggtgcaaaaatgggtttctgagagaagaacaaaggcaacaagtcaggagaaggaaggagaaggggatatgaataaataaaagaccagctcaaacatttccttttgaatgtataattcagtctctggaaacagctggttgtgatggttttccccagccaaccatgttttcaccaggtgcatattgttttcttagacagcaaataaacctgcacagcagtaattcagcaaaaaggaactttattcttcttgcattggacagggaattttcatttaatccatcattctgaacttgctgcactgttttaaaaagtcacagcaagttattcagggttgcctttgacagcagcctcaaaacacagggaagaatttgcccatgattacaagatggcatgacatctggagaaatcaggtgtcatccaggtattgggtatccaggatgtcaaacacgtggatgcaatgaactacttttagaaggtcagtgaaagcacctgcttagaaatggtttggttgaccttttcagtttgcatatatatttttgtgcaggtcacatccctaataaatgaaaatctctttgaaaacagaatccatttgataccccactataccaattagagtgtcatgcacataggagacaacaaataaatacaagagtgagtggtgatatttaggacagactttgaaacaatcattcctacagtcactaaaacactttttatcacctactgtgtgccagccacatgccttgggttacacaaataaatttcatagacgttttttgcaaggagctcacatccaagtagatgatacagacaaataaataaagtgcatagtgagtaactgtgtgataaggatgtgcactgtcctaaacgattttagaggaggagcagctaacttggattggaggactgaacaggagtgaaggcagagatcagatgttgtgggactagctaggatagtattagtaagaaacttaaaatcaggccccagattttgagaacagggtgtgtttccactagatgcaaggatatgttgtgtaagtttatagaaatcaaaagacaggtgtgttttgaaaggcaatgttgccagtaattaagtaggcattatttgttcctttattgactccaaggtaccacactaagtggaatggagtagataatcaacatgaagtgtccacagatcattctctcaagaaactcactgtctagtgttagtagaaaagacaatcatacaaataacaattagatatgctactgtaaacacagtgatgaagtttttccctaatttcaaatttatgtatgcagctccttactggatgtttaaacttggtggtcctgctagtatctctagttcaagtatagtcaaaattctcatggctagcactcagaacctcccaaaatctcattgaacattgctactactcttttcaggcatttattcattctataatgcaaatttgaatgcttgctgttttctgcacttgctctatcatttcacaccaatgtgtctgtgttcatcctgtttcctctattaggacaccttttctaccatttctacatatccaaatcctatcccagacttcaaggaaccactaaaaagccaggacatttctgattcccactctgtcattcaaaaaaaacaaaaacaaaaacaaacaaacctggaagtgactgctacttcactcgagctttcatagcatttttttctgtacttctctcatactagaaagacaaatttgggtctcattcatacagagataacaactgaaaccttacactaaaattaaattgctaaaaggcaagatagagagatataacagaagaatcaaagtcagaggttaggaaaacacacttagggggttgaggagaaaaggagccagggaagaggacagatagatagcaaagaactgaaaaataaagaacaaggagaaagggatgcctaatggtgatgaataaggcagaaacatcaagaaagagaaatgcacaaataatgaatatctgttgaatgaatgaaataatgaagaaggaatgaacaagtgaaagaagtcatgaatggagaggccattggatttatcggataggaggtctttggtggggaaagagtgttgacttggagaaattttgagggtagaagaaaatatagagaattagaatctgaacatatagactagactcctgggtcttctactgtgtagctttaagcaaataacctctatgaaactctttttctgttctaaaaatgagagaaacacctacaattacctccttcacctatatcctggggataagaatacaagcaaaagaccctagcaaaaataaagtgctatacaaatgtaaaatagtataattagcaacatttaaaagagctccacaaatgagaaggcattcaatcatcagtccaaagaaatattagtaacaatgagtttgcagagatccagtttacagatgtcatgacttgctgtgcatctgctggaattgagctcagtaccaggtatcattatgtattggattttgttttcagctagtatcccattagacagctttgcagcatatcttgctttagaaactcaattattacatttagtaaaagaagaaaagagatttatcttctgcgagtctctttaggattggtgtagcttttctcaccactacttgtagaaatcatagtcatagaaccaaagtgtttcagaccagcatttctcagcttccaggttaccatatactaatgacacatttcaagtacttggttactagtaaaaagttgtaagtagattcaagtataaccctatgataacatcatccactggcttatatttttatctaaattcttgaatgggagagaaaggttagtatgtcaggaatcatttataacttgccttacctatgctaccacccaagcatctatacaactttcaccatgagtgccctggtagaaaaaagataaagaatcaactgtatcttcagagatcatctagtcttatactatcatttataggtgaggaaagtaaggcccagaaaaagggagggattttcccaagaacccacaagtagttagaagcaggggcagagttggaacacagatcttctcatcctagtccaaagtcctttccaccatataaccttttctcaaagtgtgtgaatgtgcaaggtgctatacacacatacacatattcatgtatgcatatatacacgtgtatattggggaataatcaaataaatctagaccataaaagatcctataccatcctcttgaagattctgtcaagaagtctccccagatatctccaacacaacttgtagataagacaaagcagagtttattgcttcaccacctcctcgaagctttgacagtgcttcagaggggggatggtaagaatataatttattaagaattggaaatttgatgtaaggcaggtgtttcagtgcagggtctggactgggattgggtggcaatcatgataaaatagctcaggactgatggaagcagcaaagtgaggattttgaagggtggattcaaagaatcttagggctcaagcagtctgtgaacactctccattgaagagttgatgggtcttttgggaatctcctgtaatgagcaatgaaaccattggtttgggtaggacagtttgggaagagtaaagaaacgctaatgaaagcagggaaatagcaaagtcatgttagtatagacactaaggtatggttttggttctcagtgtccaggctgagtgtagaagttgacaatgtggggactcaattcacaatgtatattaaagccttagagaagtcctatattagttacatttgtttaactctatttaactcaggcattttcaacacctatctgactacagaaccctattttttactttaaacacagtctgaaaaactctgcattctattttgttctctttataagaggtagttctttggaacctattcagaagttgatcagttgtgaattatctaaaaacattaaatggaagctaccaaacattaaattggaagctacccaacgacagtagctgttctgatgactgccctaactagtctgacaaggctcttttgattgtatgctatgtaagtgttacttgacctgataagaacggctcaagttgtgaagcttttagttgagaacccattaatcccattagtgctgcaagaattaagtgttgggaatggatcattccaattaccttcctatcactttatacccagagtaatctttctttgtatctatattgcttatacctaatttgtcaataaactggtgccatcatttgcattttgagatacacatactcaggtgattttcaaatatttcttttctgctatgttttaaaatactttttgaaattgtttttcaaagcattttaattacgacttatcatagattaatcacctgtcaaatttaatttataaaaatgagatcattttaagttctgtcagctgcataagaaaactatcccaagccttaattcctttttatccagttttaaactacacagtcaagactgtgaatttttcctcttcttgacttaaaattgtgccatatatttttttcttcttcaagcaaccgtttatggcccacccaatttcaaaaattcttcatttatatatagatagtgagttaccaagtcatgcagaactttaactgagaaaagacttaatgagtccaaaggtaattgtgtatgcataaatgaattaaagggaaactcacaagtcagggatatggctgtgatacgtggcttgctaaaactgcaactgcttatactcctccattagattagatttagttgatttcatgatgttaagccagatattttttctattatagctatttttacacctgatcttagccaaaaggcttagaagcaatattatagctatttctttctttctttttttttttttttttttttttttttttgtgagacagagtcttgctatggcgcccaggctggagtgcagtgccgcgattttggcactgcaagctccacctccttggttcacgccattctcctgcctcagcctcccgagtagctgggactacaggcgcctgccaccaagcccggctaattttttttttttttttgtatttttagtagagacggggtttcaccgtgtgaaccaggatggtcacgatctcctgacctcgtgatctgcctgcctcagcctgccaaagtgctgagattacaggcatgagccaccgcgcccggcctgctatagctatttctaagaacatggggattcaagtttggggcatctgaattttgcaagctgcattaaatgggtcatgtactcacatggggatctggagagaaaaacaacaacagtgacaatgaaatgagatcagggtaaaacaaatagattgtgacttttattaatgtcattttcaagcaatctctaagtaaaattatatgacaccaagacattcagagaaaacagccagtcatctgatgtttagatatatgtgataaagctacacttgtcttggtgattgatatggtttggctctgttttcccacccaaatttcaccatgaattttaataatccccatgtttcatgggagggacctggtgagaggtaattgaatcatgggggcttccccctttgtttggcacttctctctcctgccaccatgtgaagaaggacatgtgtgctttcccttccaccatgattgtacatttcctgaggcttccccagccctgcggaactgtgagtcatttaaacctctgtcctttataaattacctagtcttgggcagttctttataccagtatgagaatggactaataccgtgatgtaaataatccttaccgccaagaaacataagagaccctgtctgtataactactacccactggtccacagaatacatacatggcttgggaaaattttattaaatctattttaatttttaatgttttctggcattatgaaccagcaattccatatatattattttggttgatcctctcaataactctgtcacttggttgttacatacagccttccctaacatatattaaagcagatgtcaataatttggtacacgttgagccatcagtgaattttaattgaatccaaccctggacctcaagagttggaggctttattctgtgactatggtaagcttataggcagcattatcaaacttttaccctttggaattatttagtttgagggaggtgatttgacataaagtatatctgcatcaatataatgataaatttcatggctatgttagtacttttatgtatcagcacagctaagaaaaaaatcacattttatttagttatcagaatgaatttcctgtatgagatctatcatctagatgttgagaaccatgtatcaatgaaatttagccccatctgggatttgtcattatttagaaacaagtaaaatgacatgcttgtgcatgtacattattgtaacatttaaagttgagaccagtaattacattcctgtagtttcaaacccaccccagcttctttgatactttctctgcctacatagggacctataaagatttcaagttgttctgtgacttggtgtctagttcagtggttctaaattttggctacacattataatcaatggggagctttaaaaggtattcttgacttgatcttacatccataggttctgatgtaattggtttggaatataacctggacatcaggatattttaaaagtttacgtattttatttctagtgtgaaggcaaagttaagaaccatgatcttgttgatttacctgctggtacaatgctgcccatggtatctcagtgcttcttcaataatcagtatcctgtttgggaaacattccccagaggttttcaatgactgggtccctgaaacttatttctctcatatcaatcaccttcctacttggattcctaccaattttttgttcttaaaactcaatcacttgcttcatctgaccctgcttggctagaaacagcaggacttagaatctgattctttgttttccagtctgctattttccagaataccatatcttttcaccatgttctaatctctgtctttgaccaaatctagggttctaactagactttcagtcctgatcttgtttagtcttccccaacctaccacttaaaacttcatgtacaacatcagtatctagatgattgtggattgcttttttcttattccacaaatattttggcatcctgcttctaaaaatgattagcatggtagttagcattgcaagttctgttagtgtgtctgaattgaaatcctggttccaccatttactagttttgtgaccttggatcacataagtaacctctctcagcctcagttttcacatctataaaatggaggtaaagatgataatttttagggctatgagcattaagtgaaataattcctgtagcatgtttttcacagagcctggtacatactaagtgttcaaatccacattagaaacacatctgtgtttaaataataataaatttggcaggtaataattggtatttgttttaaaatcaacaaacaatgatttgacaattgaaacaaattgtttcatccatcccatttgctattcatacaccagacctcctcatatttacatatcttttgaacagtgaatttgccttggaaatactaaatttcttcagagaaaagtctataggggtccaccactgatgcataagaaggccattgcgtttgatatcatagataaacgctaggatacatattttataattgctttattgccaggagttttcaatgaagccataaaagaaaaaaaaatgatcagcctaattgcctcgagatggatatgtaatgcataagtctcttgttaaatggatctagtaataggccacctgtttcccctgcctcctacccagttcagtatatgaatgaacagtgctttctgaaatgagcaaaccaagacttttaagtgcagttatgttgtaatttaatgacagctcatctcaggtttgaatcttacctaatcagataattctagagtttaagaacagatttgtatcttgcttatcatttttattgcacagtcattgagatatcctctaggtagaagttctcggctcaaaggcctcacttaaaagatgagcaagaaatagaggaaaggagatataggtaggcaggtgctggggcatttggttgatttattcaagaccaaattcatggtatgttaccataactgaatttaatattcggtcaagctgctcatcattcatttcccaccatttgacttcattattcaatctatcacaacatttgaagtctgcaatacatgatattatccaaaataagtataaattaagtctaaatgagcctagccactttgtacatgtcagagatttaggctccaataattcagaatttgtgacgactcatattactctgaaaaaagctgggggtgcagttattctcggcagattaacaggtttagcagatataggaaggtgtgtttaagctacttaaaacacatcattttcaagcacctaagaacttatttactgcaaatactagatatgataattacaaaacatcatgactagcctaatgaaacctgtcactgtgtttacagtgaagatgtttttttgaggatgttgttcattatttgctctacaaaaacctatggaatatatattttcttctggtctcattattttaaaatgttgcacttaccaggaaaagagacaatattaattagagatttaaatgtggtttttttaatcaggactacctgtggttaaattccaattctgtcacttcctggctatgtggcctttggcaagtcagttacttaccttctatgaatgtcagttttttcacctgtaaattgagggtaaagtagtccctgtggtgagaatccagtgaatttatatatgaaaagtgcttagaaatatgcctgaaacacttgataaatgcttagcaaatattagctgtaatagtatcatgagttttttccttgtaattagtttatttttttccaaataaacattctaggatattttcttgttgctgctagtttgggttcacattgtgacccacttgatacaagggcaaagactttatcacttgcatgttgtgattctctcttatgcttctattatttttaattttatttgattttgttaattgtctgaatgtatcaatcctttttagagtaagggatatattagtcaaccaaacaaatgatacaatataaggcaaaactagtttagtttcagctgctatgaaggatcaaaggtaaaaatagttcatttcaaaatatgttgtttttcagatttttttctgatttaaattagcgttttctcattactctgaattggtaaaaaaaaaatctaaccttttagtataaggctttgaaaatatacagaaaaacaaaaagaataatataatgaatgtccaaatatctagtacctagattgtacaactgtgaacattttgccgtgtttactccctctttatttttccagatttacgttaaggtaattacaaataacatgatgtttcacccctaaatacttcagcgtttatgtctaaaagatagcaacattttcttttgtaatcacagtattaattaaggataatgactcatttcactctttatataaatgattggcacagatatgggtatatgtgcttggtgcatctttgtgagttgactagtcagttaattacttgatgcagttttattgtatttgcttagttcttccccctggagcacaaaagatagaaaacacttctctccttctcttattccctcttccctgcctcttcccaagttagcaagagggaaaagaatataaggaaattaatttcctctactttgtaaactcatacaagttgcccctgtcccatggcaccctgcatctgcaggcaagttaataactttctttctctactggcaaaaactgctgactttactcctctcacaaaaggtagataatgtttgttagacattttgagattcatacatggaagctgcactttatactcaaagctttcttaatcccacagttgaaatggattgtattaatagtaattaaaataactactgtatcaactctatcagcagctgtggttctaaaagaagtaatattaaatactagccccaatcttttctcaattttcccacagagtaactttatctgtttcctttgtgttttcttatttttcatagttttagaaaatgtttaataattctgaatatgatatgtaacttccttgaatttttatcaggtatgatcagtgtgttgcccatttaaggcttggctattgtttttaagaaatacatgatttaatcacctcaatctcctctgggagaactcagattaaaactctgccattgagaagatcagacttgtcaaattgttttaccatacagaaaatgcacctaattatttaataacagctttcatcaacatttctcccaatttgttcttccttgattgtgttctcccatgtatcaaagatcaaatcttgagtcaaatatttaatattgaacaaagcatcacatttagaaatagtatgaattccatcatgcctagacaagcactgttcctgtgttggtggttattgacaggactgctgtcactgtttgctattatgggcttcattaatgctgccaggaaaaaaggactctggcattttggcagttactctttgccaggctctaaatttaattttcttctaagctttacaacttggctacacagaaattttaggagtgcgattagacatcttggctgttgatttagtcataaatgaaaaatacactaagttgtctttgtattgtctggttctttttctggtttagtgctttctgggcaggagacatgtatttcgtgtatatcaaagtttgatgcaaaataataatgtttacattttatactatggattatcttgaatgaatttctggatttgattaccataataacaataaggttgagcaagatgtattaggttcattttacagataaggaagctaagaaaattattattttaattttctaagttcacaaagtccaggaagaaaactctcttgaattctggacaagtgcaatatgctgcctcctagtctgtttaacgtggttattctattaacgagaatttgacaaagagcacctaaccacaatccaaaagactagtttctagagtgagttgtaagaattgaatgaatgaatgacagaagacataatttaaaataagattgatcagtagccattatttgtaagatggtacaattgaatggacctatatttctaggtctctactatttatgtctctatgtgaatcagtgtctctaccaagtaaataatggccagttgtggatcataagtcacaaatgtggcttgctcctcaaagcctacaggataaaaaggacatgcagtatatgtgagagtgtgttgtgtgtgtgtgtgtgtgtgtgtgtgtgtgtgtgtttcctttccgaaatagtttagggattttaatgttgttgttgttttaccaaaagttacccttagggcaactatggtacaatttgtgtgccaaggatatgaaatcaataattgagtcttgccccatgctatgattattgaaacagaattgatttgtgtatttccaaatactgtatatgagatatcgacctttgaatcatttttttaccactaaatacatggcaaattggtagcagtggttctagtgaaaaatcagaacacctcaagaagatagatatctttaggtgacagtggcaggactttctggtcctctcccttaaaatgtatcaagtagtatctttgtgaccctgccacctttccttcctctttccttctacaagcctccctttgcccaccatcttctctgattacacttgatttaacaagaactcctaccactgattcaaatggaaaatatgcagaactgctgcccagaaagcaggcatgtaggagaatcctcttggacgccactggtctcattcattgctaatgatagcctgcaagggctatcaatcatttcagggaatacccatgtcataggatacaggaattacagaagcaaaggggtgaatttataccattgaaaatgtgcaaatcaatacttgtgagtttccaacaatggatttggtagtggccattgtaaaagtattctaagattgataataacaatataagtgttctgaatttgaatagcacttttccccttgtcagtgtacttttttatctgttatctcatttaatccctacaacagccccataaagtaaacatggcaaggaggtattatcaccccttatttgacccatgagaaaactcaaataaaatgacaagttaatgatagaacttggactagaatttagagcatttgactccaagctatttatctagccatccagccattcctttcttccttcaaatatatcagcttcagtcccagaatattagatgcctttaggtgagactgaatatttttaaagatttttattttatttttcacaacattattttatttggaaaaattttaaacccacagaataattgcaagaaaattacaatgaacacttatatgccttttacctagattaaccagttgttaacattataccacatttgtactatgtctacatacacgggtatgtctgtatttttttctaaaccacttgagagtctgttgcagatatgataattcacccctaaattagttagcatgtgtttcataagaatcaagaccttctcctacataaccaaaatataactatcatgttcaaaaagtttaacattgataagatactatgtctaacacatatactatattgaaattttcccaattatcccagtgatatccttaataatatttttctgatccggaatccaagcaaagatcatgcattccatttattttcacattatattttcatgttgcctttaattagaacagtttccaagcccttttattttatttgtacttattttttccagctttattgaggacaattaacaaataaaaatttgtataaattcaaggtaatttaagtttattttaaattgatttcatgacattgacatttttgaaataaccagactagttattgtgtaaaattatcttcaatttgaattcatctgtttgctcataattagattcacattatacatttttgacaggaatatgatttgggtgatcctgtgtctttttcagtgaggcacatgatttctgttttttccttttattggttattcttagtttgactatttgcttaatgagatatctgacagattaaatcactataaaagcatttttttatcctttataaataaaattaataatctgttggcaatgctttgagactatttgaatactctgttcctcaaaatatttcactgatgcttctttccagaaccagtgattatgatgatggttgcaacctggtcattttaaactcattccacacatataagttggtattcttatatgaaaaggaattaccccctccttcattagtattactatagactcctagactctttctttttcatcaaatgtgtccattttgaaatgtacaaatcttaagtgtacagctcagtgaattattaccattttaaccattttaagtatacaattcagtggcattaaaaacattcacatttttgtgcaaccatcactaccatccatctctagaatttttcttcccaaactgaaactgtaccaattaaacagtaaagcttcattccgcctgtctctattccatggaaaccaccattctactttctatctttatactttttgacaattctagatatggaaccatacaacatgtccttttgtggctgattttacttaggatgtcttcaaggttcatccacattgcagcatgtgtgagaatttccttcccttttaaggctgaattgtgtggatataccacatattgtttatccattcattcttcagtggacacttggaatgcttccatgttttagctatggtaaatagtgctgctatgaacatggaaagctgttatgaacattggtgtgcaaatatctattctagtccctgcttttaattctcttgggtatatacatgaaaatggaatgggggaacatatggtacatatatatttattttttgaagaaccacttaactgttttccacagtggctgaactgttataatccttaccagcaatgcacatgggtgccaatttattcacatcctcacaaatacttgttatttacttttttaaatttttgttcctaatggtaagaatgtgtatgaagtgggtgtgtcattgtgattttgctttccatttatctaattattagtgatgttaagcatcttttcatgtgattattggccatttgtataccttctttgtagaaatatctattcaactcctttctccattttattttttatttatatttatttacttttaattttttaatttttaatttttgtgtggatacatagtaggtgtatacatctatggggtacatgagatgctttgatacaggaatgtaatatgtaataatcacatcatggataatgggttgtccatttcctcaagcatttatcctttgtgtcataaacaatttatttacactcttagatattttaaaatatacaattaagttattgactatagtcaccttgttatgctatcatatagtaggtcttattcattctttctatcttttgtacacattagccatcccttcccccccgcccccaccccactacccttcccagcctctggtaactatccttgtactctctatgtacatgagtgcaattgcttgaatttttagatcccacaaataagtgagaacatgggatgtttgtcgttctgtgtctggcttatttcacttaacataatgatattcagttccatccatgttgttacaaatgacaggatctcattctttttgatggctgaatagttctctattgtttatatgtaccatattttctttatccattcatctgttgatggatacttcttccaaatcttagctattgtgaacagtgctgcaacaagcacgggagtgcagatatctcttcaatatactggtttcctttcttttgagtttattcccagcagtgggattgctggatcatatggtagcttgagttttagttttttgaggtgcctaatttacgttaccaccaacactgtatgagggttcccttttctccaaatcattgccaacatttcctattatctgtattttggatataagccattttaactggggtcagatgacatctcattgcagttttgatttgcatttctctgataatcaatgatgttgagcaccttttcatatacctgttttccatttgtatgtcttcttttgagtaatgtccattcaaatattctgcccattttttgattgaattaataggtttttccccatagaattgtttgagctccctgtatattttggttattaatcccttgccagatgggtagcatgtaaatattttctcccattctatgggttgtctcttcactttgttggttatattttttttggccatgcagaagctttttaacttgatgtgatcccacttgtccatttttgcattggttgcctgtgcttgtggggtattgctcaagaaatttttaactataccaatgtcctggtgatttttcccaattttttcttgaagtagtttcatagtttgaggtcttagatttaaatacttaatccattttgattttatttttgtatatggtgacagatagggatctaatttcattctcctacatatggatatccagttttcccagcacgatttattgaagacactggcttttccccagtgtttgttcttggcatcttttccagcaacaggttcactgtaggtgtctagattgctttctgggttctctattctgttccattggacaatgtgtctgtttttgtgccagtaccatgctgtttgggtgactatagctctgtagtataatttaaagacaggtatgtgattcctccagttttttgaaattcctccattagttgttgaacactttcttactttctggaacacagtgtttcagactcactgtgtactctacttgtctcagccctggaaggagctctggctcattttagtggaaaacagtattttgaaaccatgggatatgggcaacagctttgctcattgctaatttggtgtcattgattctagactttttcagcaggtaaatgagtttatattgatacttctaaatctaatctaacaccacaatttgtttctctcttcctgcattttatatttgcacctcccttcacccaaagtgtgaaccctgaatctctaaagcaccaatatatctaattgttcactcctacatatagacaaaacagttttggaatttctgtacccataccaatatcaacaacaaactgtttaaagttaaaattttattatcatttacctttatccttagaatatactcacagagtatgttgtttaaaatttactttgattttttttttcatttgtggggttatctatttgatgtacagttagatatatgagtttctgattgtattcaattttaaagtttcccccattttttaaatgtatgtatttaaatatgtaaaataacataatttaaaaaatcaatactttgtaaaatagtaaattcagaaaagttttatacctttccttatccctttcacctcatgcctgtctacttcctttatataaacaatttcatttatttctctgccttactattgctttgttacattttgaaaaaaataaacatgtgttacatatttttccaatttcttactttttgtttcatgaaaggtattacaaggtatttcatatatacatacacctctagatatacatatatatattagattaattcttttttgtacccttttaaatttgctaccaggtgcggtggctcacacctgtaatcccagcactttgggaggccgaggcgggtggatcacgaggtcaggatttcgagaccagcctggccaatatggtgaaactccatctctactaaaaatacaaaaattagccaggcgtggtggtgcgtgcctgtagtcccagctacttgggaggctgaggcagaagaattgcttgaacctgggaggcggaggttgcagtgagcagagagcatgccactgcactccagcctgggcgacagcgcaagactccatctcaaaaaaataaaaaaataaaaaataaataaatttgccaatatttctgggaaatcaccacagataaattcatggagaacctaattgtttaaatttttattttgaaatcattatagatttatagaaggttgcaaagaaatgtataagaaagtcctatgtaccctttccccagcctcctctaaggttaatatcttacacaaccacagtacaatataaatcccaggaaatttgacattggaacaatccgcagaattattctgactttaccagttgtgtgtgtaccatttgtgttcatgtgtgtgcagcttttgccattttatcacatgtatagccttgtgtaactaccaccacaatcaaggtattcaactatagcatcaacacgaggctccctcaaagaccctctttatagccatactcatcttctccttcactatccctaatccgtgacaaccactgttatgttctttgtatctataattatttgacaaatgttacatacatggagtcacacagtatgtatacctttgagataagatttttttcactcagaaaattttttgaggtttatctaaattgttgcatatattaatagtttgttcctttttgttactgagcagtattctgtggaatggatgtgctacagtttatttaaccattcacccactggaagacatttaggtagtttctggttttcagccaaaaagaataaagctgctatgacaagttcctccatcctcattcatttttacagccacatagaacttcattgtgcagttttcctatgtatagagatatagattatggctaacattttgttattagtaaaaattattcagtgatcatttgtttatatgtatttttgtattatcaaagatataccttcaaagtaaattcccaaaagtgaaagtgttgggtcggaataaacatgtatttagtttttcagctatttcagtggcgtgctaaagctgactcatactggctttcaaaattcaattgttacactcttaggaattttgcaagctggttgttatacataaccattagtaagaattaaatcacataaacttacaatttaaaaatttatatttctaattaaggtaatgccaaaaagcagaaagaatgaataatacttagtaattgatagcataagggggtcattatagtcaaaataatttaactgtatattttaaaataactaaaagagtattattgtattgtttaagacaaaggataaatgcttgagtggatggatacctcattttctatgatgtaattgttacacattgcatgcctgtatcaaaatatctcatgtacctcataaatatatacacccaccatgtaccccacaaaaattaaaaataaaaaaatacccaaaatttttgaaaaaatgggaagaatcacgctactgaactttaagacttactctacagcaatagttatcaagacggtgttgtattggcaaagggatacatagatcaattaacggagtcaaaagtctggaaatagactatataattatggctagctgatttttgataaaagtgcaaaggcaattctatgtagaaaggataatatttttcacatatggccttgggacagttggacatccatatgcaaaaaacaacaacaataaaaaatgaaccttgacctaaacctcataccttatacagtagttaattcaaaatggatcatagacctaaatataaaaacaaaaacataaaagtgtcaaaattttagaagaaacataggagaaaatattcatgacctgggaataggcaaagagttcttaaacatgccatcagaagcacaatctataaaaggaaaaatagacaagttgacgtcatcaaaattcatgtttgctctgcaaaagacactgttaagagaataaaaggacaggctataaactgtatgaaaatattcacaaatcacatcccacaaaggactttatccagaaagacttctcagaattcaacaataagaaaacgacataaagaaggcataaagaagagttcaatatgttcactataattagccatcagggaaatgcacattaaagtgatcgcgagacccacgactcacctagtagaatggcaagactgaaaaagaaaactgacaatactgagtgctagtgagaatgcagcaggactagaaccctcatttattgcagatggacatgcaaaatgttacagccattctggaaaaaagtttggcagattctcttaaagttaaacatacacttgtcataggactctaccatcccactgtgaggtatttactgtagagaaataaaaccttaggttcacacataaacacacatgaatgttcatagcagctctattcataatctccgaaaactggaaatgtccttcaacaggtgaatggataaataaaccatggtacatccatactacttggcaacgaaaaggagcaaaatatagaaacaagcaacaacctgcattcatcttataggcactagactgagtgaaagaagccagtctcaaaaagttatgtacttccatttccacggcattctcaaaaatataaattgatggtgataaaaagcagacaagccactgccagaggttaggagtgaggggagggtgtgactacaaagcagtagcatgaaggaatgtttttaaggtgatagaactcttcttatcctgattgtggtggtggttatgctaatttttatgtgttaaaattcatacaactttacaccaaaaaaggcagcttactgtattttaattcagtaaattaaaaaatttacagtaaattaaaaattcacttaatttaaaaacaaaattaaaaaatacaaaaccctaaaaagatcagtgtagaatagtaatagctaccaatatatagttctttttttacaaatatatagttctgataagaacttaatatgtgaggtttttaaataaaaatatttcccttattataaaaacatgttcattataaaaaattaaaccagtttcccagagataaccactgctgttatcttggtgaatataacttcagacctctatcttgccttgttttcagaaagaatggcattctgtacttataatctgggaatctgctttttcatgttacaatatgtcattaaatagtcttcttaaaataataaaagttacaaaattaaggtaagaaataaaatcattacttcttaattctttttatctacatttttctattatctgttttcttgaagttattaatgttaattgattttatatggtaaaaaaaaaaaaaaaggaaaaaacctatacaatagtgtgctaatgtgcatctcttcccaaaatgtgttcagtgacttcaccttcgtagcttgaaattggccatggtggtactatttcacaaagaaaatcagtaaatgccacacatcaggactttttgggtgtggttttgattttttcttttctggagaaccagttgtcaaacatttaccagcacaacatagtacatttttaaattccccttgaaggaatcatattattttgcactcttaccagcaacacatgagagtttctatttcaccacagcctcagcaacagtgtattagcaaacttttaagtgttttcaaactgatgtatgaaaaatcatatttcagtgcagttttgatttgcatttatcttataagtaaagttgtacatcttttttaacatatgtaaggagtaactgcatatatttttaaactatctgttcatgtgtttcacctatttttctaacacagttttgatcttttattttccctgtattttgaagagtatagatctatatatattagggatattagcccttttatgatacacgttgcaaataacatttttgtttatcatgttgtgactttttgctttgcttatggtagattttttttgccatgtagaaatttttaggcagtcaaatgtatcaatcttttattgcatctaaagtttgaatcatagttagaaggtcttttcctttagagaatgaatatttttaacaagcctctctcatatgattttatttgggaacaatagatcaaacaaatgcagttaaacagacattaggtgcctattatttgtagaatgctctggtgaatacacagacaagagctggtgtatctatctttcatttccaggaacccataatttaatggggaacgttgacctatacatggcttttctgaaccttctgctaatcacagctgactggcttctgtttcaattaaggtctcaaaactaaaataggaatgaaacactacccagtaattctactatattcctctttaggctcaccttccgacttataaaaatgattattctatatgttttctttcctcatccaagtttttctacctttgcttatatctgattaccatacctcatcaaataagcagtgtatgtttagaagtatgaacattcaatcaatactgcttgagtgtgaattccagctcaactacctaccagcagtaggacctttagcaaatttctcaacctttatgtgtttcagtttcttaatttgtaaaatggagataatagcatttacctgatagttttgagtaaattttgtgtatgtgtatgtgtaatgggtgacaaataataagtagttttaagtgttttctatcatcatcatcattgtcatctagaaactcctctatctccctgtcctcaaatctacaatcctatctttatctgcatacatattcttcccctttcttacagtttccaaaggagggtatatccatctccccttttattaaaggaaaacccttcatctactcacaatttgcatcctctttctcctcttcaaaaattgtgcctcttcagttagcttctcccttttctgcaatgctaattttcccttcttttttttttttttttttttttgagacggagtctggctctgtcgcccaggctggagtgcagtggcgcaatctcggctcactgcaagctccgcctcctgggttcacgccattctcctgcctcagtctcccgagtagctgggactacgggcacccgccaccacgcccggctaattttttgtatttttagtagagacagggtttcaccgtgttaaccaggatgatctcgatctcctgacctcgtgatctgcccacctcggcctcccaaagtgctgggattacaggcatgagccactgcgcccggccaattttcccttgtttattggatcattcccatcaacattaacctgccttagtattttccagtcacccattttataaaaagaaaaaaaaaacctttctgttacttttctaatacattttacagaaagacacaaactttctacaaccacatctactgcaatgatcactccacttctctgctgaaaagaaaatttgaaaggcaagttcattttaagatatattcacattaccttctttcctttgtgagcttccatttacccttcaaacctcttcaggctgatttcattttcctgaacttaactgaaaatattgcagataaagttaacaacaacttccatgatgggaagtcctagccagagtaatcaggcaagagaaagaaatactaggcgccgaaataggaaaagaagaagtgaaactctctctcttcactgacaatataattttattcccagaaaaccctaaagactccaccaaaagacttctggaactgataaacagcttcagtaaactttcagaatacaaaatcaatgtacaaaaatcagtagcattactacacaccaataatgttgaagttgagagccaaatcaagaactcaatcccatttacaatatccataaaaagaataaaatacctaggaatacagataaccaaggaggtgaaagatctctataagaactacagaacactgctgaaaaaaaatcagagatgacacaaacaaatggaaaaatattccatgctcatggactggaagaatcattatcattaaaacagccatactccccagagcaaagtacagatgcagtgctattcctatcaaactaccaatgttatttttcacagaaaaatgttccaaaattcatatggaaccaaaaaagagcccaaacatccaaagcaatcctaaacaaaaagaacaaaccctgaggcgtcacattacctgacttcaaactatactgtatggctacagtaacaaaaataggatggtataggtacaaaaacagacccatagaccaatgcaacagaatagagaacccagaaaatcatactgacagcatctgatattcgacaaagtagacaaaaataagcaatggggaaaggacctcttattcaataaatggcgctgggatagctggctagccacatacagaagaatgaaactggataccttccttacaccatatacaaaaattaactcaagatggattaaagatttaaatttaagaccttaaacagtaagaatcgtagaagaaaacctaggaaataccattctggacataggtcctggcaaagattttatgacaaaggttccaaaagcaattgcaacaaaaccaaaaattgacaagtggtatctaattaaactaaagagctctgcacagcaaaagaaactattaacagtaaacagaaaatctacacaatgggagaaaatatttgcaaactatacctctgaaaaagttctaatatccagaatgtgtgatgaacttaaacaattgtacaagcaaaaaacaaaaaatcccattaaaaagtggacaaaagacatgaacagacacttctcaaaagaagacacacaagcagtcaacaaacatgaaaacatgctcagcatcactaatcattagagaaatgcaaatcaaaaccacaataccactgtgagataccatctcacactagtcagaatggctattattatagtcattctgccagccaaaaaacaacagatgctggcaaggccacagagaaaagggaatgcttatatactgttagttggaatgtaaattaatttagccactgtggaaagcaattttgaatttctcaataaacttaaaacagaactaccatttgacccagcaatcctgttatcaggtatatattcaaaagaaaataaatcattctaccaaaaagacacatgcactcataggtaatcacagcattatttacaatagcaatgacatggaatccacctaggtgcctatcaacagtggatcgaataaataaaatgtggcatatatacgccatggaatagtatgcagccataaagaatgaaatcatgtcatttgcagcaacattgatgcagctggaggccattatcctaagtgaaagcaggagcagaaaaccaattactgcatgttctcacaagtgggagctgaatattgggtactcgtggacataaagatggcaagaatagacactggggactactagagggaagagggagattctctctctaagcaatctcatgtagtcccatgactttgattatcattttattccattgattccaaaatatttttctccacctcattctgctccgttgaatttctgactcatatctaactgcccactaacatcttcattttgtgtataaataggtatctcaaaataaaaattaaactccttacctttgcttttccaaatctacctcctacatgagtagtctgcttcttggaatatatatatatatatataatataaatatattagttatataatatatacatatattatatatgatatataatacatacatatattatatatgatatataatacatacatatattatatatgatatataatacatacatatattatatatgatatataatatatacatatattatatatgatatataaatatagattatatgttagattatatatatatatataaaatcagccctcttttcttcatatatattgccatttgcttagtcaggtcaccatcatctcttgcttgaactagggcaatagcttcctacctggtcttgattcaacattcctatacctagtttacccaaagagcaatagaaatggttgtttaaaaatgtaaatcaaatcatattactctgctgcttaaaagtcttaagtggatttctactgaacttggagaaaaagctgaagtatttaccatgtcccacaaagcgtaagtggatgaacagaggagcgagaagttaattatggctggaggagagtcaggaacatttgatggaagagatggcacttgaggtggacttttaagggtaggttagatttgtatatttggagataaggagagtaagtggaaaagtacagatagattatccttgaagaaaaggagagtaagtggaaaagtacagattgtctttgaagaaaagaatgtgatccagtgcagtttggagaatgaggcatatgacatgcttagggaaaggtaaatctggacaaagtagttggggcagattgtagagagcattgaatactgagctgtgtcctagcctgagaagaggagggatgtaagagattatcaaatcctcctttctgcttcctcctgaaatttctcttgggtctgcccctactttgcattccccacttcctcttccctggttctagcccaagttacctcttgcctggacgattaaacaacctcctaattagtcttttctttcccttcccttctctcaacctttttctacaccagcttaatctttctaaagcacagctctgatcacaccatatccttctccaaaaaccttcagtcattctgttacccacaggatgaaatccaaactttatagtagggtagttcaagccactatcattcccaccacccccacaccaggaaatttaacctgcgtttgctgtctttgtatcctttagctccctcttgatgagtcatacctccctgcacactctttcctctgcacatccactgattcttctttctctttgccgttgtacattcagttgcctcctcttgtactactttcacccagcttcatatctctccaactggacatgtctcaatgctgcacagttccaccatcttctctaccaagcttcaatgcttttccacctgctcaagttgttagtaatttctctcctctgaatttccgtaatattgtatctgtacttctcttgtggagagcattgtaagagagcattgtattagccactgaggatagaaaggtgaataacacacagctttatactattttatatatgatgctacatttaaagatcaataatgtagggctgtgtggcacaatcaataactgtagactgtgtgacacagcctgttgtagtcagccagactagttatctctcttcaaagaacgtagaataaacccccctcttggcttctatggaaaacagactatacaaattgctttcaatgtttagttttaagaagctagactatataccatctctataccaccaataacactgtgaaaatctctttgcagttttttgtcctttcttcccctttcccagaggtgtagtggaagagaaagggtgggatcactaacatttgtttaacatttcctatttgtcatttaatcctcacaacaatcctataaaatagattctcttttttttttattttttatattttttatttatttatttatttatttatttatttatttatttaatttattattttttttttttgagacggagtctcgctctgtcgcccaggctggagtgcagtggcgggatctcggctcactgcaagctccgcctcccgggttcacgccataaaatagattctcttatatgcctcttttataaatgaggtaactgaagcatagagtgagtagagaactcaggatttaaattcaatctaggaattggagaagttgagattaaaatgcatgcaatctggctccatagtatcctctatttaactactatactacactacataactaccactgtttaatgaaataagtatattagttcactggggagagaaacatcttcagacttctgagaagaatttgtaacactgctctctctgtaagtaaatactgcccttttatagaaccatggcacagtagctccttttgtatatatgtttccaaggaagtggcctggcatcttatctcatgtaaaacctgtgaaaactcacctataaagttcaatcagtcaattaactactaaatcttgagtacatactgtatggcccagccctgtaagaaaccagagaaaataaatatggtcatttaaaaatatctacaactcaaaagcagtgcatcaaataggttgaaaaagtatttaaatgattcctatggagttggagaataaatctgaatatgaatgctgcttgtttttccctatacctcacacagtggcttcctcatccattcatagaacattggagtggtgaaatgcactgaatgtgagatacaatgaggtcctttacaagttcttttctagatggcattggttttcacataacctggagggctggctgaggctgtgaacttttctgcataatcagcctgagacatctgaagccaagaaagaccacagcagtgacagaacacctactgtgagttaagcaaagaatgggagattaacttttacacatgtctatagttcattttgagtgaatttttgtgcttcttgtggtaccttaatcaaaaattcactaaacataaatgtaaaggtttatttctggactctcatttctgttccattaaatctatgttttttcttgtgataatgccacactagggctttatagtaagttttgaaatcagaaagtgtgagtcctccaaaagtattctttttcaagattgttttggctattctgggtctctttcatttccgtataaattttagaatagacatgtcaatttctattaaaaagctcactgggattttgataaaggttgcgttgactttttaaatcattttggggaaaattgccattttgaaaatgttgagtcttctaattcatgagcatggagtgtgtttccatttgtatatattttctttaatttctctcaacaacattttgtagttttctaagtcatgtactacttttgatagatttatacctgagtattttattcttttgataatattatgaatggaattgttttcttaattttaattttggcttattcattgctattatttagatatacatttttctgtatattaatttttgcatcttacaacttaaaatgtatttattagttatagatatttttgtagattccatatctctttttagatttgtttatttgcagatgaaagacaaatttacctcttccttttcaatctgaatgtcttaagttttttccttctttctttcttttgattcttctctttttttttctttcttcttattgccttagctaggatctcttgtacagtgttcaatagaagtggcgaaagcagacaactttgcactgttctgtatctcagagtcagtatggttactggctgcatggtgtaccttttcagatccttttatattcaatctatttatgtctttgcatctaaggtgtcactcttgtaaacagcagatcattctatcttgcttttaaaaaacctaatatgataatatctgccttttaatttgggaatttagctaattcatgtttaagataatttctgatttggttggattaacatttcttattttactgtttttttatatgtctccttcctctttctttctttcttttttgattgttgtttctgtttcccttcactgcattcttttcagttaaatattttttgtgtgtgcaccaatttaattcccctgtagatatttagctaatttttagttattttcttaatggttgctctagggattacaatatgaatcttaattaacgagaacctccttcagattaatactaacataatttcagaaaaatatagcaatttagcaacagtaagttctccctcttttttgtattgttgctgtcatatatattgtatctatatatgaccaacctagaaatgctgtgttgtaattattgcttcatgtaatcttaatctttaaaaaaagtatagagtgttttattattaacctacgtatttaccttttccgttgctctacatttcttcccgtagttctggatctggtgtcatttcctttcagcattgaaggtcttcctttagtatttcttagaaggtagatttgctaacagcaaattctctcagtctttattaatctgggaacatccttatttagccttcatttttgaaggatagtttcactggatatagaattctgttttggtagttttgtaatgaaatgcaggtccagatgcttaccacttgcagagtgcaattaacaagagcaacatctggtagaaagaaagtgactattaaccaaaactagtaaacgggaagtagccagattcttatccaaattaatcactttgattttttgtgggagaggcaggggttttaaaaggaaaactttttaaggaagccatgcgagaattgggctgagtgcaatgtctatgtgtcttcttctgttggctaatttttttcttttatcgctttgaatatgtaattctagccttcattgtttattatgaagtcagccttaattatattgatgctcacctatatgttatgagtttttttctttctcttgttgcttttaagattttctctttgtattttgttttcagtgattggcttatgatatatctagatgtggattcctttttcttcaaagtgcaggctgtgcagactttactttcttctgggccctttcacatcttatcaaaatctgcttctgagaagtatgttaccatgtgtgcagcctcagggtttgccagaagtgtgtagctagcttgggcctccattccagagttatgtttatcccaaccatgactgcagcctctagttagtaaagctgttagattttcttactcaccttgtgtccaagatgatcacttccactgacaacacggttgggcatgggtgttgccagtgctcacttttccaaatcaggtgagccccctttgatagtggcagaacagcttccagttctcacggccttccacaccctaataaaatttatgccttggctgagatggggttgggggcgcagtgggaaagaataagaatggaagaagcaataccacagattcctactgcttttcatgtggtatttgttgaatgtaaagataatgatctaattaacatagtagtttacatttattccttcattcgggtaatttcttcagaacctaatatgtaccatctttcgatctaatatcccaagtaacattattcatacatcctcgagaattccatatttatttaggaaaacagacatgcaaataaacacaaacaatacaatgagatcattaaaatggagagaaggaggaaggaaaataagaaaggtatcactaggggttcctgctgtttaaagaaatcctatggtgatggtgatttttttaaagaaaataataatcaccacctattaatatatctatgggacaagtacagaattgggtgggcataatgggagggaggaatctggatgaattgtagtatatctaggaggatctgctgaaaactacaggtttgttgcctgacctttgaaggaggaaagactttagttatggcaaaaagaggagaaacatgccccatgagtaatggaattcatctttatcagatgcctagttatcgctagttacaaactacgtttgctatatattcataagattttcaaattatttgaagtctaacacccaatataatgagcaggattatactctcaccacttctattttctgaaatatattagttgattattgtcagtgaagttgaacgtatggtcctaaaatggctttaaatgattttatacattttctcttttattattatccatctgatactttgaaagaggcagcatacggcagttaattttctcctccagtccctcgtgcacaataataaaacaattcaaagcagtgcatatttcagctgccttttatagatgaattatacctcctgcagtctgtacatgaagacatagaacaggccatgaggcagattttagcataaatgttattttgcttgctaggaaggatttagagaatgtatttaaaataatgtgagctttaagtacaaatcaaatgctgaaatgcatctttaattcggaaatgtatagtaaatccaaacaaatgggtgaataacctctatcgtacatttttaatacaaagggacttgttagccatttcaaatgtcatttgagtgtttgaaaaagatgtgaattacaatcatagattctgaagattaaaagagccatttaagatcacctagtaaacccctttacttgttactagaagacccactacagcatcccctaattcagctgttactatctaaccaactttccaaaaatatagggcttaaaacatccagcacagttttgctcatgattctgtgggtcaccaatttgggccaagcttagctaggcagttcttctggattcacctgggctcactcatgtgactgcagtgatttggtggctctaccatcgagtaattgtctaatctgggctcattcatatgtcctgtggctagtactgactgttggctgcatcccttcccaagtggttctcattctcaaagaggttatttcaaacttcagatggtgggactgtgtttcaagagagggcaagtttcaatgtgcacatactttgtaagtctctacttgtcatgtttgttaatatctctttgcaaaacaaatcgcatgaccaagcctagcttcaagatggagaaacagattctatctcttgatgagagaagtggaaaagtcacaatgcatgcaaggatagggaaaatttgtggctattaagtaatctgtcacattctgttattgtggctatccatcttttgtttgaacatctctgatgaaaagaagtttagtgccttctaaattagcctattttatcagagttcaactctggcttctggtaacttgcattcattggtgacagtttttcatccaagcacacagctgtctacctggctagccagcaaacaagcacctactatgttaagcaccaaatagcatagaaaaacatagtgaataaaacagatgtgatccttgctgtcatgaaattcataatttactgtagggagacagacaataaataagaaaacaaacaaatacattttgaatatatatatattgaaattatatatatatgccttgaaggagtcaagggaaccatgaacacttataccaggaacatccaaactagtctggaggaggtaggtcagggaatgcttacttgaagaagtggcataaagattagacaggtgaagagtgaggaaaagaacatttcaggcagagtaaacagcatagacaaaagccttgaggtggaaagaactttatttgttccaagccagtatagctggagcaaagtgaacaaagtggaaggcattataaaatagtgttggagaaataggcagcaaaaagattgtgtaaggccttctggagttttgtcattttatttcttgaagtcatagagagcaaatccaaatccctctttgatgtgatagcagtataggatgtagctaagactgtaggctctggaatcagagcacctggataagtatccacactctaccacttactgtttgatctcggtcctgcttcttcataggtaaagtggggataataattgctacttcataggttgctatgtgagttatatagaataacatatgtaaatggattaacacggtcttagacacatagtaaatggcaaataaatggtagctattagcattatcaatcttttttacgtctcttcaccttattgtatcattcttttccaaatatattctaaacatatgggttttaactgagcgtcctcttttgatgatccagaatgattcaaatatgttgttaggaagatcatccataaattcaacttgagtttttcatgccgttatgtaaaataaactcaatgccttagatttggtcctttctgtgtatggtaaacacgcagttagtgtgctgtcttccaaatcccagtatgaagtatcatattatttatttcctgatgtgcacagatgaggtgtgtgtatgtgtatatgtgtttatcactaattgaatcatagtccccaagttaatagcaatgactggaatatttttatctgtcatatggcagttattctttcagcaacaaagattaattctttaaatgacccaatttgttatgaaatttgttatatgtcattattcttaaatcaacaagttgttaggaattatagaaaccttaaccttcatctaatttttccccctcatttccctgttgctgtgggcagagagatgtgctgcccagaaacctcttaaaggtagaacttgttggaccgtatatggaatgttgtgagcagacagcctcctgttgtcacctcccttcacggtttgtcttggctacagagaactgttgtacccatgggcttatccttcctatccaatgactaagtgtaatggtggtatagaggcccatccatctgagtccaatatgaaatgtgctgatgagccatatatactctagaactccatatgtggtttatctgcatggtagtttttctcaacttgttcactcctgctccctcccactacctttcataggtataaacatcctaaaaacccaggatgccaaatttcttcacagtatctactccacagaacctaacctgcaacatttcttaactcccgaagcccagaattactcagagacctgaacctagaatccgtctctaattctaaatcttaggctgcagtcattccggccaacttctttattaaatctttcttcataggttcagttttccatttcttcaattatttttattgcttttctagatgcttccctaaaatgtgggattctcttagtttccaaagtttgtgaaacttgccaggctttatactgagatatatttatatgttaggagtgattactgggtgtgggaatggcactgctttacaaagcaaaggctttttcactgcaccttctttccaggagataggacccgagaactctgaaattgccattaataaagagggagaggcaggtgaataggcagtagtcaggaagatgagcagataattccctggggtctgccttcctgagtgtcctccaccacaattagcttagccgttataaattccctcatgtcttatgttctgtattgtcacctggatcttcttcagtgtaatcttttctcagtgccacttattaaaaatgctgactttcaaagagctcaataaatttttttaaacatcccctgactcaataaaaagggatggaattgaacactaagtctatattccactgtctatctcccaagagtgttgagataaactatgaaataaatctttctgtcccatccaggtcatttcactagctttaatattatttacagccctatccatacaatccctgtcccttaccctgaagtcatcagtgtgttctctttctttttgttgcaaactcacagagtctttcaaactgaaaatagctgatgcctctagtactgataatgaaagaaatactcctctggttgcttgtaggtcgtttcccaaaatggaatgtaatttcaatgagcagaaaagagattttttaaatgcagatatggtcacagggcatactaaattgtcaaagattctaagagttagtatttaccatgggacaaaatgtctgggaggatataccacaaagagtggttgtctctataatgggattacagataatttttatttggcatcaccatattctatatattaaacatatcaattttgtgataaattttatactaaaagaagtaacatatgcattctagaaaaccctcatactacatttccatacatacataaatacatacatacatacatatgtgactaacatgattcagtatacttttcacattccgaaaccagagtgaagccagatgaaattaagtggcatgctgtccaggtttttacagtgaatagtggtagaacaggtctataataatttttctcctgatacccagcctaatgttctttctacaactctaaggtagttttaaagggcagcggagaaattgcctgaaggaagatttttactcaaaatttcaggatcccattatgtcttgaacatacttaccattaaaagtatcactgatgctaatggaatggaagagaatccatgcactttaccaaaaaaaaaaaaaacaacaacaacaaaaaaaacacattagtacccagtcttcacatacgcctcattcctttataatgaaggtaaatgaggcctttaactttaagaacctcagatgttccattcttgataagaacgattttattaaacttatgatgttatttttctttcacctgtggacatttcagtagaacaacttcccacccctagctgcctccatgtctctcaaagcagcagcctgaaaaaatctattcaggagctaatataaatttttattaaatgtacttaaaaatattgataaggcatataaagcagaatgttcagtgaatgttaaataagcaagaatttagtcctataaagtatataaagctgctgggctgcaaataaaaatgaccacaatgcagcaagaaagtgataaacattataagttatcttccccctaattatccaggttacatttcattaatatgcaatgaaaaatgttaactctcctgggctaaagcatagggaaatagtaaattagaagatttccctttggatgccaggagcggtggctcacgcctgtaatcccagcactttgggaggccgaggcgggcggatcacaaggtcaggagatcgagaccatcctggctaacacggtgaaaccccgtctctactaaaaatacaaaaaaattagctgggcgtggtggcgggcgcctgcagtcccagctactcgcgaggctgaggcaggagaatggcatgaacctgggaggcggagcttgtagtgagccgagatcgcgccactgcactccagcctgggcgacagagccagactccatttcaaaaaaaaaaaaaaaagatttccctttggagacaagattttgattccctatacttaactctcttgtaatatttatcattctgaatggcaaaaatcagcttatgtgtattttccttcattgtaccatgaaaagatgaaagatagtagattctagtttctctctaatttaatgcttaacaaactgcctggctcatagtaggcatttaataaatatatgttaagtcgtattcttaaacgtataacaagcatttcttggtaactaaccacacttgcattttccccaccaaaattataccttgtggcagagagagtctaattacacatcaaactctgttccctttttgcgttcgcaaatctagaatacacataactagaatgcactcttgagtctcccttaaacttaggtgtggccatatgactaatttttggccagtggaatgtgagtggaaatgatgtaagctacttccaggcatgacacataaaaacctcccacctaatcctgtcctctctgtcttcctccatctgctggctatatgctgaatcccagagtattcttggaacccatatgctgaaggtggcacagcctgggtctctgaataagtgcgaaatgcatttctattgtgttaagccgttgagatttcatgttttaacagctaccacagatacagttactttaacagatacgtgtctataatacttaatatcaacatattattgcacttgttcaataacaaaaaaaatttcaattacagttcacacaatttatttggaacatcatttaatttaaaagtcattttaagtttaaattgtgttaagtattctttatactctaataagttttattttccaatatcatattatcataatgctttgatatatgccaaattgttttctgaaaagttaacagtaagaaaaaaattgtaagaagaagttttaactagaatttcctagtagattttcctagactgtctgtggcagagcttagtgaataagtgatctttagctattgtgtgaaaaggaactctcactcaatctagagtctccttagagagggaataaaccatagtggggtggttgtaaagatagaaaaaatagataatcatagaaaaacatggcccaaaggattatgagtgactgcatgtttcaggagtttctttgtgattagttggcagcggctttgaagcagagagccatctatattaggccccagaaaccacctgaaggagggcatgttgggatctgcagtaagcaatcaagaggaaactcactaggacaactaacactgggaaaaggagaaagtagctaaaaggaattttaactctacaagtacaaatgactgacttagagtgggctgagctaatgcccagtgcttttttaaagttatgtattttcttcctggtatataaaagaaagtccaattaatcaaggtgattagtaatcactgtgtgtttaaatagcaaacgtagacaacatttgtctctaggtatatatatttattttaaaattaccttacatgatatctttacttaaattaagagttcagttaattaatatttatgctattatcttaataatttatttttataaaacaaaacgtttcatgtacagtatagagaaattcatttttttattgctctcttagtcttgaatacttgtagcagccccaaccagatggtttatattccataacccaaggtaccactgattacttgggggcaagatttggaaattttaggcttagtgcctaagggcaaataagcttatttttcctcaataggactgaccttacaaatctaactctgtaattgtacaggtcctttcccaattttgaaaagcattatcttcaacattgagccacccaaccaggacccctagcctaagataccacagtcattctgagtccagtcttaatagttgatacaacatgtctggtgttatgtcttacctctcctctttgtaacacattacttggagctgccccacactccagggcctattcatatttctgtaatctgtgccccactccatagggccctgccctacatcagatggcctatttctaaggaatcctgaaactcctccacaggacagtttgtactatataatgtgttctctcctcaagagtatttacattttaaccaaggattctagaaatacaatgcccctgcaggcaaggaaacttatttatccctctggctactataaaatttttctttttgctttttgcttataattttgattacaataatttttaatttatataattttgcttataattttgattataatatatcttggtgtggtattctttgtggttattctacatgggattcactgactctcaaatttgtgtttgatgcttttaatcaaatttggaaaactttaagccaatatgtcttcacataatttttcagtgttcccaccctccacatttttggagcttcaatgacatgtatattaagctgctggatattgttccacgggtcgctgataatctgtttaatttttttcagcttttttttcctcaatatctttcagttgtgatagtctgtattactcaatcttaaagttcattgttctcttcttctgccatattgaaatttatattgaccatccagtgaatttttaatcttttaaggtctagatatatttaatttttatatcttctatttatgtatctgttatgttcatattttcccttaaatccttgaacatagttataatagctgtttggaagttcttacatgataattctgtcatctctatcagatttctacatctgtttctattgactgattttttttcctaggtaagcatgacatttattactaagcatagacccttctacattctctactcattgccctgggcattcaaggaggcctctccactctggatgatcataactcaaacattttcaagccttgtgtaaagctttggggattgctcagtttacagctctctggtagttgtttttttttttttttttcttgccttgtagatttttaccctatgcaagtgcagtttaatattaagacaaagattaaggagtttcccaggcagatttatttctatttctctgagtaacttcgttttctccaccactctgctttgcatatctcaggtacctcagcctccccaaactttaatctctgtctcttcaagtcagcaaggcgaacatgctctatttgggttctcctgcactgctctgaagttcaaaaatgactccaggtggaaagctaaggtaactatcagggttgccttgcttatttcccttctttcagggatcaaagtcctgtgttgtctattgttcagtttgaaaaccattatttcatatctttcatccacttccctagttggttatggtgagagtccagtaccagttactctttcgtggctgtaagtggaagttctaagaagtccttctgaaaggtctcagtcattcctcagagttggcttccccctatgtcttaggataaaaatctagtttcttagcagtctcattttgatcaaagagaattccagacaataattgttccttgttagttgaaatccagataaactccaagtgtcttgcaatgtctttttgtacacaccaacccacatcattctatgaggttacctcagagctttagttttggagaaaagcttttgagattacagcttcaaatgagaggtatgttaggttgtcatcactgggcaactaaacatttgtgagttgtccttttgtctgaaagattattgggagtttcagacagagaacaagacctttttctccccttttaaagagcatgcctcagccctttgtgaacttgaaatgcaggtcttattttattcatctctcatttgcatgttgtgcctttagttgtcagtgatcagtaaaatcatttggacttcagaagcctttgaaaaagtgattaaacaggccaagattatgttagtcatttagtttatccttctttaatccagaggcattatttactgtccactctcaccctaatttaggattgtgccttacatgaaagagctaatgaaataaatgactatcactgtcaaattttgctgtgtcatagggggacagtacgagaagctttgtatacctcctattcccttggcctttctaaaattattttgtaaggcttttgatgcatacttgcaaagttttattttagtaattttattaaatgacttatttacccacaactacttggtagtaccaccatttaatgttattttcccacagggaaactgagatccaagaaataagacatttattcagagtcatccatcaaccacaaaatggaattagaacacaaaactccatcttttgagcctttaagccaaactgcttttttctcctgagattcttcatgaaaataacacagcctatactcaacaccatcataccatccccaacaccatcataccactgtcaataccatcataccatgtaagttgaatataaattactacattgccttagactcccttattacactggttaaatagtagtctctattgataaacactgtggcatacaaaaataattttaagtattaataataatctcaactgtggtttaaaattgaggacacatatgtgactggcttagtaatcagcattttctaggaaaggttctgtttttagttttaatttgctcaccacattttattaatgtttagtggaagatttaccctgttcttttatagatatcaaaaatatgtttgaaataatttagtcagtaactgaatattatagaaacaaatacaaaaaataaactaatataaggaaacatgagacagcaaaaatccttatttactagtaaatcattccttactttagaaaatctggaaaatacacaacatagtggtctgcttcatatggcttttctgctatattgctacaaagcatagggctataaatttccttttgatctctcatatggaaataagtttgtctattgtctggttgtttgaagtcgaaagtcttttcataacattttagaaaagcgaattatatcatactgtgcactatgggttagagaagattcagagagccatcctgcagatgttataactttggatccctctgttcacaatccccctctttctctgcatttctattagtggtgagatgtcatatttctcgaaagattagagaccattgccccaaagtctattaaatgaaataaagagagacacaggaataacacaatgtaatcctagccagtaactttttgtgtgtgtgtggagaatctaaaagaagtaatggtctttgacacaaatattacattctgccacaccctgaaagaaatacctcgaatctacatatttccaaataaaaacaaatgatagtagttttagagggaatgaaagcaagttcttgatacttatgtctccattaattcaaaaattatgtcttgtgagtaccatttaatttgggcaacaaattatactgttccttttcagtcttcatgcaattcactttccttgaaatagaaggggaccaatacaaaaaaatctcccttccttattccatcctggagcacaactccaaacattaacagtaattgcctctacttccatgtcattgaagcttatttaaattgtagctcgatgctgagtaagagggagagtcgccctccccaatccagagacaaaaaattctaattggcaattcatataattttgaatagttcatgacagtagaaaaaaaatgtgttatgttttcataggaaattgctgtgcattctagaaaactgttgacttgctaaaaatctgcactcctttattttgtcatttgtctcagaagttaagaatgaagcacgcataacaccttctttgggatgctttatattttatttaatacatatacttagtaaagggatttgctccttcaaaccggttaaaaaaaaaggcatttgctcattcaaactggtaattctgaatatttaagaactcatagcccaagtatacttgggtatattgaaagacagtatagtgtggtggtaaaatgtggattctggggtcaaactggctagattcaaggcacagttctttctatcacttgttggtcctgtgatcttaggcaagtaatgtgactttttgtgtctcaaaatcttttcgtgtctcaaaatcttttcgtgtaaaatggagataatagtagtacatatctttcagggttgttgtaacaagtaaacacattcaaagtccttagcatgagtggcacataagcgctactcagatgtaagcaatatactagaagtgccccacagcagaaggcacatatctcacaatcttcttttcctactatcttcattcccaaatgttgtttatgtgaagcaacttcttgattgtccagaagggaaggacttcctttagtccactctcatcttttagccccttttgttctttaaggcaaggaccaacttggttaaataattatttttctattctgaattctgtgaccatgtagacactcaataaatatttatctatctgaataaaaaggacaagctcaatttggtttcatgattttccagaaagtgacccaacttttgactcaaactttgtgtactttctaaaatctaaattaaaattttccttgcaaatcaagtaggaagtagttagcagtatctttcagaaattttctaatcatggtcttctatatactgaacacattttacatgtgtaatgagatttgtgtattagtgacatctgctactgcttaatcagctcctaagaataataacaaataatcacacaaaatagatttgggaagtttgtgttttaattaaatctgtttacctcaagttttgttacatttttcattcccttggcatagattccactctatgtcttggtacagttttaatccctgcccagagcagaaatttatctttaatttacattgcctcctctaagcctagggccattgactcagaaagtcttctaatttttattcgtaaaccaacttatttttatcatgttactgagacttttgggtttctagagttcagaaggaaactatttcccaggattatggccagttaattcagatggttggaacatattaatgaggccaatgctgcaggtgtgattctttatgtttttccactaggatagccacaaatgtatacttttgaccaaaagggagattcattgagagtttgtggatttttaatcagaaagccatctctattgctaaacaaacaaaaacatacaataaaataaacccactcatatacatatctgacaagttctgaatcaggagacttaacctttgttatacagtatgaatacctcagacttcctcaggctgtggttacaaataaggtcacattagctgtaaaaatgccaatatcactgtcttcttatttctactcatgttatttccactcacatatttcaagatcattttactctcttcccccaaagtgtcacccagttatataggggaatctctggaggtaccccacatgtgctcacaaacagtattcttatattcatctactttgggcctttgctgatgtcagtccacaagaagacacttgaaactatcacttggctgctgtcactgctgccatgccattttgggggactataatttcttgcttggggtaatcttttattgtactcttcaaagtaacataccttgtaaggagccaaaacaacacgatctttttaggtttcactgtgtcagtgccactctgggtaaaaatggggaggatgccattctgccccctatttatagcattttgtcacctgggcactgaagcagcattgcttgtgtcattgtctttctctattgctcttgtaaaaatagcttctttggcttctgccttcaactttgctctccatagggcttagatcccaatctttgagactgggtggagcaccagacaccgtcttgacctctccatctccctttattgcctcaggaacctttgaaaaaattagacaaaaacctctctcttccttcagccatcatgcaaactaactctaccaatgcaccatagccatcccaacttgcctgaactctagcagtggacataacaaggtgcaagctgagatctttactacacctttaaagaaggtaacctcctcaagggtctgtgtgaagactctgttgttctgagctaggccaacttagaagctcaaataagatatattctatggcaagatttcaagggaacagagagaatactaatgcctacttgtgggcgacatcttgcacccctctctttctttaactgttggctagatgcctggactttactcccaaagatatctcttttcatgtagggtttttatttatttatttatttttgtttagagggagtttcactcttgtcacccaggctgtagtgcagtggcgcaatcttggctcactggaacctctgccacccgggttcaagtgattctcctgactcagactcctgagtagctgggattacaggtgcctgccaccacgcccggctaactttttgtatttctagtagagatggggtttcgccatgttgggcaggctgttcccaaactcctacctcaggtgatccgcccacctcagcctcctcccaaagtgctggaattacaggcatgagtccctgtgcctgcctcatgtaggcttttataaaatttgtaattgacacataataattatacatatttatggagtacggtgacatattgtttatcaacaaatgaatggataaaaacttatatatatataatacatatatattttatatgtacattttatgtatatttaaaaatatgtttatattatatatacactggaatattttatatacatatatgtatatactggaatactattcaaccataaaaagaacaaattcctgtcgttcacagcaatgtgggtgaacatggaggatattacgttatgaaagttagtgcatcataatttgcttgagacaaagaatccatcattcctaaaccaagtcagttttagacattagaaagagattctattctttagaaaaatgtcagtagcagaatgtcttacccataaaatgacccacaacctggactcctagaacagttttggggtattgcagtactctgagagatgggacacacttataccataagttcactgagatgtggatgctaaccattaataaagatgttgccaaaaaattaatgctgacagctcaccttcagaagctagtaagtttccccttcaccttgggagctaggtctaaagtaaagaagcacttgaagaaatctttaaaaaaaaattattagcacctgtctgctgttgaactggcagaaatcttatttgatctatattttctttgaaagcccagacctagacttggtaagtgggtaagaacaggtattacctaagcagccatacatgctgagggccatgtaggctctaaataagtcacagctggtagttatcaaatctaaatgaacgtgagattcccaccagcacagaggaatcaatatttatcaacagaaaaagtgatattcattactgccatttgaaggtcatgcatataaagcatatatgagtaatgccaaacctcagagctgtttcctctcacaattaggtagatacagtgcctatgcttcattttgccactgcacaatagcctggcttattccctgagcaaatgtctaatccctccttgtctcttgacctttgctacaatatatttcttaaaaataatatggctatgcagaaaaaaagcagggaagctttgtggacagtgcagggttttgcatagaaaagggaaatagatttcacaaataccaagtggacaatacccagctaggtacaaagtcaacagaggatctcaggattagagtagaaaacaagctgactgtgaggagtagcacttcagtgttcctgtgatttacaagtagatatgggcaatgaagatacctggaggcacttggcttgaacccttcttgcttcccattcccattatacatagaattgttctgactgtcactgacccgtgttatatatgccttgatgttgattactaaaatggaacaggcaagatttgagagccagagttattgtattaaggtaataaaccacttaacaaatattttatgacctgaaaagaaaatttaaaggaagtaaaattgtaaaaaataaaaaatgcacagaaaatgctgttgcagagcatggtgactttagttaatataatacattacaatataatacattgttatgaaatacattattgtattatatatttcaaaatagctaaaagaatggacttcaaatgttctcaccacagggaaatgataagtatgtgaggtgatagatatattaactagtctgatttgatcattccaaaatgtatacacataccaaaacatcacattgtaccccatatatacaattatttgtgaattgaaaataaacacacacacacacacacacacacacacacacacacatacacacaccacataatatggaatgtcttagggaacttaattacaggtctcatagccagaatgctaggtaagcaggagtttaggcacatacttaagagaagtagtcaagtactgcagtcactcagagggcttgccagaaggcttagcttggctttcagaatgctctgcctagacagaggatcaatagacagtagggaggctcccatactcaagtaataacttccctcaatctgaaagatctgaagttctcctcccactggaatactttacacatagttaattcatccagtcaattaatatatatttagtgcctactttgtttcagattctattctgggtgttggggattatagaaaataaaagttcttgctttcatggaagtactgttctagtggtagaggaagcaagacaaaaataaccaagtacagataaatacacattttgtcagacagtagtaatcgttaagaataaaaatgaagcagggtaaggtaaaagacagtaagggtgatgactactgcttttaaatagggtagtcgtgggagatctctctgagaaggtaacatttgatttttaacaatacacatttattgagcgcctatcatgtgccagccatgtgaattaattcattttatcttcaccaaaatcctgtgaggtaggatcattattatgtttgttttacaaatggggaaattgggcacaagagaagttaacttgtccaaggaaacataactagtaagggaaagagctagagtttgaactcaactagtctagcatcaaatcccatccttgtagtcactataatacttggcatttttgattctgcttacaggcagggagatatgcacattttctctttagtcctgtgaggcactaacagacctatgcaaaaagaagcaatcattgaagcagagttatggaggtacctaacagaaagcccttagaaagggggatgaaatgactaatattcaagtactttctatatgtagctatgttacacatagagtctcatttaattctcccaacaaaaatatgaggtagtcagacagatagttattttgcagatgagaaaactgaggtaacaaagtggttacatgaattgcccaaagtctcatgggaacaaaggaccaatattatgaatttgagttagtctgtcaccaaagtttatgctctttctaatatgctgtgctgtctccagggagaagaaaaagaaagacaaggaaatccagagcaaaatacatggagaaaaaaatgaaaggagagacctcaaagtaaagacttaataggttcagagggccagaggactgatagtggcttaaatggcataaagaactttcaatggcaccttcatcctcaatctattctctgacactaatagtcttagtcgatttgggctgctataacagaaataatgtaaactgaatagctaataaacaacagaaatttctttcttatagttctagaggctgggaagtccaagatcaaggcaccaacagattgtttgggtaggggttgttctctgcttcatagatggtgcattctcacttcatcctcacagggcagaagaggcaaacaagttctctcaggcctattttataaggacactaatcccattcataagggctccatatcctaaaggctcctcctcttaatactattatattgaagattaggtttcaacatgtgaatttgagggggtacataaacatttagaccatagcaccaagttaggtggattcttgagaatttctgtgattttgtgatttcaggaattggcatgtgtagtttttcagtgagacctggtgtttacatgtgaatagcccttgagtagtgcatcatcttcttataactgctactgtctttgaatcagctactacagtaaagcaaggaacataaacttcgtaaagacatgaaagaaaatttatgaaccatttagtatttgaaggctagcatgtagttgtttgataacaaggatttttccccctcagaagcatagtttaaagctgtcagccttaatgaaataactttagatatgccttgcctgccaatttttccctttttaatagtatagtagtaacactgtgggattgtcaaaataatagtctgatgagaagtgttagcaaagaaagccaaatggcgcattgcttgtcttacactgtagcctctgtgtggtgtagaaaagccaggatgtggtcagatcactgtgggatgaggttgactcacccattcattattctggatgagcagaaaatatgcctctcaccccatgcctgctctgccttgccttgcctttccttttcattcccttcctttttcttcccacacatggtcaaaggctttgattttttctgaatattagacaacaaaacaaacaaagcagcaaagacacttacctgttctgtctttaacagagtgtttggtggctccctgcaaagggaagctaagagagacccagggtgggaggctagccagctccgtcatttgtattcttcaggtaactcgtttaaacctccatttttttcagctttaaaaatgctattacagtggctattgtttcattccaactttcaagaattcagtatacatctttgagaactaggtgtttggaaattcactaggtgttgggaaaattggtgttttaaaaggaaaatgtagtcttttttttagaatgctctctagaccatagaaatcattgaaattctcctttggctctatagagccaggagatagtcttataacccaatgtcttttgaaaactgaattacaactggaagttgaatagcaacaaaatattataaataaatttgattttaagggaggttttggcaagtacctaggctttgattacctagaaaccaataaattctattctaccatggattttctaatttttctataagcaactataaggtagatcacctctatgacatctaccaccagtggcccatttgtaaaatatgtgtagtgtcattttaacaataagccttcagagccactgtcttctaggaattctaattacaatttataaccaaagtacaaaataattgagttaactttcagtggactgacaggcaatggtcgcatagctgaatgctattttctccgtatcactttcccacaccgcacctccatctttagccctgtgtacctatgtagtcagtatggacaagcctactcttccatcaaagtctatacttggcaaataatagttaattgaagcacagattctgttgttttgtattgaattggtgccagattctctttccaagacaccactgaccacctgctgtcagcaaaggaaaggaaatggggcaaagaaataaggagaagaaaaggttgtagggtagtcaggagaaaaatgtgattgtggaacatgttccatgagttaagcaatctatggagagtaatttggctggtgaagatcttcagagtgtcatgtcagcttcagaatcagagagttgccgtcctaacttggcttatagtgattcacgaggggatggagggagggggagctagtatgggtgaaggccagatataaggaaaacaaaacaaagtgctttatttacagaaatctcctcagagaaataaaaccattgctaactccacaactggaacatgtgtattcttttcttattggcagcaacccaggaaaagagagagagagaaaaagagagagagaaaaaaagaaagagagagacagtgtgtgtgagagagagtcttacaagagttggtggaagaggactgaaggacttggtttctgagatatttaggagtgtaaatggcaggacttggtaactgatggcatgtgtagcatgaaggagaggaaggagtagaggctgatatccaggtttctgattttgactaatgggcgaatggtattgctggaaatgtatacaccctcccaagccatctgctctatttcttcaccttctttttcttcatcattggctgcccttcgtctcttactcaaataattactcgacaagaagtttgcagagaggtttgtgagatttagcacacaacacattaaggacgtctgaaaacccacacagcctgaggagctgtggcttggagagtgatcgagttgatgtcttcaagtataagaaagatattttgtaggagacttttaaacttttcatttatatctaggcagaagagtaaataagcacatgggataaaattttaataaagaacatttcagtggggcataggaaggcaattttaactgttctagggaaacagactagaatgcaaaactatacagaaactgaggaaatcttcaaggagagatatgacaatcctgagacctgaataatttagacaccaaccagaagggaggggccaggattagatgatacctctgagcatctgttctgcaaatgtccttttgttctgccccagatatccccagaggaactatggtctcattgatctggctgagcagatgcatttagggaaacggtacagcaggtcattgaacttatctaaccctgatggctctagaaatggagatagagatcagaaggaaaaaaattcttattttaattttgaatgtattttttatgtctttaaggccagttcctgttagaaaaagaaatgcatctaagagctagaacttagaacatacttgtttatccatccaagataaaagaagctaccaaagggagtgatacagacagatggcaaaacaatgaatcaaacagtttactaagcatgaatccagagaagtacactccctcaaggctaaggctgtagatttatggggaaagtagcttagatttgaggcccatggactgtgaaaggcatgaatgttctccatactctgacatacaagcagggaggtatttatatacaaacagtacacatatgttaattgctaaaccatagttctagcagagaatcagaataattttaatgaatgattagagatgagccagactattagtggagaattttgtcagatgagtataagaggaccagaggacttccagctacatgaaatagcattttaacaaaggcatagatctgtgattaatgagtcatccattttccctttcttctaaagagtccatttacatttaaattcttaattccattgcaatgtcattctgaattatctggtatcttcgaccataccattatttgtgggtggatctggaagactgatatataaaatcacatttgtcaatttgtcttggattttctggcctggaaaatttacggactttattaaatataatattattggtgccttagaaatttcacatgattttttgcaggaatttttgctaaatatgtctggcctgtggcatttatctagggatttgcagagagttttcttcaaaggaatataaagccctaaaaaggaaaaaaagcccagagagttgccttcatggagtcacttctcttttagtgctttcactcatttattagattttacaaagggtaccttctgccaccaggccccagagcatactaatataatttaaataggagagataattgaactgtcaaaactctatgtgtgtgcatgcaggtgtgtgtgtgtgtgtgtaagacagagatggagacagagtcaaagacgtgaaagacagaggcatacaaataacagccatcaacacagcagccacatcattttatgttagagctgactgctcagaaagaacagtcttgctcaaaaagatcttgagtggtgatactgctcttctttcttcaagcagtatcatcccctatcactacaacttggattttgtgatactctctgcttctcctagatgtaccacataacatggatttattttaaaaatcaggtatgtgaaatatatctctatctatctatctagagttatttcaaaaagaaaagaaaatcagaagacagttaacttccctttactttaacattcttatttagaaaattgtgacacttttagaggtaacggaaagcacccctggtgtagctgatgggaaatgaagggtgtcataaaacccagattaggctgtcctggcaatggggtatgacttatatgtatttgtaacaacactttatgcaatgtatccctgaagcttaacatgttgtaaagattggtggttacttggctccttcggagaaacaaggagagggaattttttgttctttccttgttaaactcttcatcccttttccaatacatctcattgtggaaaatatcaactgggtaagtttcaaatgaggccagttttaattgtggcaattcattgaattctcactttccattaccggattatgtggaatgctggctttaaaaaataagttagctgaatgtaagagtagttgcaacctttcttgaatgcacaaaataattgacatagcatctagagctcttgcagaacatagaccctgatttctggagtaccatcactcacaccagagatacactggcaccatttttattttttatgaaaggtcaaatatcacaccatctcaagaaagtaatgtgtatatacttttttataaatagtaatttattgctgaatggttgccattttacgaatgccgtcccaaatctccacaaattgaattattacatcctgccaacaaaagaaacagccatgcccatatttttagatttaaaagttcattataaagtatggataattaaaccattaccttttatttaattaatgatttatactttcccttaattattactttgattctcacaacaaaccattgtggaatattatgaggcccactgagtttgaatgctgtaggtcacatgtctaatggtaaaattaaaactgtaaccctggtctcatgacttgcagtcttacaccctgttgtagtcaataaggtattcacaactatttcagtttcccttgcagccatatgataggattatacttccctgcccctttaaagttagaggtagtcatatggcttgctttagccattgaaatgtgaacagaagtgactcctgtaatttcttgatgggagcatttaattgccagtgctcagctccagacttttgtttgtctttctgtagtgatatggaagcatatttcaaaatggatcctccctcaacttgggtctttgagtgattaccatagacagagcctccaaaccaatatcctacactgaacatgaaaactatacaagaagtaaacctttgttgttttaagccaatgaaattcacataatttttgttgttatggcataacctagcccattctgacttatagatacactctttctatgggaacaaccagtatattatcatttaagtatgtcttcctcatagcttcatatctgtaaaccttgttcctctggagtcagtaccatttttgcacagccacattagtaatactttgtgaccactctcagactgaagcagtttgaatttggtagctatcctgaaaggagtgtcagtggcctattctgtttcttttttaaattttatttcagtagtttttggagtacaggtagtttttggttacatggataagttctttagtggtgatttctgaaattttggtgtacccttcacctgagcagtgtacactgtacccaacttgtagtcttttatccctcgctcctctcccaccttcccctgagtccccaaagttcattataacattcttatgcctttgcatcctcatagcttagctctcacttataagtgagaacatacaatgtttgcttttccattcctgagttacttcctcagaataatggcctccatctccatccaaatggctgcaaaggccattattttgttccattttatggctaggtaatattccatgatgtatatccactcgttggttaataggcacttaggttggtccatatttttacatttgtgaattgtgctgctataaatacgtatgtgtatgtgactttttcatataatgacttcttttcctttgggtagatacccactagtgggacttctggattgaatggtagttctacttttatttatttaaggaatctccatactgttttccacagtggtttttctagtttacattcccaccagcagtataaagtgttcccttttcaccacatccacaccaacatctattttttgttatttttaaattatcagtggcctattctctttaagtgtagtagtgatagactaatcatagattcaaggcttgaagcaatgtcatgagaccaaccattctacctcccacttttaagcaggttagcactttctattccccctttatacatgtttgcatcagaaaggaagatatttgatatgaaagaggaagattgtgaattgaagtagaggagaagaacatggcagtgatcacaatgccatgcatttggagatggccttgccctattgagcttaagtgcacttcaggtatcatctatgaaagaggaaaagggaggagaatgtgtaggaattggggagggagaatacttatcttcagcaccactttagaaccaaaaattcactctgacaagatagaagtaaatgcaaaacccattctttttccttgattgatcttaccaaatcattcaaatccaaaaatacagaaaagcctatagaaccttagaatcataacctttatagatggaaggagctttagaaatcatgtggtttaattccctatcttatagatgaagaaactgagacccagtaagaagaagagaactggctcagtttatacataaccatctatatttcccagacatatacatatggatatctatttaataaaatcctaaaagtatttcatagccaagtttctaaattataagtctttttgatagcttgaaacataagctaggtcctttttatattgataaatgataatgatgattataaattattccaattagttatgacataggaggttgggctgtgataacaaagaaaactaaatacctagtgtcttaaacaagattgaaacatatatttcccctcatgttagtcaatatgtaagtagtccagagctgatacagtcaatccatgttgtgaaggatctaggctccttctcttcttgtggctccactgtcctctgttgccctcatccacatgagggtaataatctcatattatggttgataatctcatactgtggttgagatatgggtgataatggcttcatatgtgatcccttcttgataataatttatttttacttgacttattcttgaagaacattgccttagttcaaatggaatgttacctaaaataattaacacactaagcctatcagatctgtttctgtacatgagagcattgagagataagagcattgatgataaaacatgtctactaattggtaatttgatggtatggtaggggaggcctggaagaggcccacaagaactaatccaaagatacctactcaaaattatgtataggattaaaaccctgctttgcctctaattttctctcttctactaaagagaaaaaaaaagccttccttaatgatcagtgtctagatcagatttcaatgtcaggtttttgtaaattttacaactattaatagaaacgaagatgttccaaatatgtccattttcacttattcttcagagtaaagacactcagtctgtgtacctaattatataataggtaatagagatttagtgacatcaatttttccccgacatgtccaatatgtattaaattctgaatacccctccatgctctggaaccacaaacacccagaaacagatagaaaattatttacaagaaactttagcatcagggaaaagaaaaggtctgcaagagtgggtgaaactgtcaaatccaatgaagcaaagaattcctagaagattgtttattttctgagtgaaagtatagatttatggaatgcatacgaaagcctaaatcagttttgtggccaggaagatagttcatggatgaaaattaattactatttggttttagatccttctgaggatggtgatgacttttatatattatcttaagtacaggtataacttattttaagtaaactcaactttgaaaaattctaattgacacaagaaccaagattagtgcttagttctataaaaggattcaaagcagaattccttaacatagcatagtcttttagttcaagagtcagcaaatgatgacctaaggaaccagtatgatcagtctttgtttttgtaaataaagttttatttgaacacagttatgcacattcatctagtttatggattatttatggccatttttgcactacaatggcagtgttgtaacagttctgtttgtatgacctgcaaagtataaattatttactatttggccctttacaaaaaaagtgtgctgacctatactacagtgcatcaaaatgttattcatattacatcaatttatttagtttgcagtaattgaacatattttgatattgttgaagaaaagtttagatgtgaagaagtggtagagatgaacctagtggagtggagagaggtcatatcatgaagagatttgtacacttagctgagtttaaactttatcctgagagtagtgagaaaccatggaaggttggtttgtttgtctatttatttgtttgttttcgagacaaggtctcactcctgtcacccaggctggagtgcaatggtgtgatcacggctcactacagcctcaacttcctgggctcaagcaatcctcccaccgcagtctcatgagtagctgggaccacaggcatgcaccaacaaacccagctaatttttgtattttttgaagaagcagggtcttgccatgcttcctaggctggtttcaaattcctgggctcaagtgattcacctgcttcagcctcccaaagtgctgggattacaggtgtgaaccactgtacctgactggagggttttttaattcagtggacttacatgattccctctgatatcagtgtggcagatggattggacagagatcaattaggaaagtattgttatgcaggaaagaaattatgaatgtctgaatttagatggtaagaataaagaaagattgaagttgaaggaaactcatgcgaatgttaccaagaaagaagaagcaatgtgattttgtgaacgggtgaatggatgttggtagggaaggggaggagtgtgagatgactttcagatttctgacttaaaaaaccaaatgggtagtggtaccattctcagagagggggaatataggaaagggggaaaaattttagggaaataagattggttcagtttcatagctattgaatatgatatgcttgtgacacatccaagtagaaatattttttaggcaagtagaatacatatatctgaaacaaaattaagagttatgaggcaaggatatagacttgaaagttatcttatataactagcaatttaggctatgttttagaataaatcattcagaagaactctatagactaagaacaatagaaggcaaggatgagcacaggaggaacaccagtatttaaacaatagcagaggaagcccatgaagaagaatgggaagaccactaaggatattgaaaaggagttgcccttgagtaagttaaaaagaaaacaagttagaatcatcacgaaagctaagagaaaataaaattttaagagggaatgtcaaatgtctaagagagatcaagttataaagaaatatcatgacagattattcatcgggtttgtaaatactgagttcactcgtgaccttagtgaaagcagtgactggggaggatggcaaaggaaacagtaaatataagctaatctttcaagtaatatttctgtcaaagactggagaaggtactagttagaggaactcttaagggagtgtttcttgaggataggaaagaattgcttgtgtttattatgctaaggggagggaatctgcaggggagaggaagaagatataggaggagacccactgcagctccaggctatcaggccaagcaagctctgtatgggacagtcccatctttagtctctcaggtcactgtcagccaggctaatccaaaaagagctgacatttggactttagatgataatcacgtctgagaatatgattcacagctcaatgacactagctttcccagagctgtctttctttagtaggatcaactaagaggaacatgttttaattttcttttccatcaggcagaaatcactggaggtccagtgggaagctagatagcaagtggttttgtggagtgttgaatggtccttttgctgtctgtgacagcacttgaatacacaatcagctctatgttaatgctgtgtttagagaagtaagataatagtgttacgtagacttggtagaaacctgacctttttttttctctatagcagatggtatgattttgtgagattgcagcagtatacattgccagatatgtggtgggaaaaagcagcattctatacaacatgctaatgggtacaatttattaaaacattttctaactcttagagatattaagcaaatcacccattagtgaaaagttagaattaaagatatgtaagtaggtgaggaatcaatcaagcattactaaatcttctgaatatatatgccaaacttattttttgcaaaattatttatttgtgtcataagtcagtatattatttcatccaaaatattgtcatcacctgaaataaacctgcagttccaacagtaaaagctgtgagtctctcttcttacttttaattttttaatttccttttttaatttttatttttaatttcaggagtacaggtttgttatataggtaaacttgtgtcatgggggcttggtgtacagattattttgtcaccctggtattaagcctagtagtcattggttattttttcgatcctctccctcctcccaccctccaccttctaatgggttccattgtgtgttgttcacctctatgtgtccatgtgttctcatcatttagcttataagtgagaacatgcagtatttggttttctgtttctgtattaatttacttaggataatggcctccagctctgtccatgctcccacaaaagacatgatctcattctcctttatggctgcatagtattccatggtgtatatgtaccacattttctttgtccagtcagtcattgatgggcatttaggttaattccatgtctttgctattgtgaatagtgctgcagtgaacatacacatgcacgtgtctttatggtacagcaatttatattaccttgggtatatacccagtaatgggattgctaggtggaatggtagttctatttttagttatttgaggaattgctacattgttttccacaatgactgaactaatttacatttccaccagcagtgtataagtgtttccttttctccacaacctgctagtatctgctatttttgactttttaataatagccattctgatttgtgtgagatggtacctcgttgtggtttttgatttgcatttttcctaacgattagtgatattaagcttttttttcatgtttgttggccacatgtatgtcttctttagaaaagtatctgttcatgtcatttgcccactttttaatggggttgttttttgcttataaatttaagttccttatacatactggatattagacctctgtgagatccatagtttgcaaatattttatcttatattgaaggttgtcagtttactctgttgatagtttcttttgctgggcagaagctcttttagatcccattgtcagtttttgcttttgttgcaattgattttggcgccttcctcatgaaatctttgctcattcctatatctagaatggtattgtgtaggttgtcttctagggtttttattattttgggttttacatttaagtctttgatccatcttgagttgatttttgtgaatggtgtaaagaaggggtccagtttcaatcttctgcatatgcctagccagttatcccagcatcatttattgtatagggagtcctttacccattgcttatttttgttatctttgtcaatgatcagagggttgtaggtgtgcatgtgctgaacttctagtaagtcaataggtcagcagtatatagtgttctcatgctctacaagcacatccccatactggtcaccttgtgggtattcagaacgctttgcccagtcattttctttgaagaacttatattcttctagggagctaagacatagttatgtgaaagaacacttatgtgcaacacctacatgaccctactacctggtcagtgttagggctaataggaaaaactgcaggaatgctgcagaagtagcagatcatgtgaaaatattgcagaatatataagccaactatatgattagagaatacaactatcaaaaattcatttattcatcaaaattctatcaggtccctagtataggcagagcatttcatgtttccctcatgtaagtgtattttaggagttgaaaaatcaccataaagtttgcacttttttcttaaaagtgaaactaaagtcattggtatgacaagactgacatgaaaagttagttgcagggaaaaaaattactctattttatcattgatattcccaaatgtcaagtgttattgcaactagggagtaggactttttcccacaattaaaagcttatccacaagacatgcaagccaagtaaaaatcagacagctgacaataccaagagtccacctctaacattattcctgggagaagcggctgaatatttcagtagctgataatggatctgaaaactaaaaatttcaccatcttttaaaaatgggcctatatgatactaccggaaaattacttccagaaataattgccagtaaaagcattcctaaaatttaccttaatattgtcattgaatattgcttgttggagcaatttgtaaaaggattgaaccagataatttcttcccttataactctaaagtcacatctttgccctcgtgctaaatgataatggcactaacacagtatgttataagatttaccaaagactgtgtatgttctgccacctcatcaaggttatagttatatcaaagagaatctatctctttggctttctttttcctcccaattaatagaccctcaataatattgttgtgattaatttgattgatagcttagtttcttttttaaatattagacatattttccctcagccaaaattgacagcatattttccagactatactgatccatgagaaagcatgccctcaccctcctacaaccctcacccattaccctatattgaagaagtgtaaagtcctggaatataatagtttgtccccttacttaccacactttgccactcacctcaccaaatcccatctctttccctttctttggtagtacttacatggtcaaaaatgtggtttctattgctctgaagttatgtgagccttgaagagttcaagatgttcccatttgtaggaaaattttcactttctttttattattatactttaagttttagggtagatgtgtacaatgtgcaggttagttacatatgtatacatgtgccatgctggtgtgctacacccattaactcgtcatttagcattaggtatatctcctaatactatccctctcccctccccccaccccacaacagtccacagagtgtgatattccccttcctgtgtccatgtgttctcattgttcaattcccatctatgagtgagaacgtgcggtgtttggttttttgtccaatgcatactttataatcatttgtaacagcaaaaaggctgtaagttcttttgactagcttccatgcacatgcttatagatcaataaatatacagtattgtctcacattggggatagtttgtaaaacaaactgcagattttggaggagggggtcacttactgtgttcaaagttaagtgatatgtcaaacataagggttatataagacaaggatcatgactgctcagcttggtttgttattttaatatttaaattgacatttttctacaagtacctttaattatgctttaaatccctttaaatcactgtgactaatattttttctgaagaaatgcctcaatgggataggattatttactttttaaatttacctcctaaaactctgaataccaaagataaggagacagagaaaccaagaaaaccctgacgcaagtgtttttggagctcagtgtatggtaagatgcctttaaagctcttggccccttgaaagtgcaccactaataattacaaagggaacagactaaactctagtgccaatacttatcacacaagctcatactgttcctatcagtaggattaataagatacactgaaaatctattagtgatttccaaagtagatagactggacccctgccttaatgcttttctaaagccatgcgatcaataaatatttgttgaataaatgaataaaataatgagtctatgttgccctcaaggtccatgttgtgaagctatcttgtaattgagatccattttatgttgacagctttctttctcttcaggaattgaatcatattggatggaaactctagctactgaagtattcagccatctcccctgggaataatgttagaggtagacttggtattgctagattcctgacttttgtttggcttgcatgtcttgtgcatgagctttcctttgctggaaaaagttctactccctacttacatttacacttgacctttgggaatatcagtgctaaatagagtgatatttttccctgcaactaaatttttctgtctgtattgtcataccagtgactttagtttcactttcaagaaaaaaatatcaaccctatggtgattttgcaacctgtaaaattaaatttacatgaggaaaacaaaactttaaataaagatcatggttaaaagttttaaaagtgtcttaaattagaaaaatatataaaaccaagcatattttcttttatatgcaacatttttctttatatgcaatatataaacatatgcaacatattttctttatatgcaacattagcaagctgtgctctaccatgggttcagtaatctgtatttagtgatcactgatttatcaggctgagaataaataatactaaatttattgttgttattaataaacaataacaattctactactgcttttaccatttacactactactaacaaccactgagactttattatgagacagatactaagctaattgccttctattatcacatttattcttcacaagaaatctgtgcaataggtattcctactccatataatagataaagaactaaggcccaaagagtaacactaacttgctcaagatcacgtaagtatgaagatatgaagccagtactcaattctggctctatataataccacctattatccattagtccatattgccccagaacatcaacaagatgataaaatgcttcaaaacaaaatgttagactccctttctaagcccaagatacatgatttgggatggctgtggtatcccaacagacattggtagctaagaggccaagatagtccttgtagcccagttcttattcttttgtcttaccatgcacaccaatgaacaggacccgtattgctgtctctctgaaacactgtagcacaaattgctttcacaacttctttattgcgagtaaattgttcaggtaaaaccatctttacactccacactcagtagatgtgttggtagataaatctgtgatattgttaaggctattcagtggagcattgataacaaatcatcttgtgtgctttcctgccccaaatcgcacatttgcatccagtgaaatcaggctcaaagaaatggaaaagagattttaaatgggcagcctccgttatatataaagaaatagacttggagaaatatattcctaggccgtgtttatgccttggtgctagtgggaggaggaaggctgaaaactgatgttaagtgaaccccccgtgttttttttttttttttttgcatactttggtgaaggccacttcctttgtgtccaccagctgaatgactgtacagctgccaacaacatgtatcccccatttaccttaaccagggacccagggcagtcaccttgactcacttatcaaccctagggacagctggggattttgctaatgcaggatcatttacaacaataacagaatagcccgaattctaagagccagcagcagatttcacattagtacctaatggctctgcaggacaggacaaacaaacaaatctgtcaaaccaaagaattatcaaaccaagaccttgaggctcctccaggaaaggatgctcagagagtacagcagagaaagaatccctaggaggcattggcagctcttttaatttgattgctttagaatgaattctgcttggcctcactgggccaattttataaaacttaaaacactgtacggaaattttaaaaaataaatttagaaaatctcttaatttcccatgctgagtaggagggagaacagtaacataatttaaaggggcttaggcataattctaagtaatttacatttggcttggaaacacattctgtaatattttttttcttctgtggactcaccttagtttttgttcagactaatatctgaagtagttggaagtccctggatacacaccaactggcatagtgaagagaacctagaagcacgggcttaacccagaatctaggatgtaccatctgctgtagataaactataaaggggattaacttcacacagttattctgggcttgactgtattgctacactcatgcaatttctctttccacagcctaaatatcacactaaaaattaggttcatttctgcactttaaaaatgatattgatagttatgtatatgctaattataaaaatcacaagtgttctttatagaaaatttagaaggtatatcaataatgaagaagaaattaaaaattacctatgcttctagaatttaaagacaggagatgttaatatttcattatatttttggacagttttcatatgtaattataaatacagatcataaacgagatttaactgtatatttaatcttttattcctatttcatttaatagtttattatgaacattttccatgtagttaaacatccttcacaagcaaactggataatgtgtgttctttaaccacttgaatataccataatttatttaatctttccacttttcttggacatttaggctgtgtctaatttttcaataacataatgattattattgtaaataaatttcaaactacatctctgctatttccttgaagtagggtctaaaatatgaatattatgataataatgagagtatatttgttaagcctcttgatgacattgttatactgctttccagaaagtctgtataatcttacaaccatccaagcagtatataaaattgtttatctcaccatataatccaagatctagaacatacatgtatgtgaatattttaaattgaaaataggattccaattattatcattttatttatttgatttgggttaagatttagtttgataggatgatactggtgttttttcttgagttatctactcagttactttgccagcttttgatttggggtgttaatttttgcattattaatttatactatttctgtatatgtcaaggatataatcccttcatctgccatatttgttgcaaattttacgccagcttctttgaggaataatttacacacaataaaattcacgtatttaagtataaacttagataagttctgataatggtcagttgtgtaaccatcactaaaatcaatattgtcttgatgtaaatatcacactgtcttgaatgctgtaactttatagtgtatcttaaaatataatattttatgtcttccaatttatttcaaaattttgttttgctcttctaagtcttttgtatttcctacaaattctagaatcagcttgtcaatttctacaattaaaaaacctacttgaaatttggctggaattgcattgaatctatagatccatttggggagaattgacctgttaacagtaactcttccactccaagaacaagatatatttctccatttatttgaataatctttaattgctctcatgttttatagttttcagtatataaaataacatgttttattaaatatatttctaattattttatatttttatgctactgaaaatatcatttcttaggggagaagccttcagctttttactgtcaagtataaggttagctgtagattttttatatatgccatttatcaggttgaggaagtttcccagtttgctgagaggtgtttttttttttaaatcattagggtattaaattgtattaaatgactttatgtatatattgattttttaatatattttggtctgttcttatagtgaatttcttattgattttcacagtgttgtaataacactgcatggcataaatcccacgtggtcatgagatatcattttaatacacttttaattcattttgttaaattctgtgtgtatgatcataagcaatattgatatgtactttttatttcttgaaatatctccttctggatttgaaattcagtgatacggacttcataagttgggaagttctcatttctcttctatttttggaagaatttgaacataattggtattatttttccttaaattttagggaaattaaccaatggagccatattaggtatgaaggtttctttgtgggaaggttttaactaagaattcaattttttttgtttttttttttttgagacggagtgtcgctctgtcgcccaggctgtagtgcagtggtgtgatctcggctctctgcaacctccgtctcccaggttcaagcgattctcctgcctcagcctcccgagtagctgggactactggcgcgtgacatcactcccggctaattttttgcatttttagtagagacggggtttcaccgtgttagccaggatggtctcgatctcctcacctcgtgatccccctgcctcggcctcccaaagtgctaagattacaggcgtgagctacggcgcccggccaagaattcaattttttaaattgatgcaaggatactcaggttatctggtttttctgcataagccttgttagtttgcatctttcagagaatttgactattttatctaagttgttatttattagcataaagttgtttataacatcccatccttttagtgcctgttgactatgtagtgatatctcctctttcttgtttcatataaatcatgtttcttcttctttttccttttcagtatgtctagagttttatgaattacatttatcttttcaaaaatttgttttactaatttattttcttgatttctgtttcatttatttctgctctttattctctcattctttgttcttacttggggtttactttatttttcttttactagtttctcaagatggaagcttaaatcattgatttgagaactctgcataatataatcgtttaatatgtaaatttcactctaagtactgcttttgctgtatcatacaaaccttgacatgtttttcattttaattcaggtcaggtgaagatactctctaatttgtcttatgatttctcctttgccccatagattatttagaagtatgttgttacagttctaaatatggtccttttggtgactattccatctgcacttgaaaagaaggtgctgctgttgtgtggagaaattttaaaatatcagctggatgaagttagttgaatacgttgttcaagtcttctattttttttctgattttttgtctacttgttctattaattatctgagagaagagtgtgaaatctccatctgaaatggtggatttgtctatctctcttttccattctgttagtttttactttctgttttgtagctctattatttagtgaatgaaggttagacttgttatgttcccttaatgaaatgattatattatcatcatgaaatgccctcctttatcgctgataatattccttgctctgaaatctattttgtgtgatactaatattatcattgcagctttttcaaaatttgtgttttatggtatgtctcgtttcatccttttatttttaagctttatttctttatgtgtaacatgtttcctgaggacagtacatagttgtttctgtttttttttttcttgtctcacttgatatgttgtcgtttctgctttgtatagtcaattgtcttcaaaagcattaaataggaggaaagaaaacctggaatttatgcaaatatttaccattttgctgactataaaattctaggttgacagcctttttatcagcagctaaaatatgctctaccatattgtgtcttgcataatttctgaatattatgtcttttttatcttcttttgagagtcttgatcactggtgttcagcaatatgattaaaggttttgagaaatgtggaaatcttcaatcatcattttttttcaatgttttttgttctctcattctttcctcttctggagctccaattaaatgaaatgtatatagcattttttatatcatcacaccaacacatttacctttttcagtctttcgtccttctgtatgattccttttagatcactatttttttttcctttggagtgtttaatctactggtaaactcatcctaaataatacaatttcatttcagatattgtatttttaattcctggagattctgcttgtatctttttacatatctcctgtctttcctcatgttcatgttttatgattttaaatatattgaatatttttataataacagctttactgtccttgtgtgttaattctataatttggattttaatatgtttctattgattgatttttcttgtggttatgctcattttttttacttcttttgatgttgttgattgtgaattttatgttcctaggtactagagtttgttgtttcttttgcatgttgtcagactcagttgagggatgcagtttttttattactttttttttttaatttaagttctggactacatgtgcaggatgtgcaggtttgttacataggtaaacgtgtgccatggtggtttgctgcacctgtcaacccatcacctaagtattaagcccagcatgtgttagctcttttcctaatgctctcccccacctgctgtcccacaacagcccccagtatgtgttgttcccctccctgtgtccatgtgttctcattgttcaactcccacttataagtgagaaatgtggtgtttggcgttccattctggcattagtttgctgaggttaatagcttccagcttcatccatgtccctgcaaaagacatgatctcattccctttttatggctgcatagtattccatggtgtatatgttaccacattttctttacccagtctatcatttatgggcattttggttgattttatgtctttgctattgtgaatagtgctgcaatgaacatatgcatgtgtgtatctttataatagtatgatttatattcctttgggtatacacccagtaatgggattgctgggtagaaaatctttgcaataccattaaggacataagcattgagcaaagattttataatgaaatcgccaaaagcaattgcaacaaaaataaaaattaataaatgggatctaattaaactaaagagcttctgcacagcaaaagaaactaccatcaaagtgaacaaacaacatacagaatgggagaaaatttttgcattctacccatatgacaaaggtctaatatccagaatatacaagaaacttaagcaaatttataagaaaaaagcaaaccaccccattaaaaagtgggcaaaggacatgaacagacatttcccaaaagaagacatttatgtggccaacaaacagaaaaaaaagctcagcatcactgatcattagagaaatgcaaatataaaccacagtgagataccatctcacaccagtcagaatggcaatttttaaaaagtcaagaagcaataaatgctggggaggttacagagaaataggaacacttttacactgttggtgagaatgtaaattagcttaaccattgttgaagacagtatggggattcctcaaagatttagaagtagagggatgcagttttaacttggagtcagtacccttcttttcaggattaatcttgaaattttggtttatgcccagagaagcttttgcctaggtttaatctgtacctgtgattaaggcaataccctcctgagaactctatctgatgatacataggtgagcaggaatttccattctggctcataggaacacacactatatccagcctagtgtatgctgcaaagacttttctgcctgctccattttggtggttggttctttttttgcttcatatagtttccttccatgcatgcatagaccagtgcttggccaaaaacttgagaggaaccgcctacaaacttctagaattctgtgcatgtgcacatgtctttgtgtgtgcagctctctcttctctggtatttaaataaaaaattatatatgccttggcctcctcaaattctgaattctggttcctcaatttagagaaagtactgatctctcttggggttccctttccttgtttctcaacctggatgctctcctcaggcaggaagctggacaattataaggctcatctaatttcacttattttcccagagatcattaccctgttctgtctcttgtaaaatatatgaaaactctcagggcatatattttctatagtcctccctgtatttaaggcaggaagttaaatctggccctattactttatcatggacaatagtagtagtcctgtattccttcttgaatcaaaattaatatatacttttctataaatttttccatttcttctaatttattgataagctaattaataattttatctttatcttttaattctgcttttctatagttaggtctacttttctatttataagaaatatatatgtgactttttgttttccttgactattctttccaaagttctgtattgtttgttagactgttcaatgaaacaaatttgctttctttgagccttttatttgttttttctgtttacttgacttttctgttattgttactattttctaatattatttttactttcttcaatttttaatagtttactatcttctgctttctcttagtttattctgttgtttcttttctactttattagttgaactttaatgttcttcctttattatttttgtaatacaagcacttacactataaatttagattgaaatagagcttttactgaaccccacaaattttggtatgtgatgttgtcattatcacccaatttttagtatttttacaattccattataatttctaacttgatcctgaaaatatgttttttaaaaatttccaggccagacgtggaggctcacacctgtaatcccagcactttgggaggctgaggtgtgaggatggcttgagtctaggagtttgagaccagcctaggcaacagaatgagactctatctctacaaaaattttaaaaaatacctgggcacagtggcgcatgcctgtagtctcagctgctcaggaggctaaggcaagaggattgcttgagctcaggaggttgaagctgcattgggccgtccttacaccactgcactccagcctgagcaacagagtgagactgtctcaaaatattaattaattacaattttaaaaaagaaaaattccatatatatggatgatgttatacttatttattttatatcttatttattattctaattaatttatttcttcattattattttaatgttctgcatcttgattgtatcaatgttaatatccttgttgtagtattgtactatagtttctgcaagatgttaccatgggaggaaactgtgtagaaagtatacaagatcaccgtgtattattccttgcaattgcatgtgaatctatatctcaaaattaaaactgtgataaaaaactttaaaagttgattcttagataaagacaaaatatattttaatttttaattttaatttttgaacttttatttgaggttcagggatggatgtgcaggtttgttatccaggcaaattgcacatcaccggggtttggtgtactgattattttatcacccagctaatgagaatagtatctgatatgctgttctttcattttcatcctcctccccaacctgcaccctaaaaaatgcccagtttctattgttccctttttgtgtccatgtgtagtcaatgtttacctcttatatgtaagtgagaacatgcagtattttgttttctgttcctgtgttaattcatttaggatgatggcatctagctccatccatgttgctgcaaatgacatgatctcattttttcttatggctgcataatattccatggtatatatgtaccacattttttaaatccagtctactattgatgagcatttaggttgattccatgtctttgctattgtgaatagtgttgcaatgaacatgcgtacatgtgtctttatagtagaacaatttatatacctttgggtattaatacccaataataggattgctgtgtcaaattgtagttctgttttaagttctttgagatatcacaaaactgctttccacagagattgaatttacattcccaccagcagtgcataagtgttcttttttctccacaaccttgccaacatctgttaatttttgactttttgataatagccattccaagtggagtgagatgatatctcattgtggttttgatttgcatttctctaattattagtgatgttgagcattttttcatatatttgttggccatatgtatgttttcttttgaaaagtatctgttcatgtcctttgctcactttttaatggggtaattttttttcttgtaaatttgtttaagttccttatagatgttagatattagacctttgtcagtttcttagttggcaaaaattttctcctatcctgtaggttgtctgtttattctattgatggtttcttttgctgtgcagaagctccttagtttaattaggcaccacttgtcaatttttgtttttgttgcaattgcttttgtcatgaaattgttgccagggcctacattcagaatggtattttttaggttttatcctagggtttttcgtagttttgggttttatatttaagtctttaatccatttttagttgaaattttttatatggtgaaaagaaggggtccagtttcaatcttttctatatggctagctaagttatcccagcagcattttttgaatagggagtttttccctattgcctgttgttgtgaactttgtcaaagatcagagagttgtaggtatgcagctttatttctgggacctctattctgttcctttggtctatatgtctgtttttgcacctgtaccatgctctgttggttattgtagccttggagtatagtttgaagatgggtaatattatgccttcagctttgctctgtttgcttaggattgctttagctatttaagctctttttggtttcatgaattttagaatactttttttctgattttgtaaaaagtgttcttggtagtttgataagaatagcagtgaatctataaattgctttgagcaatatggccactttaacaatattgattattcctatccatgagcgtgggatgtttttccatttgtctgtgtcatgtatgatttctttgagcagtgttttataattctcattgtagatatattttgactctctagttagctgtattactaggtattttattcttttgtggctattgtgaatgggattgtgttttgattttgatctcaccttggatgtttttggtttacagaaatgccactgattttgtacattgatttagtatcctgaaactttgttgttgttgtttttttatgaaatctaggatattttgggcagagaccatgtggttttctaagtataaaatcatattatctgcaaacagagatagtttgatttcctcttttcctatttggatgcatttttttttgtctgattgctctaaataggatttccagtactatattgaatatgagtgcttagagagggcatccttgtcttgttccagttctcaaggggaatgattctagcttttgcccattcaatatgatgttggctatgaatttgtcatagattacatttattatttggaggtttattcattcaatgcctagtttttaagatgaagcaatattcattttttcaaaagctttttctgcatctattgagatgaccatgtggttttttattttagttatttttatgtgatgaatcacctttattgattgtgcaggctgacccaatcttgcatcccaggtataaagcctacttgattgtggtggattagatttttcatgtgctatactggattcagtttccttgttgaaaatgtttgcatctgtttttctcaaggaaacagattggcctgaatttgtgtgtgtgtgtgtgtgtgtgtgtgtgtgtgtgtttgtgtgtgtttgtgtgtgtgtgtgtgtgtgtgtgtgtatctctgctagattttggtgtcagaatgagattggcctcatagaatgagttaggaggagtccctgatcttgaattttttggagtagtttctgtaggaattgtactaggtcttctttacacatctggtagaatttggctgtgaattcctctggtccaggactttctctggttgttaggctttttattactgattcaattttgaaacttgttactgatcttttcagggtttcaatttcttcctggttcaatcttgagagacttcaagtttccaggaatttatccatttcctgtagattttccactttatgtgcatagaggtgtttgtgatagtctccaaggttttttttttttaatttctgtagggttggtggtaatgtttcctttgtcatttctgattatgtttatttggatgttctctctttttttcttcattagtctagctcgggatctatcaatcttatttacttttttgaagagcctacttctggtgtcttcgattttttgtgtggctattgacctcttaatgtcattaagttcaggtctcattatggttgttttttatcttctgctagctgtggggttggtttcctcttgtttctctatttcctgctggtgtgatactggtcgttagcttaagatctttctaacttttttatgtgggtgtttagtgctataaactttcctcttaacgctgctttagctgtgtcccagagattctggtatgttgtaaatttattttcattagtttcaaataatttcttgatttctgccttaatttcattgttaactcaaaagtcattcaggagaaggttgtttaattttcatgtaaattgtatgattttgagcaatcttctttgtactgatttctatttttactgcactgtggtctgagattgtaggtggtatgatatcattttttaaaatttgctgagaattttttatggccatttgtgtggttgattttagagtgtgtgccatgtgcagatgagaagagtgaatattttgttgttttgggtggagagttctgtagatgtctgttatgtctctttagtcaagggtcgagttcaggtaccaaatatctttgttagttttctgccttgatgatctatataatactgtcagtggggtgttgaagtctcccactgttattgtgtggttatttaagtctcttaattggtctctaagaacttcttttatcagtctgggtgctcctgtgttggatggaaacaaatttaggatctttatgtcttcttgttgaattgaatcctttaccattatgtaatgcctttctttaatttttttgatcatttttggtttaaggtctgttttgtgtgaagttacaatagcaaccgtcaattttttgttgttgttgttttgttgtccatttactttgtagatttctctccatccttttactttgagtctatgggtgtcattgcctgtgagatacatgtcttgaagatagcataagctaggtcttgcttttttatccaacttgccactctgtgccttttgttgtggggcatttatctcattcttgttcaaggttaatattgatatgtgtggttttggtcctgtcatcatgttgttagctggttattatgcagacttgattgtgtagttgcttaatactgtgtcgatggtttatgtacttaaaagtgtttttatggtggctggtaatgatctatcctttccatatctagcactcccttaaagatctcttgtaaggcaggtctggtggtaacaaatttccttaccatttgcttgcctgaaaaggatcttatttcttcttcacttatgaagtttagtttggctggatgtggaattcttgtttggcatgtcttttctttaagaatgttgaatatagaacctcaatctcttctggctaatagggtttgtgctgaaagttctactgttagcctgatggggttccctttgtaagtgaattgccccatctctctagctgcctttaacatttttctttcatgttgaccttggagaatctgatgactatttgtcctggggatggtcctcttgtatagtatctcacaaggattctctgcatttcttgaatttaaatcttggcctctctaatgaggttggggaaattttattggatgatttcctcaaatatattttctaggttacttgctttgtctccttctctttcagggatgccaacaattcgtagatttggcctctttatataatctgatgtttattggaagtcttgttcgttctttttttgttcttttctctttatttttttctgaccgagttgattcgaagaaccagtctttgagctctgagattctttcctcatcttggtctcttctgctgttaatatttgtgactgtattatgaaattattgtagtgagtttttctatcaaatcagtttggttcttttttaaaatggctattttgtctttccactagtatcattttattggattcattccttagattgcttgaattggattttgactttctccagaattttgataattttcattcctatccagatcctgaattccatgtctgtctttccagccatttcagcctggttatgaagcattgctgaggaagttgggaacaaagaagacattctggctttctgagttgccagagttcttataatggttctgtctcatctgcctgggctgatattcctttaatctttgaagttgctgtcctttggatggatttttttttcgcttttatattctttgataccattgtgggtttgatataaggtgggttcatttgactggcttcatttctggaaaatttcaggggtccaaggctcaactcatcactcctgggctatggggtctatctttggggttctggtattgggtccccagctttgttctctggccccttatggttaggaacctgctgcactggcaggactgaggtgttcccagtctcctggcaacaatcctctgatgaggggtctagccaaagtactttcttggggcagtggctgtgcttgtgtgcacatacaagcagcagcctgttatatttgtatttattttatttgtattactaacatctaccttaattgtactatggacagagaatattgtcagtacgatacctactctttaaaatttgttacatcttgctttatggtctggcatatgatcaatattttaatataatctgtgcctgagaaaaatttaggttttttgattgcacagtgagatttttactattgatagttctaaagagagcataaaatatatttacctctttgttgtttccccattttctatgctcagaacatttgctttttatcataatttgataatattcacctttatcttttctagatttctgtgatttcctaccttcatttagcatttccaagccatctggaatttattttgttataaagcataggtttggtttagaatctaactttttgatttatgtatatctaaatggcataactccataaccattagcagaataattggcatgactgtgtcttagtattttatcatgtaacctataaaataatccagttgttaaatatgttttggtaggtttctgggttatctgtctcagctattgatacttctcatactaataccacactcttctctttgttttaccttaatagttaattttagcatctggtaggacaagtattattattcttatttttttaatggtgtgaactattccttgtagtttattcctataaatgaaatatagaatgattttcaagttaaaaaaatttatgcttaactattcataatagcaaagacatggaatcagggtaggtgtccattgacagtgaattggataaaggaaatccatgaaatcatgttctttgcagcaacatggatgcagctgaaggccattatcctaagtgaattaacactggagcagaaaatcaggtatcacacattttcacttataaatgggaactaagcattgggtacacatggatgtaaaaatgggaacagtagacacagcagaatacaagaggggagagagaaggtggggagtatgggctgaaacactacctaaagggtactatgctcactacctgcgtgacaggatcatttacaccccaaaccttagcatcacacaatatacccatgtaacacactcattctgagattgataattaattgggtaaaattaggtgaataattcttcttcatatcatgttacttctttaccattttaacaccattttaacaatagcacagagtttttgattaccttgtagaagaaaggacttttttgatcactgaaaacttcaaattatatcccagattttatcttcctttccatttcccctacaactattttaatttcccgttatcttcaaagttttgtaggatgtatttagttgaaacactaatgtagacggaagtttattaataaaaaatatttcttccaccaaacaagtttgtaagagtctgggttaaacaatattaaataagaattttaccactggaatttctctgaaactttaatatactaatgatcatattattgaggctgcccaatataggaataaagtcagcagcccttcccaaatttttgccctgacaaccagggttttccatggccttaacataatgtcatagagttgctttgaaaaataagtgagttaaaacccataaaatattttattgaggatttttacgtctattttcatcggaggtattggcctgtagtgttttttgttgttgttgtttgtttgtttgtttgtttgtttttcttgcagtgtctttttctagctttgctaagagggtgatgctgtccttataaaatgagtttggaagtgttccctctagttgtatcttctcaaagagtttagggagaattggtattaattctttgaatgcttgataaaattcagccataaagccatcttagtcctgggattttctttgttgggatatttttaattactacttcaatctccttatatattattggtctgttaaggatttctatttcttcttgatgcaattttggtaggttgtatgtttctaggaatttatccatttcctctagctcactcaatttgtttatgatagtctttccgatcctttttcttttcatacgcaaccattttaatatctccactttcatctctttatttatttgagtcttctcttttttagttagtctagctaagggcctgttgattttatattttaaaaaactcggttttcttgatttgtttgtattgtttttgtatttttcgttggtttatttcttctctgatttttaatattgccttccttctgctaactttgggtgtagttggttcttttacttttgctattctttttctagttccttgaggggtaatatttgtttttttatttgaaatatttgtttttttaatgtaggtatgcatcactataaaatgctttcttaaaactgggtctgctgtatcccaaacatgttggtacgttatttttttttgtcttgtctcaagatttttgtttgtctcaagatattttttaatttcccttttgatttcttttttgaccattggttgttcagaagcattttgtttaatttacatgtaattgtgaattttccagttttcctcttgttattgatttctagtttcataccacagtggtcagaaaagatacttgatactatttcaatcttcttaaattagttaagacatgttttgtggcctaaaatgtgatctgttctggagaatgctccacatgtgcttgagaagaatgttcattctactgctgctggatggaatgttatgtatatgcctgttaggttcatttggcataactacataactaatgtagctcaagttgaatgttcaagtccagagaatggatattctgtctggatgatccacccattgttgaagggaggtattaatgaactggacccttatcttacaccatacacaaaaataaactcaaaatgcattaaagacctaaaagtaagtcctgagattataaaattcctggaagaaaacataagagaaaagccctttgacattgatcttggcaatgattttttggataggacaccaaaagcacaggcaataaaagcaaaagtaagcaagtggaactacatcaaactaaaaagcttctgcacaaaaaagggacaaatcaacaaaatgcaaaagtagcctatggattaagagcacagatttgtgaattatatatctgataagaggttgatatcaaaaatatattagtaactaacacaatggcaaaaacacaaataatcagaataaaaatgggcagtgtacctgaatagacatttctacaaagaagacataaaaatgggcagtgtacctgaatagacatttctacaaagaagacataaaaatggcaaacacatatgtgaagaaaatgctcaaaatcacgaatcatcaggaaatgcaaatcaaaatcacaatgaagtatcacctcacacctgttaggatggagttttagtcctttctcgcattgctgtaaagaaatacctgagactaggtaattataaagagaaaagatttaattggctcacagttcttcagactgtacaggaagaatgatggtagcatctgcttggctgcttggggaagcctcaggaaacttacaatcatggcaaaaggtaaagggggagtaggcatgtcacatagtgaaagcaagagccagagagcgaggaggggggaggtgctacacacttttaagtgaccagatctcatgagaacttacttttttaaatgaccagacgtcatgaggatagtaccaagagggatgatgctaaaccatatatgagaaatccacccctatgattcaatcacctcccaccagaccccacctccaacactggggattacagttgaagatgtgatttgggtgaggacacagatccaaaccatatcagatggctaatgccaaaaaggcaagacatcaagtgttggtgagggtgtggagaaaaggaatccttcatacactgttgcagaaatgtaaattggtatagcaatcagggaacagtatggacattttttttcaaaaaaattaaaaatagaactaccatatgacccaacaattcctcttctgggtatacacctgaggaaatgaaatcagcacctcataaacatacatgtacccccatgttcattgaaacattatttacaatagccaagatataaaaacaaactaaatgtccattggcaaatggctgaataaagataaatatatagatatggagatcataatagcatttaactttaaaaagaagaagaacaaaatcctgccatttacaagctagatgcagctagaggacattatattaagcaaaataagccacagaaagaaaaatgctgcatgataaatcttataagtgaaaacacacacacacaaaaaaagtcaaacacatagaaacagaagagggcagtggtcactagatggaagtggggaaatgggaagatgtaggtcaaaggttgcaaaatagcagctagtaggatgaataaatctagagatctaaagtacagcatgaggactataattaataatatattgtatactggaaactttctaaggggtagattttaggtgctcttattgaaaaaaggaaactatgtgaggtgatggatatgctaaattgttaacctgtaccaagcatttcactgtgtatatatctatgaaaacatcattttatacaccttaactttacatggtaaaataatagtaacaaaactataaaacacttatagcagtgcctggaacatagtgaatagtcagtgcatatgagttgtttttgttattttctcaagttcttctctctgcctgaaatgcctttctccccatacccaaacatgcaaaagacctacctgcaatgtaacctcctccacaaaatcgttcctgattccccacatctcctcacctaatcatcatcagagatatattttctctcttctttgaaattatgtcaaataatccctttgaacttattatggacaaccaaagcatccacacacatttccaaattcccctgtgggggatctactgctctttgttaagaaccactgagaagagaactaagtgagtgttcagtaaatacatgttcattgattgttgcccagagtaggcatgaaaattcacaataagcaatcattgatttaccttttaagtaccactttgtcaaaatgaggtgaaaccaataagtctacattcaagtctacacaggtttatgattcttaccttgaagagtatgggtcaagccacttatgtcctacataattcatatattatttctaattagattttttccatatttcactggcagatagtgagcaatgcaaagtacaaagcacttccacaaattttgtggcaagacagactgaattgcctaatagggtgtgaagcacagctacatagaagatatatgaagcatattatcattgggagtaagcacagctccattgatttcatgaaacaaaacaaaattaaattgcatagaaactcaaagacatggtaaatatgggttttgagtctaatagacctgagtttgaaacctggctctattatttactagttttctagctgtgtggccttagactaacttcctcacctgtgaattgagtgtaatataccagactcaaagtgttacacaaagcttgcactgtgaagtgtgtggaatattaaccttgggtgcacaatataggaggcaccaaagaacttagtaatcaagacaaataatattatatttcaatctttttttaaaaaaaaatcaaatttaatgcagaactccacaaagcagaaaacatcaatttttaaaataaagacaagatcaaattctgcatgtggatgacttggcttcccttggccctctctaatcctggccctgaatgttaaggaagttaaacaaggtaataagtgaagtaactttggcgtagtccttgccttgaatattcagttataaactatgacattgaggaaatggccctttagtcttggtaaaaaaaaatccatagtgaataatgttcaaatacaaagaaacctaatctatttattgctctttgtttttaattcttaattacatacatagtatataagtatattattggtaaggttagcacccctttaaaactagaatttttctaagcatttatatgcataggtatatatgtatagaatacatatgatagtaatttttttctttttttatgaaactggtatcttgatatacaaacatatctacaagttggcttttgtttcattcaacactatgccttatcaatgcctcatcattgtaaattattgcatagagtttcataatatggatatactgcagtttgttcatttagtccccccgttgatatttatttagagttgtttacagtttatcaatattatacacagtgcttcagtgaacatttttatacctgcacgtagttttttttctaatttagctactgagaagtagaattgctgaattttataggatatgaaccctgatttcatttaaattgttaatgtttaactgccttagtggccattccaattgatggtcccactagaagggcatgacagtacttgttttaccacaccaccattgacatattatatcaaacgaattcattatttattaatcttaactatcaattaataatgagtatttaataatttaattaataatgaataatatttaatgaaataattataattaatcatttttataaataaatttataaaaacaccaataaacttcttataaataattttataaatattttataaagaatttataatttagttaatttgattaataatatttgataatagaatatttaattaatttaattgataatgaataatatttatataggtatatctacacatagttttagccattttctaatttagctactaagaagtagaattgctggattttataggatatgaacactgatttcatttaaatttttagtgtttaattgccttaatgaccattccaattgatggttccactagaagggtaagacagtacatgttttaccactctcattaacatatgatatcatcaaactaattcattatttgccaatctgaatgaaatctgatggtttaaaatgttatttcattgctgttcttttcgcattttcttacttgagaatgggcatctttttaatatatttatggggcatttgtatatcctgttctatgaagtgcattttcatatattttgtccatatgtacattaggtaattttgttttttttaaattgaattccaggagttagttatgtattatggatactaatatgttatctggtatattgcaaataatttaacttactatacctagtctactgctttttgtttagagtatcttgtcatagaggagtttaaaattttgaggaagttaaatttaacgatctgaatacatcatcaatatatttgtccagaagtgcccaatgctcacctccttcacaaagaaggaccaaaacaagtagataacagcaaattgagtagaatgtctgtgagagtacactggaattcagcaagaaaatgacagactctctgagacacaaaagcttgagatggcagcatacagacagaaatgaagcacccagccaggattcgcttggagccatgatagactcccctccctattatagggaaaaagtaagcaagaggctctcagcagcgcctattgccgctgtggatgcctgcaatcctagctaaaggggaactccacaatcctccaagctgtgaggtaagtataggcagctgccttaagtccatgtagctacattgcttcagggaaggacttcacattaagtcccctctcagccccttgggagctaggctactatggcatggcaccattttgagagaggagccactaccagaccacattcttccctgtactttaatagcccatgcatcaccacatcctgtgacccctcaattatcacactgagcccacacagaaggctgcaacaccacaacaccacctggacccagcagtacagccataattctggcacacaagcccacatagcatcctataccccaagtagaacgtaatccagcatagcagggaggctgcccacagtaccaagggagcccatgtgtgcactccctagaagctgagggcttgcctgccaggtgcctgcttccatcaccactccccctcctccagcgcagagctgctgtgtgccacatgagctccctagtgaccaatgactggctcatccaatgtccactactgctactgaacctagcacctccagtggtaaagtttctgcatactgcacaaactccccaaggaccaataattgatccttctgacctaccactactggcaaccccaccccctacagcagcagagacactgcacctaccaccactggcaaccccaccccctacagcagcagagacactgcactctgtgcatgtcccccagtgaccaagcactagctcacatggcaccctgtagaaagactttctgaatttaaaattaggtcttttaaaataaaccagtaagaaaaaaaaaaagaataagaaagaattaagaaagcctcctggacagataggacaccattaagtgcacaaatttttgcattatgaaaagtccagaagatgaagacatggggaaaggcataaaaaacccattcaatgaaatgatagtttaatacatgataagtctaaggcaagatgtgaatattcagatcaagggggctcaaaaattcccaaatagattcaaccaaaacaggtcttctaagcactttatactcaaatgtcaaaaatcagagacaaagagagaaatataaaaagagcaagagaaaagtgtcaagtcatatataaggaaattcccatcagactaactagaaattttttagcagaaaacttggaggccagaagagaaaggggtgatatatttaaagtaccaaaagaaaaaaaaaaaaacctgttagccagtagcactatacccagcaaagctatcctgcaaaaattaagaaataaagtatttctcagacaagcaaaaaatgagggaattcatcaccactatactaggcctacaagaaatgctttaaagacccctacatctggaagcaaaatgatgagaactaccattatgaaagcatgtgaacatatacaactcactgatagagcagatacacatatgagaaagaaaaaaaggaataaaaaattatcactaaagaaaaccaccaatccacaaagataaataagagagtaagaaaggaacgaaagaaatgcaaaacaaccagaaaaaagtagcaaaatggcaagagtaaatcatcacttattaataataacactgaatgtaaatatattaaatccccaattaaaagatgtagactgactgaatggatccaaaaaaaaaaaaaagacaagacccagtcatatgacacctataagaaattcacttaaccagtaaaggcacacatacactgaaagtgaagggatgtaacatgatattttacaaaaatggaaaccaaaaatgagcaggagtagctatatttacataagataaaatagactttaagtcaaaaactgttaaaacaaccatacaaggtcattacataatgaaaaaaggatcaattcagcaagaatgtatcacaattataagtatgtatgccctcaacaccagagcacccagatatcaaaagcaaatattattagatataaagagagaggcagaacccaatataataatagttgaggacttcaacaacccattctgagcattggacagatctagatagaaaatcaacaaagagacatcagtcttaaattacaatatagaccaaatggatctaacagacatttacagaacattaacagatacagaatacatattcttcttatcagaacatgtaacattatccagtatagaccatatgttagaccacaatacaaattttttaaaattgaaatcacaagtttcttttcaggccacaatggaataaagctagaaataactaacaagaaaaactttggaaattgtataaacaaatagaaattaaacagtattctacttaacaacattgagtcaatgaaaatatttagaaggatgtaaaaatgcattgaaacaaatataaatagaaacacagcatattaaaacctatgggatatagtgaaaactactaagagggaagttcataagaataaacacctacatgaaaaaaaagtagaaagatttcaaataaacaaccctacaatgcacctcaaggaaccagacaagcaataacaaacacaattcaaaattagtagaagaaaataaataatatcagaacagaaataaacaaaatagatacgtaaaaaacaatacaaaatattaacaacctgaaaagtttttctttcaaaacatgaacaaaatcaacaaaccattagctagactaagaaaaaaagagagaagacacaaataaataaaaaatgaaaaataaggcattaaaacttataccacacaaatgcaaaagattattagcaacaattatcaacagcaatatgtcaacaagttgacaaacctagaggacatggattaattcctggacacatacaacatactaagattgaaccaggaagaaataggaaacctgaacagaacaataaagagcaaaaagaccaaatcagtgattaaaaagaagtatgccaaaaaaaaaagaaaagcccagaaccaggtggctttactgctgaattttaccaaactttcatagaggaacatctgttcttctcaaactattccaaagcatttaagggaattattccaaactcattttatgaagccagcattactctgaaaccaaaaccagacaaggacgcatgcacacacacacaaagaaaaccacaagccaatactacagatgagcatacaagcaaaaatccccaaatacaagcacaccaaatccaatagcacatcaaaaagcctataaagaagacatggtcacaaagatggttcagcataacaattcaataaatgttatatgttcctttgacagaatgaagaacaaaaaccatatgatcacctcagtaggtgcagaaaaagcatttgataaaatttgacatgtcttcatgataaaaaaaaacactccctacaaagtatgcatagaaagaatgcacctcaatacaataaaggccatatatgacaaacctacccctaacatcataaatgagacaaggatatccactttcaacactcttattcagtatatttttggaagtcctacccagagcaattaggcaagagaaagaaagaaagggcatccaaataggaaaggagcaaaatcaaattgtaccagtttgcagttgacatgatcttatacatatataaatacctaaggactccaccaaaaaaaacttttagaattgatagacaaattcagtaaaattgcaggatacaatatcaacttacaaaaatcaatatcatttctatacaccaataatgaactagcaggaaaagaaattaagaaagcaattcaatttacaagagctaaaaaataaaacacttgggaataaatttaacaaaggaggtgaaagttctctgcaataaaaccttcaaaacactgatgaatgaaatcgaagaatacacaaaaaatgaaaagtcatcttatattcatggaattagaagaatcaatactgttaaaataatgtactacccaaaataatctatagattcaatacaatccctatcaaaataccaatgaagttcttcacagaaatattttttaaaattgtaacatttgtttggaaccagaaaagaccccaaatagccaaagcaatcttgaacaaaaagaacaaagttggaggcagtgcactacctgaattcaaattatgccacaaagctatagtaaccaaaacagcatggtgccagcataaaaacagacacatagacaaatagaacagaatggagaacttagaagcaaatccatgtatttacagccaaatgattttcaatagaggtgccaaggaacatacattggggaaagacagtctcttcaataaatggtgatggaaaaactgtatattcatatgcagaaagatgaaactcaacctctatctttcaccaaatacaaaaataatctcaaaatagattaaagacaaacatcaaacttcaaaccataaaacgactagaaaaatgcatagaggaaatacctcaggacattggtctgagaacaaaagcaaaattaggtaaatgagattataccaaattaaaaagctgcacagcaaatgaaacaattaatagaatgaagagacaacttgcaaaatggggagaaatatttgcacaccattaacctgacaagtaattaatatgcagaatatacaaagaactcaaaacttagcacagaaaccaataattccattaaaaatgggctaatgatctgaatagacatttctcaaaagaagacacacaaatggccagccagtatatgaaaaagcgctcaacatcactgatcatcaagggaatgcgaagcaaaaccacaataagatatcatctcactctagttggaatggctattatcaaaaagagtaaaagaataaatgcttgtgaggatgtggagaaaaaggaacactatacactgagggtgggaatctaattagtaaagccattatggagaacagtatggaggttcctcagaaaaattaaaaatagaaccactatataattcatcaattcccctacaggatatatatccaaaggaaaggaaatcaatgtatcaaagagatatttacacccccatgtttattgcagcacaattcacaataaccaagatattgcatcaacgttaagtgtccaacaacatatgaatagataatatcacatatatacagaaaagaatctattctgccataaaaagaattatatcttgtcatttgcggctacatggatgtaactggagataaatatgtcaagtgaaataagccaggcacagaaatataaatacagtatgttctcactcatatgtggaagttaaaataattgatttcctacaagtagagagtagaatagtagttactagaggcttggaagggtataagggagagctgaatagggaaaggttggttaaagcatacaaacctacaactatataggagaaataaagttctaatgtttcatatttttgaaatagctgtgtatttactccatattttgaaatagctagaaaagaggagtttgaatgtttctagcacaaaaaatgataaaagtttgaggtgatggatatgctaattatcctgatttgatcattgcacattgtgtgtaccaaaatatcactctgtactccataaatgtacaattatttgtcaatttaaaaaagtgatcaatatttttattgaagtattttttcacttgttttaaaaaaagctttgtcccctactaaaaagccatacagatagtttaatcagttctatttttatgcaataatattttatgattcatttttaagaatcagtttggctttttttaatggtacgtggtatggattgtttttgctttttttcatttatttcataacaaatggtcaattgtatcagcattctttaattgaaatttctgctttccaatacattaaattctaatgtatatatgtgtctgttttggaactctgttatgtttcattgatatatttgtctatttctatgccagcaccatgttcttttaattatgataactttatagtatgttagttttgcttatgagcgtcagatagtttttcacaaagaaagtgactcttgaccaggtattaaaagatgcatggacattcagcagacaaaaaaaaaaaaaaaaaaaaaaaaaaaaggaaataaggcattccagttagaagaaacatgggccaatacacagaggtatgaaatcaattgtatggcatatttaaggactctcagctgtgttgtatcactagaggacagttcttatagtagtccagggtgggttttgagggcagagaagaagattggggcatattatataagggtctttcattgctttgtttaaaagattctggaattattcttgaagcagaggagagttactgaaggcttttgagtaggggaataatataatcagctgtctttggcagaagtgtgaagatggtataaagagcttatggaactgctgtaggtattcagagaaagaagagagctctgcaatctggattagtcagaagaagctttataagggaactgctaaactgtgaaggaatgataggatgggttaatttaagggaatactctgattcatgggttcaggaggagaaacctcttatatgtttatttaatttatatttgtattattttttatcttatattttttaagaatcaggtgagttaaaataaatccgatattcattaggtgcagatatcttcccatgtaatttaattcaagccaaggtagtctttgttacaaaatggtgcaatgtggctcttttaagtaatcaagctttaaaatgtcaaataaagatttttcattcaccaaaagaaagcaattctgagagaatttttaaaaccattaaggacagacatacctttagtttaaaaggcagcttggaaactcatagtgaaggaaagagtaagtgggcaagcaaagcagaacttcaagttaaaacctaggcagaaattaaatattttatccaacaaaaaagcagagagtatatgtttgtgacttcactgttactcacttttagtaaagagcaagaaagtgtcaatggaacattttaaaccatgaaatgtaattgttttaaaactgtgattaatctgggatagataaaaccagagttctttttaaaatgattggacagcctgttgagagaaataggatacataaagcacaaattagaaaaccttcacagatatctgttgtttcccacttgttctatgtggaattgcatggctaacctaattatttactaactttaagtaatttattatacttaaaataactttaaagataaatattagtgagcatatagtgtggactgtaccagttttttcttggtttgtctatgtctaagaaaatccaaactgccatgcctgctattctagcttgatgattcaccacaaattacacggtggcaacttccggaaataaaggcagagttcagtagggacaaactcaactcctctctaggatctgttcttaaacttcatcccctgaaacatgggagaatttcacaccccttgtgccataatctctttgtgagtaaactgctattttgagccactgcttaaaatgggttggttctttatgctcaaaatattttaaagattttagaaagaaaaaaaaatatgggaaagaagcctgatggtgaactctcttttaaatcagttaattgtagggagcaaatagcttatgcagaaattacaagtttttaagcaaggagataaatattgggtaatattattcattaaaagaggtatttggggatgaagaaaacattctggaaatggatagtgatgatagtcatacaacattgtgaatgtacttaatgggcgctgaattgtacacttaaaatggttacaatggtaaattttgtgttatctatattttacaattaaaaaaatagtgcatgagagagagagagagagttggggtaattatagagagtttcctcaaaggagatattttcctcatagaaaaatacatcctatatatttccatctttgttaagttttagtttttcctttttaagtgcatggaacctgagtatggcgaagatgtttctgtcccatcctcagtccaggaaaaataccagaagtttaaactgaagtgaaaaagcctgtgagtcaggaatagatacggttttatcagagaataattatagttagcgagtgagtgatgaagaggtttcagtgcctaaagtgaccagcctcatgccaagctctgatgccccacactctcaatcagagccaacagatcaggcaggcaacaaacagcacttgtgcccaggccaagacctagggcaaattttcaaagctggtatgattcaaagtgagttccaattagattggggatctgattaagctaattagaatagataacagtctaatttattgcagtaggtgttcattttacttcaggtattttttgccttatgatgttttctttgatagattcattccatctagccatcaaattcatggagttatttttaatagagaatatatgtgaacagaaaagaggctgtctgcttgcctgtgtctcccatttgagaatatctcttactgggaaatgtaaagctaccatccgtaggtgtaacagccaagaatgcatatccatctttatgcattaagtacttccctagttggcgggttggatttggtttttaggatagaagattgattcttggaaaccatttcaataacagtgacttattttgttcacttattttactgagccagagtttccttcaatcagggtatcttttaaagccattttctctttacaaaatttgtaaagtcattcattaatgaagtatactttatatacaaggaaatatacattttaagtgtacagattgatgaggttggacaaatgtaactcataaaactaccaaccaaattaaggttgaaacatttcctttgtgcccctctgtaggcaatccccagcacctcccccatccttgccccaggcaaccactgagttttttcttgctatctttttaaaatatagatttgttttgtatataagtcatgcactatataacaatgattcaatcagtgacagaccacatgtacaacagttgttccataagattataacaaagctgaaaaattcctattgcctagtcacatcacagccatcgtaaaatcatagcataacatattactcatatgtttgtggtgatactgttgtaaacaaaccgactgtgctaccagtcatataaaaatatagcatatacaatcatgtatagtatatactacttgataatgataataaacaactatgttactgtttcttgtatttacttattctatacttttaattgttattttggcgtgtactcctaatacacaaaaaacggttaattgtaaaaacagcctcaggcaggtctttctggaggtatttcataagaaggcattgttatcataagaagtgaaatcttcacatgtgttgttgcacttgaagaccttccagtgggataagatgtggaggtggaaggcagtaatattgattatcctgaccataatcctgtgtagacctaggctaatatgtgtgtttgtgtcttcgtttttaacaaaaaagtttaaaagttaaaaaacaactaaaaatttgaaaacagaaagaagcttatagaatgaggatataaacaatgaaaatatttttgtacagctatacaatgtgtttacattttaagctaagtgttattacaaaaaagtcaaataatttaaaaattttataaaataaaaaagttatagtaagctatggttaatttactgttaaataatttttttaatgaatttagtgtaccctaagtatacagtgttcataaagtctatagaagtatacaataatgttgtaggctttcacatttactgaccactctgtgacacatccaagacaacttgctctatttaagctctattcatggtaaatgccctatacaggtgtaccattttttatcttttatgtcatatttttactttaccttttctgtttatatatacaaatatttgcaattggtgttacaattgcctacagtattcagtacagtaatatgctgtataggtttgtagcttaggagcaataggctgtacagtatggcttaggtatatagtagtctatacaatctaggtgtgtgtaagtaccctctgaaattcccagacaaaatcacctaacaactcatttctcagaacatatccccatcattaagcaacacataactgtattttagaccttcatgtacatggaatcttgtagaatattctccttagtgtttggcttattttgctcagcataaagtctgaactttatccatgtttttgtgtgtatcagcagcttttctttttttatcatggtgtgactataacacagattttatcagtttaacagcttatgggcatttgggtattctctagtttgggtctattataattatgtggctatgagcctttgcatacaagtctttctgtgggcatatgttattatatttcttgggtaaataccaagagtggaatttcttggtcatataggtatagttacctttataagaaacaaccaaacattgttttttgtttgtttgtttgtttgtttgttttttgtttttaagacagggtctcgctctgtcacccaggctggaatgtgatgttgtgatcatggctctctgcagcctcaaccacccagactcaattgattctcctcccttaggctctgagtcgttgggactacaggtgcatgccaccatgcttagctaattttttttattttttggagagacagagttttgccaagttgcctaggctggttttgaactcctggtctcaagtgatccactgctttggcctcccaaagtgctgggattacaggtgcaagccactgtgcctggcctaaccaaactgttttaaaacatagttgtggaaggggtggagcaaggtagccaaatagatggctccaccaattgtccctccttcaaggacactaatttaacatttgtctacacacagaaaaagcaccttcataaaaaacaaaaatcaagtgagtacttacagtacctgcttttaacttcatatctctgaaagaggcgctggaagaaggcaggaaagacggtcttgaatcattgatgccacccctcccccatcccctgacagcagtcatgtggcatgcacttgaaagtgcaggaattgtgagacattggattgaactcagtgctgccctgtctcggcagaaagcaaaacgaggctgaactctgctaatgccctcccatggagggaacatttaaaccagcctttgctagaggggaatcacccatcccagtggttagaacttgagctttggcaagcctcgccaccatgggctaaagtgctctggggctctaaataagcttaaaaggcagtctaggccacctggactgcaactcgtaggcaagttctagtgctgaatggagctcagatctaggcatcttgggggccaggagagctattgagataccagccaaggtggctaagagagtgcttataccacccctacccaaaccccaggctgaacagcttgtggctccaaaaaagataccttttgactacttgaggagaggagaaggaagagtgaagaggactttgtcttccatcttggataccggctcagccacagcagggtagggcccatttccaggccatctctcctggacaacatttctagacacactctgagccagaagagaacccagtgccttgaagggaaggacacggtccaggtaggacctatcactggctgactaaaaagccgttaggccctgaataatcagcagcgatatccagttagtatgccatgggccttcagtgagactctgagactagctggcttcaagtgagattcagcatattcgcagctggggtggttatgggaagagactctttatgcttggaaaaagttgaggaaaagtaaagggcactttgtcttgcaccttagataccacctcagccacagtgggatagagcaccaagtgggcacttagggttcctggtttatggttccagaccttggctcttggatggcattgctagacctgctgtgggccagaggggagaccaaggccctaaagggagagtcccaggccaggccccatccaccacaagctcattaaagagtcctcgggccttaagggaacattggcagtagcctcgtagtactctccatgggcctgtggtggtggtagccatggggtgaaactcctttgcctgcagaaaggggagggaagagtaggaaggactgtgtctcaaggtttgagtgcgacctcatctgcagtaaatagaacaacagacagacttctgaggttttttactccggttcctggcttctgaatgacacctctgggcatgcatggggcctgggagagctttgccaccctgacaggaataacaaaagcctggctaccttgaccacctttctgataatcaaattcagtcaagttgcaggatacaaaatcaacatgcaaaaatcagtagcatttctacataccaacagcaaataatctgaaaaagaaaccaagaaagtaatcccatttacaatagcaaacaataaaactaaatacctaggagtaaatttaacaaaagaatgaaatatctctgtaatggaaactataaaacattgatgcaagaagttgaagaggacacacaaaaaaagaaggatattccatgtttatggattgaaagactcgatgttgttaaaatgtctatactacccaaagcaatctacaaatttaacacaaactctttgaaaataccaatgacattcttcacagaaatagaaaagaaaattataaaatgtatataaaaccataaaaggtccagaatagtcaaaactatcataatgcaggagtcacattatctgattttaatttataattcagaactatagtaatcaaaacaggatggtactggcataaaaacggacccatagatcagtggaccagaatagaggacccagaaatttacatccacacatctaaatccatacatctacagtgaactcaatttggacttaggtgccaagaacctaccatggggaaagggcagtctcttcaataaatgatactgggaaacataaatgttcatatgcagaaggaagaaactggacccatatctctctccttatacaaaaatcaaataaaactggattaaagacttaaatcgaaggtctcaactttaaaactactaaaaggaaacattagagaaactctaggacatgggaataggcaaagatttcttgagtaataccccacaaacacaggcaactaaagcaaaaatggacaaatggtatcacatcaagttaaaaaacttcggcacagcaaaagaaacaatcaacaaagtgaagagacagcacgtagaatgggagaaaatatttgcaaactacccatctgacaagggattaataaccataatatataaggagcccaaacaattctatagaaaaaaaatctaataatctgactaaaattggacaaaagatatgaatacacatttctcaaaagaagatatacaaatggcacatgggtatatgaaaagctgcttagcatcattgattatcagaggaatgcatatcagaactacaataagatatcatctcaccccagttaaaatgacttttatccaaaagacagccaataacaaatgctggcgaggacacggaggaaaaggaactctcgtccactgttggtgggaatgtacattagtacaaccactatgaagaacagtttgggggtttctcaataagctaaaaatagagctaccatatgatccaacaatcccactgctgtgtacagaaccaagagaaataaaatcagtatatcaaagaggtatctgcactcccatgtttataatagcactattcacaatggccaagatttggaagcaacctaagtgtccatcaacagataaattaataaagaaaatgtggtacatatatacaatgaaatactcttcagccatcaaaaataatgagatcttgttatttgcaccaacatagatataactggatgtcattatgttaagtgaaataagccaggcacaaaaagattcactttgcatgtgttcacttatttgtgggagctaaacatcaaaacagctggacttatagagctagagggtggaaggatggtcaccagagtctgagaaacgtagtgaggggttggagggatggctaatggatacaaaaatagtttaaaataataaataagacctagtatttgctagcacaacagggtgactgtagtaaaaaaataatttagttgtatatttaaaaataactaaaagagtatcgttggattgtttgtaatgcaaaggataaatgcttgaggggatggataccccattctccatgatgtgattattatgcattgcatgcctgtatcaaaacatctcatgtagtccaaaatatatgcacctactatgtacccacaaaaattaaaattaaattaaaagtgaaaaaagcacatgaaacactttaaaaagcacaactggaatacaaatggaagattatataactatatcttatcaatgttaaattcaatgaagttgataacagtactgcaatcacataagagaatattctcattcttaagaaatacatactaaagtctttaggagctaaaagccttggtgaatgaaatattctcaaatggttcaggcaaaaataatatgcatgagcaagagtgcgaatgatgaagcaaaaaggataaaatgctagcaatagattaatatggatcaggagtatatgggtgttcttggtactatttttattattttcaacttatttgtaaagtttaaaattatttctaaatagaaagtaaaaataattcacataattttaccattttataattccaccagcagtggatgagaattacagttgctctacttccctaccaacacttggtatgatcaatgttttaaattttagccattataaatgtgtaaagtggtatgtcattgtggttttaatttgcatttctctgatgactaatgaagttgagcatctttcatgtgcttcttaggcatccctatatcttcttttgtaaaatatacatacaagtcttttttcccatttttattgggtgattttctttttattatgttgaaggggtttgttatgtatacttaatgacagttttttgtcaaatatgggtgtggcagatattttgtcctgatctacggctttccttttcatcttcacaatattgtcttttgaataatagaaatttttactttcgataaagtccagtttatcaattttctttttatgatccaaattttttggctctaagaaattatgttaagaaataataatgtcattattattattatgttgagttattaagagaatggacttgagagttactcagatctgagttctagtgacacaaccacttaatctagtggcactaccgtgaccctgggcaagtgacctaacatctttgtttctcagtttccccatacataaaatggggataattttattacctaccttccagaactgctttgaggaacaaactagataacatacatacaatacttaatgatgttcttggtacatagcaaacacttattaaacagtagctgctgttacttgcaaatgtttgtctttgggaccttatctttctaaaatctcctctctttttagctctcccaacttactcaggcaaccaagaaaatttctctacagatattgaatggccaactcgatgagggaattgtaacgaaatgattctaacatactttgaattttaacgagctactcaagatgatactcccctgaaaagaagggagagcatatgggccagtgaacagagccctgagtggccactgacaacctcaagcagcagctactcaattctggggacttgcttctttggtcccagggcatcacataactcataggataccatcaagccccatttcttcagacatggtttcctgtatttgattttgggtcttattctactctaagacattttccttattatttttaatatcctctcaaattcagaaagctcttactttcctgaccttgtcataattaacaatagctatttcttgcttatgagttgttacctacaatttcacataatttttctgacaggctgacaggctgactaattaacaaggtttgaccaccctctcaaatcagttggcaaggctttgggctttgacactgaaaaagttctttgaagcttagttaccattcttacctgctatatgtgaataataaatgcagagttgctgcatgtagaagtttgtcttcatcatgtgcttcagcattcaaagatatcttgacgctctctttaagggattatctgacagggattagatgcaattttaactcctgtcccatagataaacacctacttagagcattatcattaaataattttcacaaagaacaagtaatttttaaaagatactattcaaaacatattattaaccagagaagtctttccaagaaggccttaacctgattatttggagaccacattttcttaatgtatgtgtccattttacccacacttccagtaataaagatactcgctctctgtatctctctctctctcactcacacacacacacacacacacacacaatcacatgcacacattatacacccttaggcagaaagaacaagcagagggaaaaaagagtatatgagtcttcagttctcatcatttagctcccacacagaggggaacaacagacactggggtatattgcagggtggagtgtaggaggagggagaacatcaggaaaaataactaatgggcactaggcttaaaacctgtgtgatgaaataatctgtacaacaaacccccatgacacaagtttacctatataacaaacctgtgcatgtacccctaaacttaaaataaaagttaaatttaaaaaaaaaaaggtttcagttaagaagtatggttggaaatgaagttttctgctcaactcaactatctggttagggaggtagtgaagcatagcagaaagaatactggagtttagagtcaaaacagaggattaagttccctttacaccagttactatatgtgtgaccttgagtcataatctctctgattcacaatttcctcatgtgaaaaatcagtatagaaatgcttatgttacagagccattgaaataattggaataaaaccataaaatctttgtaaaatctaagtgtcctgtgacatttaaatattctataattctgtaagggaatatcagagaattataaatttatgtcctggaactacccaggtaagagctttcaattaggatatctgttgttatgagcacagagttgcgcgatccagattccccttcaacaaaagacttattgtccctgttactggaagtgtggtaagcagatagccttcagctttaacctcctgagactgcttcacctgcacaagagctgccttatgctcttcccatggaggtataagggaggaaaaataattttctctttaccctctagagttcttagtcgggacagactcctgtaatgaaagacagattaacaaaaggaaagcaaacacaagtttattaacttatacatttcatgtatacatgagaaaaaaaaagcagagaaattagtaaattttaaagagttgtcttagacctaaggcttaaatacagcagttctctgaaacagggaaaaaagggtatggaaaaggcctggttaagaccagaaggccaaataaaaaaaaaaaaaaagcactgttaaataaaggtaagattgattatgcggatttgagtccatgccttctccactgatcaagagtctctagtgatttggtcatccctttcttcttggcacaaagagggagacaccattacaaaataagatttcctttatagatgtaaatttctcttacaaaatggtaactttgcagagcttctcctgtgtctgcagtttctgaaaataaccagctcaataatccttatgcaaaagaggcataatttggagtggcatattctggtctccaacagttatattttgggatggcatgtccttaaccctatcagaggcccacatttaatacgtgattgaggccaagatatgaaggcccagcataaaagcagggagaaaagttaaggtgctccagtagttgtccaggagagagatgatggacacttggcctagaatagtgccagttgagacagagaaaaataggtacatatattgagaatatgctttggatgtagattcaataggactctaggatgagagaaagaatggagtaaatgatatgccataggtttttggcaaggtatgtagtgaagattttttttaggccatattaattttgagatgcctaatagacatctaggtagaaatttaaaggagataggtagatatatgaggttggaactcagaggagaaataagggcaaaaatgtagatttaggaataatctgtatgaggacatgggactagatgagatcatgtccctagaatatgggaagccagttctttgtcacttagttatggagaacagtgtttgttaatttcactcctataatagtgtaggagtcaacacttcattgactgtatgacttaaatccagcaaccagaccatttagaaagagtcctcattaaaatgaagggatttttggttgtgctattgcatactttaacctaataattacagagttcctactatgtgctaaggaatttgtatgcattatattatctttaatccttaacacatgtaaatgaacactactattatcctgatgtcacagatgaagaaaccaaggttcagggaagtgaagcaattttctccagattacacagttagtaaattatggagttgatttcctccacgtttaacctccacttgcagtgcatgataatacccagtaatagcagccattaatggatcacctagtaggtccaagtcctgagataaagtgctttatatggcttatctcattctaataaaaatctacttattatccctattttacagatgataaaacctgtccttagagatgctaagtaacttagccaaaatcttatagctcgtgagtgacagagtggggtttcaaatacacatttgtctgaatcaagaactttcatctcctctggccttagctgagtagaaaaggaaaaaaaattcccctagaaggtgatataaatctccccaaatgacaagcagatggaaagcataacattaaaaatgattggtattaagaaaataaatttcattggaaataagaagttcaaggtgattattaaaaatcaacaagacattgggaaagcatcttttgaattactttttaaagcggtcatctttaaataagcaatggtaaaaatatgaatctaatcttgcttctaaatctaaatgttttgtgaccatgaagcagagtgaacatcaccaaccaacataagattggacccatggccttggcttctgaggacagaattctcaagcacttagtggacttgaagattcttctcttagtcatgagaagcccaggagatgttctaaagctgaggagatttatttgattggttcctatatccctcaacataacatcaacatataagtatacctgtagtttctcttcttctatcactcattctttcggctcccaaggaagaggtttataaacatgtcataaatatatctaatcttaacaggcattatccacaacatgttaacagttgctctggagacaccaaattgtttttggacattttgaaagaggcttgtgtgtagaacttactgtggacaaatttatctctggaggtttttaagatatttaattgatctgcttgattttctccaacacttagcacagagtctgaaacttactagacacaattatttgttgatttaataaatgagacttcaatatctcaaggcaaaacagtgttcagtagtgtgaattttaaggcattgcgacaagcttgttgtttttaaaccagatatttctccttgatgtagtgaggccgtcctctggaataaggctcaagcccaaggtaaaacaaatcttattgcctgtgatcctttcaaaaacacagttctgaaaggctcagtacagaatttggtgaatattgaatagatgaaaataaagtctaaagcttttcacaaggcaggcatgtgttagtcaaaagggaagggggatatgtatagaatctgtatctacttggttttgttattttaagctgttgccagtcactgattttaggtgtttgacttaaaatattttaagggagtgtgaatactgagctatgattatttccccagagaggagaaagcctttattctctgtagctattactgtacacctcaggtactagtgatggggacattaagctgacccatgtgtgtagctcaccacattccctcagggtaatgctacgaagatacatctaaatattacttctcacctaaatgtgtgtgtgtgtatatggggggatggggaagtaacgatggttcagttcagtggcacttactcctcttctgtcatcactatcaagtaaattgaaatgctcctagtatgtatactttgagagtgctccagattggaagatgccatttgactcatttcaagtcacctgcctttttaatcatacgacaattataccaaatttgacattagcatgacaattaaatgttttaaagtatttaggagctttatatttatattaaatatgtattcagtagaagcacaataaataaggttcatttttataagctgaattaaaagtcaataaaaataataataataataataataataataataatagaagcatcagagactgcctaggattttcaaactaccagttcagccaaacatcatgtcctgtcggcaagtgtacatctaagtacataggagttgtcagacaggagctagaatgtgtttctcagcaggaatttttctgtcttctgtcattttcattctgggtgttataaatggtatgtgttgttgtatttcagttattatctttcaattatagagtctgagagtacataggattctttgaggttatctcttccagcttctctcccaataaagttatccttttaataatattcacagcagccatttagactgaatgtgtccagtgacaggaacctcattcttaaaaagcagactgttctgttgttgaaaagtgctgagtttcagaaaaggtgtttgacttaaagtatttctgtgttaggtaaaatctctttccttataattaaccatcgctaatgtatttactctcttgagtcatattgggtaaatctaatccttttctacatgatgactatagacatttttgaatacatctaccactgtccacccaccaatgaccaacctcacccccactaatctcttctcaagttttaaaacctctagttccctcatctgtttgtctgtccctcatgtgagtctgttttaaaaccttctgtctttgtgactacatagacctagttcaagtactggttgcttatgatgtgacctgtaaaatgggggaagttatttcaacctcatgagatcttatgagaattaaattgacagataatcctttttttaatattattggtcaaacattattctatgtgtcttacacatattaactcatttaattttaataacagtcctatgaggtagttgctattattattttcccaatttatacacaagaatattgaggcaataaacatttattcaaggtcacataactaattggtggcagagtaaggatttgaacccaggcagtctggctctagagtcttgacctttaatcactatgctgtactacctttattaagtgaggtaacacacacacacacgtatatatatatacatatataaatgcatatatttggaaaatggaaaaactgttttaaaaaatcctaaatttttaatttaggcctgatactacagatgtaatcaaataatcttagaggggcagtttttttcagttctgggaccaggtttcatttggacactttgtagactagatgaatctaagtaaatccttctgtctgtgatgcccacatgaagatcctcccctaagatatagtgacccattcatttatccaacatttattgagcactactacaaattaggcacagtgtcatctgttgtggactagatgtatgcaagtaaatcctcttgtctttgatggccacatgaaggaccttccctaagttatagtgacccattcatttatccaacatttatttgagcactgctaaaaattaggcatggtgtcatctgttgtggatacaatagatcatgaccaaacagatatagctcctgtcttcatggagcctagaatccaggtgaaagacagacattaaacaaataaacacaacaatacacgtatgattactaatagtaaggcattttgaaggaaaataataggatgtaataagaaacaatagcacagggaagttattctaaaattgggccagtgggtggctaaggaaaagcttgtccatggaaataaatcagagactcaaagggtgaattgaagttagccaaggaaaatgttgggatacagcattcgagaaggatttaaaaatattttgaaggccctgaagagaagaagaactttacctggtcaaggacctaaaagaaaaagaaggccattgtggctgagaaatagtgaaggggaaccagaatgactctaaatgaagttggaagattaggctggagctacatagcaccaggcgattgtgctgaactgatgctgctattaggagtcagcagaacaatgttgcagaattgtagttggtgttttggatggtatcttgagaggaggcagctcaaaagcatacagcaaggagactccagagactccaccagttgctgttataactcacctgaggcttatatactaacatgcaattagcctataaatactgataaaaccttcttattaatatcaccactaacctgttatctacatctacaactcccacctcaggttaccattttgtgcctagtttgtgccctcgcatcttccccagatattgtttataatcagagatcatctatacataagtattgaagaaaaggctattcagtgtgatttgcacaagtagcattcacccctagatatgggactggaatctatatactgagagtagggttggtaattattatagccacgtgccgccttttttctgccagtaacgataacatcaagcctcaaagttgagctctggagtcacactgacatggcatgatttcataactatggattaactctgctactaattatctgtgaccttaaacaaataagttaacctctcagccttagtttctgcatttgaaatgtgaaactaatgatacttatctaaaaagatggttgtgagaattaaattaagatacttaatatgtgggaaagaacctgacacaatgcctgatgggcagtagatactaaataaatgataaatttatttctttatgatatacaacagagtgtttcttttctacaaagtcaccatagggtgatccttcacatccaaatttatttcatttatgttatattatacttggacatagatatattgtttgggttttactaacctcaattctacagtatttttatggaaccatagtactagcatctgaaaggagccttagaaaactatttttatcctcatccttttagtagaaatagtgataaaggttcctaatcctgaaacatatacaacacatgcagacattcattcatacaggtagcaaaatgctaattaatctctttgtgccacgttctgtgctaggtcctggagatacagatattactaagcataatccatatccgcaagaagttcattgcccaaagggtatgacagatatgtgtggaactaactatattaaaagacaggctcaggtgtttggtgggagcacagaggaagaaatgaaatctgcctgtggatgtggtcacaacaactagcccttttattatgtgtatctgactttagtatgtatgctaacatttccagactcacttgcttcacagcaacttaaaacttgcattttatcttctaactgctgaactcattcttatttggagcttatttttctcagaacaatcaatcaagtctttccttactatccactctgtgctagggcttgtgagggataaaggagaagcagattatttgtccccaccctcaaggtgcctgaagtccagacagttgagagtgaaaagacccccaacaataaactactatttactacagagctgcctctgaatatgttcagagaagagagctcagggtgagttggaagaattagaaaaaaaaaaatcaatgttccggcagattcaaacagcagttcaggcttttaaaaactgcctacatacaaatatttagagattcatttaaatattctccactgcataataactcaaaagagaaaaacaagttcagtgtaacagtatctctcccaatgcttgttaatctgaatttatagcacattgatctaggagtgccttatttaaattctgttaaaaatcttagttgtaatattcctagctggtccaaagacagggtaggctaagcatgtattagtgaagacaatagacaaacagattctcaaagctgtatacatttcagcataggaggaacctgacataagaaaaaaacagggatgcaatgaaattctttgaagccttgctttttgttagatgaacctttgaaaagggtgttttgaatttttgaggtgcacacacattttatgtcagagaaatatcacaggaaggtatgtttggaaagaagctgatggggagtgagaaatgaggattgctgctgtaaggcattaatgagttggaagaaggtcaacaacccattttgaagtaaatctattatctgagttcagaatggtcccaggaggaacttgtactgacacacccaaaattccctctctagcctagagagatggaaaacagaggaagataaatctgatggtggttttccgggtacttcttactcctaagtatgatgaatggaagttttagaccctttggtttgtatggaagattttaaatataaacatggtcaatggcaaatgtgcttagaggtgataagtttatttttaaaatttttatagatttagtgggtacaagtgcaattttgttacatggatatattgtgtaatggtgaagtctgggattttagtgtaaccatcacccaaatagtgtacatcgtaaaaaggtgataatttttattagatttcaaaaaaacataaataattgaaaagttatccaagctagtcatttaaaatccattgagatattattttctacctttccttaaaattagtcctatctccttggcctagcatttctccaacttcagtgtacatcagaaacacctggagaaattgtatagcctgcagattcttgctcccccctcagagattctgattcagttggtatgtggtgtggcccagggatctgcaggtcaggaaaacctagtgcaataataacaggaaaaaagcttttcatttcatcttaaaaactgtatttattattgtctgtaatggaattgaattaaaaagcaaactggtcctatattttaaaaggctttctttctttagtaggagcttacatggcctttggaaaatcttataactgcaatttgggccagacttgcatttattgctttatcaaacaacaaaacaataactaattattatatagttcataatggcttatatttaaatattatcttctaatgaatatccttcttttattatgattatagatttatttcccaattcagaaaaagcgttatccattttacaaatataactctattacaagtagaattaaaaaatacagagaagttaagtgattagcctaaagtcacacaggaaccaccaaagagagaaggtgagaatctatattttcggaatcacaatgcagtattctgttaggcaacgctgctttcaaactagaaaatatagatgggagtttttaggaattgacatttgagccacagatactaaactgtttccctacctcactctgccaactttcatttccccttatccctacctaccctacctcatctacttcatcctgaagttcctttcccatagttacatatgttccttaagaatttatgttgttactaaaaatttgtgaaatgtcagaaagttgatctcttaatgccatgaagttgtgctgatcaccatttgatatcagatctattcctggccctaatgaatacagttttatcttatcattttgtgacttgggtgtgaataggcccaaaggtgtgcactgagcactgagcatgcatcccaggatcccactcataattaaagaagctaggtggcttcacaaagtcagctttctttggccattctacatatggcaggttcaggaatggcacctaaattgctgaaaccatcgagtacagaatctctgtgaaagtttactttctctgttcaggccagaccatgtcagcagaattcctttattttgctgcagtttgtgtgtctggggagggaggaggtgggatgaggtggggatgggaggagtattctccaggtgctaagtgtgccttttgctccttttgcaaatagacttgcaggctgccctgggggagctgcttttatgccatggtgcattggtattgtacccatttcattttttttctttttctttttttattatactttaagttttagggtacatgtgcacaacgtgcaggttagttaaatatgttcaaaaatgaagagacccagcttgcttaccatagctcaaaaaagagattagtcaatgaagcttgggaaaatcatgacttgccaaatccttcctaacttttacagtctgctgtctgctgtgtatgttgtctagataccaaatagacaggggcctttgtatccttggcatggctgttgttaaaagataattttacaaaaaaaaattgtaaaattaagactgtcatacagatataaaaatgaacaaacactaaagattttgtttaactcaataatgaggaaacgtgtggggtgttataaacagtcaaagggagaattcccaagaaaaaagaaagacacatttataaattagaaagattgaaatgaatgtggaaatggaagcacactggcttctttcaaagttgagcaggggaccacgcatggtggctcacgcctgtaatcccagtactttgggaggccaaggcaggtggatcacttgaggtcaggagttcaggagttcaaaactagcctggccaacatggcaaatccccatctctgctaaaaatagaaaaattagttgggcgtggtggcacactcttgtagtcccagctacttgggaggctgtagcaggtgaatcacttgtacccaggaggcaaaggatgcagtgagctgagattgtgccactgcactccagcctgggcaacagaatgagacttcatctcaaaaaaaaaaaaaagttgagcaggggtttgaacatttactggaagtttacatgtctgtggacaagaatcactctgcattgctctcagttttccacagtttagagagttgtaaaattgctcaaacacagtgaaagactagaatcagataacttgaagggttgtgatctaaaccatgtatagctttccattcaattttttttttctctacactacatttgggaaaacagcccaggtcttgatgagactaaccagtgggcttagaagcagtaggttccctgttgccaggtctccttgatccttgtatgcctgaactggccaacttagaaaaatgtttcttgagtcatgttttaggatgccttcagcctcctgtcaggctcttgtttttgtctttgatcctttgaaatggccatttggttctatgacagttgcaatgtgatggcaaggagacagaagaagagattagtgatgtagagatttcaaaaaaactccagaagttaaaaagtcccttcatctcattcagtttccactgcctattccctttcctcaaagaaagggagtaatccaaggtgctactctctcccattccatgaagccaacttgccacaacagtttgcttttgagttgatgaacttgctttcagtcttctatttgatatggtttcaatttttctcttctgtacatttcattcactgagcatgtacacagggatacacacaaaaaaacccacataaacacatgcatcatacacacaccacttaagaattaaatcttcatgttttcccccaaattatgtatccatctgttaaattattcatgctaaagaaacggagcagaggaatggctaatccaaaatgctagataatgcccaaatgatgtagtggactttggagtatgttttgtgtgtgtgctgatgtttgaaattagatgtgccttataaaagcaggcattggagtactggagaggaatgctttgagactgaaattatggtcctacttcaactaggtttgtgaccaagttgaattcagtttacctttcagcctcattttccaattctgtaaaatgagagatttgaacaaagtgatctctaaagcccccttcagctctgacaattccagaatattccagagattggctttaagccaacagtaaatcaaataagcaatccaaactcaaactcaaactcaaactcaaacccaaacccaaagggattttgggaagctattcagtttcccctcttggccctctgtttacctcttccctgtgaccttcctattgagagtaaatctctctaacattcaagtattcactcacacttttattcagtaatataaatggccaccatttattgagtacttactagtgcaggcaccctactaggcactgtatatgtattacttcaattatcacaacaaccccagaggtagataccattattcattcaattttatagatgcagaagtgaggctccaacatggcaaagagtttactcaaggaaacatagctagtaagcatcagtgctaagatgcaaattgagtctgtctggcttcaaattcagagcttttttttttttttttaactaaagggtgttgcttctccatataattatcagagttatgtgcaaacagtgaaaggcgctagggagaataaaatgttgaagattcgatctgtgcccttaaaggttttcaacaaagtggagaatggattattcatctgggtgttagggaaaaaaaatgaaaatggtctgaaaagtaagaattaattgtcaattgagtgaattaagtgtcaaaaaattgaaaggtgaagtatgagaagaataaatcacctaaaaaaaagaacagagatatcaagtatgacccattttattatcctatttattcacttctgttcaagtcagaggccctacttctgccataaattgctatgtgattttgggcaaaacctatttcttctctgggtctaggtttcctcattttttaagtgatgaggataactaaatggttgcaagttccctcgctgcgattccatgattatataataacttgaggctattttacattcaccactggaatttaagaatggaatctgaatgggaggatttcatgcaaggatctgatccaattgtggggtagaattccttaaagaaatgtgaatctccagaaaatcagccagggaatttgcatagcccttttgcacataaatctaattgtgatagggagaaaaaaaaatggtgcattccacaactatcctttgaaatgtgtctacggtatcctttaaaatgacacattataagttagggaacgttttcaggcaaataggagatgccagagaagtaaagatagatttagtcagtacatctggtacatctggtgaaatgaatagcccagccaaagggttaaagctgaatagcactaattgccgagaattcagattaggcatatttaatagatataaacaccccaaccatccatcatcccatctggtccttcttcatagaaaatggagagaaatggtgagggcatgctgccccgacagactctacttttctcagaacacaacccatctttctaccaggatcccctccattttcagaaacgaataaacaaacaaacccagactttgcgtctgcaaggggcaatatagtagcccagacacctattgactggaaatgtagcctctttataaaaggcaagatggcctggcaccattcaagcttcaatgccttatgaaatgagaaggtaagatccggtctcagtgcaagatttggcacttccatggccttcacattgtgataggcaggagtgataggaaagaattcaagcatatcaaaaatccttgtcctttttccttccttcagttgccttagcacgaaaccacaactaatctacctgtggactctggcttttgacttaacgaatccagcagttttaaaatcagtgtggatattaattaaagaagggagacaacccaaagtttaggtccccagaacagtcttccctcttcctcattagtgctccctcaccccctcctcttttgtatcttactcttctctttgattctcatacaatctttcctttgtcttcccttactctccccagtcctctcttattcctttcccttttttttttcttttctgcctatgccttaagcctgtctgaactcactatggcttaactcggctgacagccacaaaaaactaaagaagacaccggaccctgaccttcaggatggtcccatgtgatcctcataaactctctgagatgaaagtccctgcaacatgcttttatattctccactgaatctagggctggatactgtgcaaatggtcaataaactctttttagttaaatgtaatgggtgaatcactcttctaggcttccatatgtttctgggaataagacattttgtctttcgacagctgacagagtttgacattgacatggggactcagaatttggcctgcttgagagaccatagattttttaaatgttcctcttctatcagtattgaatgagatttgttgacagcatcaagaggaaagtcaaagttgtcattttttattgaaggtggtggagcaagaagttggaggaacttattctattaacaattcttggcagcaatcactcttctcttttgcccccatacagacgcctcacttttgggaaatgatttcaaatcttaaacaagatgttagctcagttttatttctgctgaatagaacagaagttttaatactagagttctgataggctgtgggctcttctaccctttcattataatgtactttcactgaggccatataatctaacttgtgtaaaacttgtcattattggggaattgactccaaatataacaaatcaagatggtcaacttgctcaactgggaaagtcaacatttaagacaaatctaatcatgcatgccagttctcaacgaggtgagtttcagccatacccagttgtgcaagttttacacaaaacccagtttatcttctttgctgcctagaggaaaggaatttggtaaagaactttttcttagtgctcatgtgtgaaggtacaccgtcaacacattaattcatttcactttcctcccagttagggaaacttcctctcccgcctctcagagagaaaagagaaatatgggctgtaggccaagcatgaagatagatcaagtgcattgagccttgagatgctgcttctacattcccatttttattgtttcattcgttggtaaacatttctttactgttatatagtcgtttagatcaagagatcttttagataaagggggcaaccaaaaactaatttagctaggttatgcagcatgttatgaacctattagagaatgaccatccataattccataagttcttacttaaggtgatttttgataatcgttctttgctctattttttcccaagggagatacaataaacccaaagtgataaaataattatcatctttgttgagtttgtctaattgcatactgatttcccacccttgtttattgatcttcaaagaatataaatacagaaacaactgcttgagtctcgaaaatttaaaaatgaaaggtcaacactaatagttctgttattgagccttatacctacttgacaacaggtttactagggtagaccttttatgtaggcagagcagttgacctatgcgatgtggacttaaaagccctaggaaagcttctttatcacttaagggttctcgcaccacttccactattggctaatgcttaaaatctcaccattaaagttttgattagtgtttatataatgtaatgcacatatatatacacacactcatgcacccactaaaactccctaagctgttcttagtgatttattccctaagtgtgaatgagaggtagatacttggttttggatttgagcctagggagaaaatatttggtgcccagcacctgaagaggctcacagaaggggttacatggagagatcagggggcaagtatatgaatacataaccaatacctttattttatgattttgcctagatttcactctaagaatgccaccaacagaagtcttttttactctgattttatttcctttccttcatcttctaatgttctccctgagagctaaggaaaaagactatgggcctcaactgagctcattttagggttgagagtgcgtcttctacttcccttatttgcctttcagtgtctacgtgtctgtacactgaaataaatcaattaatcatattgactgactttcctagttcaaaaagagaaagataagtgatagtatctgaaaagagtacaaaaaggaaaggtacattttcccattctaataatcaggcctacaattgctctcattaactctaagactaagccccctgcccacttacctccagtcaccacaatccctaagtaaacaatttgccatgagaaaccacacaaagaaatgccagaatctattcaaatgtagagagaaaatgttacaatgaagtaccttacattcttacactaatcactactgcttccttgggaaccaaataaaaaaggaaaaaaacaaagaaaaatgccaaaagggacaagcaggattgtccctttgtcaaataggatttgatgtacttaaattcaacaaaaacatattgagtccatacacagtcagataaagcagaaatggttcttgccctcatattctaatagttggagggggttaatgacagatgtcaagtatgtacataataatccttacaaaagttagagttgaaaatgcaataaaagaggcagaacttaattgctctggagttccaagtgaagaagttatgtcactagtagtcataatagtagtaacaacaacagtaattattactattatctattgaggcttatcatatgtcagatgccatgcaaagcacttttgtaagaattttcttatttaatttaatcctcatacaaacttgatccattagggatcatgattatcctcatgttctttatgaggaaactgaagctgagaaatttagtaactttcccatggtcacacagctagaaagtagtggaactagaattattccagagcttgtgttgataaagacttcacaaaagagacaacatttaagatggtctttgaagaatgtgttggattttaacaggaaaataaaaggaccaataccagcaaaaccgtataggttgtaaagcatatgtggcatgtttagaggattgcaaatggtatagtttccctggagcaaagcaaaatttgtggtgctagtgacagaaagagccaagtaaggaggaaaaccagtgtagaaggaaagacgatgagcatggctgacacatgcgataaccttgctcctgaatttcacaccaatattttcatcttcattgagaaagaacgaataggccaagaacagaattttaggacatgatcacactgatggggtaggaagaggaagagccatcagttatgtaaatgtaaacaaagcagttagaatattaagaagaccagaggttgacagtatggtgggtgccacggaaggtcagggtgccagaagaaggtgtttagttcctactttagtcaatgctataaaaattgaagagaatcaggatttatagtagattagcttgctaccagttattgatcactttctatgcttctggtactatgctaagcactttacaacagcaattgtctacctaaacttcagaaccacttgtgaggtagggactgttattttcccgattttaaagatgaggaaactgaaatttatagaacttaaaaaacttgatcaagacctcatagctagttaagaggcacagcctggacttaaacctaaatctgtttaactctgaagcttatgttcttaatctctaagatctatttccatttcatttttatttaccaggagttcacccttgagagagaggtttttggcagagtaataagggtaagagtcagagagcacagattgactagaagggagaggacagatattagaatgattgtgaaatgagtgggtggtaagacagtggaggttatggctatcaacttattctgtctatagtttagagggagtggcaaagaaaggtaaacaatgggagtgggtagcctgaggggacagaagagtcaagggaagtttcttttaataggggaggaatgaacctattgttgactgaagagtagccagtggagagggagaaagggcataatttatggaacaggaatgtggcagagaaaggaggaataagattcagaggacaagggggaaggttcaaattagaaagaagaaagacatttattaggtaacccatgttcttaaccttttctcctctccctgatctcatcaaaatgtgtctgattcagtaagcaccttagttgcctaagtataattacttattatacttggtatatattacatggactgttactcataaaaatataatatttaaaatgtgagatgactgaaacactaaatataattaattaggaattataagtaatgaatgaattaaggtgccagcgtattagataatgatataataaatatgttttatctctctgatagttgaattttcacagaaatgttggaaacagagaaaaaatttacaaccccccaccccaggtgacccttagatacagacagatgttagtgtgaaactgtcattcactcagcaaacatttactgaaagtcagctatatgccaggttctgtgctacacactggggatacagaaataaaggacagagttcacatccccaaagatctcacagcctagtggatgaggcagagaaatcaacacagtataatacagcttgatgaatgctgtgattgaggtaaaaaccatgaaacactgttgaactacataaggaggcagtgggcggggttcagggaaggcttcccaaaggaggtgatatttgagatgagttttgaccttctactgttgcttttatagggatctgcaaaaagggccaggaattcccccaggtgtcacattacaggcaacagctgcaactcactatcctggcttcatcctcagtgtctgacatcaaggtcactgagccaaaagtcttaggtgggggggagtatacaatggcactaagtctaacctctgggctattgggtcataggagaagatgagggctataggttccagattacaatctgaataaatagccttctcttttccagggttgggaaagtaagaaagtggaaagggaaagtggagaggagctagaagaaggaaggaaggaatagctacctctttattagatctttctgcctgctaggaagaaagccttctctctgcatatacaccactcatattgttttgtttcaatctttattcttgggtgtttttccacatgaaaagggcagtgaatatatctcacctcagtgcagagacatttagaaatgaaaaacaacttcaaccaagctctatttctccttctttgaaactggaagactgattgtaggtcagtttctattttatctgagccacttggcccatctggaatagtcactctaggaaatcgaaaactaaatttaaattttacagaggaaattttgaagtgactccctcaatctggtcagacacattctgttgcattcctctgtccaggcataacactgagcctctgacgaaaatctgaatgacaattgtctgttcttagtattaaattatttgccccccccatttccattaatttgcagactcaggcatactatagcaaagactcaacttgaactaattgccttttaaatttacctctcatgttcctttccttagcaaatgagaataaccatacattgaagcaggaaagactatggttagacataaggaaaaacaacctcaaccaagcgctatttctccttcccttgaagctggaagactgattgtaggtcagtttctattttatctgagccacttggcccatctggaatagtcactctaagaaatcaaaaactaaatttaaattttacagaggaaattttgaagtgactccctcaatctgatcagacacattctgttgcattcctctgtccaggcataacactgagcctctgacgaaaatctgaatgacagttgtctgttcttaatattaaattatttgccacaccccctcctcatttccattcatttgcagactcagacatactatagcaaagactcaacttgaacaaattgccttttaaatttacctctcatattcctttccttagcaaatgggaataaccatacattgaagcaggaaagactgcagttagacataaggaagagcatcatatagctacaacattgagactggcagtactagaagacattatggaacatttttaaagtttcttcttttctttttttttcttttttctttttttacttgtttgtttgatgttattcttgctgtttgggcagatgggttgttcataaaagaccacatgattattaaagacaatttgaaggggtaaagagaaagccatttatcctggatggtttaccagtctgaaggaggaagacaaccttttacctcaaaaattatatgattttactctctgattttcaggtgacctcaggtccacattagccctgcaatgcggaaagttttttcttgtaccagggacggactccttttagagattcctttaatggtgtggaagaatcataattctaatcaacatgaaagcatttgaaaggaaccactgcttcaaatatggctattcaagagaaaaggaaaaagaaggcattaaaattctaagaaattaaaactgttggagaaaattaaattgcaattgagttaaatcttgtgaaaaaaatgaaagaatttcagttttggtatcaggaattttgtacatttgtgggcaccatgtatggtgcagggtagatgttattctgaaaagaacagatttctttaattcatatgctgggattcacttgatccatctcaggcttttatgttgacctgggttatatttttttcttattcttttcccagaatcatccaggagttacgcccagtggaaaaagaatagagaaaaaattacattaatgatcaaattggtatttcatctctaaatcttaactggcacatagaatgtgtaataatttagccatagaggaactctaagtagaaatataagttctattaggggagccttaattttgttttttatgcgagtatttcccagttagtattaagttataaccactttggtattacatactaagacctagtatggatgttgtcaggtttgtgctgaggagaaaagtcagtaaatatttcaaatttaagtcactctgcatatctccatgccttatcaatttactatttgaaatcatttatttcttaaattgatcttataccattattgtataatttttaatccttacctaagagccatcaggaactcaccatattgcatgggacacaacctgctataactctccactgggcattttctgtacagagccaagctaaatcttgctctcgtgaaatcaggcacaagtaagatgtgaacatcggtgcagcattcagaatgtcaccattaaggtgatactgaaaagaaattctaaaagggtaagtaatagatgatctagtacacatctgaaagcagaggagctctgtgcttcgaattaaatataatactttataaaaatggagagcctaaaaaatgatgaacccttgtagaaaactggaattaattactctccataaaaggttttaattttataatttcatttacctttacagaaataatcgtcactcctcatctttattttagaataaccatccattctcaactttatttttactaactaaaatccccttattaggctactctccttacctttcctttcctccctgcaccaaaaaaagaaagaaaggaaaaaggaaacaaaaaacacattcacacaaaaaagccaaaagccatgcattttaaatacccaagacatgaagcctattggcagaaatgacaagtaccgtatggtctcctatttttcatggtcctctgtgaggtcattggtttctcattacagccagtcaagtcatgtcaaacttggagtctgcctcttaccattatttatattaatatctactaaagctccaaagatattctgtgaaaatccaaaactctacctatctgcatatctatctatctatctatctatttattattttttctatctaactgaagactataggaattgcttgtgttttttgaaatatataggagggaaatttagtagctgttactgttgctataactcatatctaaactcatttaggtttgtgttgggaatttgaattagagacaattcacttgaaaaaaaaatgaattagcaaaaaagttagtggcctggcttctcaggaatgcctaccatcagcagggaccagtcacacatttacttccaaacacctaccctaggacccttcttccatctctgtatgagccatgacaaaaattttcttgctatttcagtctattttctttcgtgtgggagctacaaataatgttgcaacaggctcaaaatacccacagccattgaggcccagttgcaagaggatcctctaggacagagttttgtgtttgaatattaaactgttgagatcgtttgttttcactgtgcacagatatgaccaaaaagactggggttgattaacaagctatttgcctaaaagtcccaaaagtttttaaaaactagtgcaagcattgatcattaaagtacacaaattatgtatgtgtgtgtatatatatatatatatatatatatatatatatatatacacacacatatacatatatatacacacacatatctatatatatagatatagatagatatagatatagatatagatatagatatagatatagatatagatatagatagagagagagaccgagagagagtgccaaacaggtttgcccatttgtgggttttcctctcctccagtaagtccaggctcttgtgtttcccaactaatctattaatggctggaactgattgacaactgcaacaaagccagtgtaagcactgtgggagtcctaattgggtagttctttataaagggaattgatgactgagtaaatatggtattgaaagtagatggtaaacatacaaaaaattaagcacaaattagctagatttagagtataaatacttacgattggaggacctgagaaaggttttgaaatttattcagcaaataaaaacgtgaggccattgggaaaatagattttcttgagttgatatgtcaacccacaaaagtacttaatttgtgcttgagggctttttattttattttattttatttttgcctggttagaatatgggatctaacaattcatttctaagtaaaatctatgagtttatttgttcattcatttattcactcagcaaattttctctatgccaggcactctgctaggtaaggggtacagagaagaataagatgtagcccttgtctggggagctcacatctattaatagtagaaaccagaaacatgactagacaatcttgatattcaacaatgactataactgacagcagatcctccataacacggggaaaggctggatacaggcagatttgttgggaggctacttcagtaatctagacaataagcaaagtgaatgtgaactaaggtaatgacagagataatggagagaggagtaacaaatatttgaattattatttaaaagaaataaaacctctagaatctaaggacttgatgatagaggtggagtgatgaggaaaaggaaagactccagaaggacttctgttgactgactgggacagcaaggtaattagaagatagttacatcaaccaagatgatatgtacagaaggaatatatttatacatattggtaatacctgattatttgttcatattttggttttgaggtgcttggtggatcacccatatatggacatccagtatgtaattgaaaacatgggtgtggagctcaagagaaaggcatggaccttgatgtttgactgtgatcctataactgatgtttacaaagcctatgcctctgctttcactttctgaccctttttgagtattgtccctttttaacctcgcaaggtttcttcaagttccttattccctcacggtattcactgactgcctagggatccctactgacgaagaagggcaaaacgtgttaccagatctctactcctaaatagcccccaatggtctggatccttttcccccatattccctgcacagccccccactcctgccctcactcctgccccatcaacatttacctatcctgcaactcattccctcacagccctgctaggtggttggctaatctaaataaattagtttatactcagacctaagtgaccaattctggttttgtgcatcatacttcccaagtaatatacagatgcaaagaatgtaggaattgcaagtggaattgtagaatatcagagaagcacttggtgtcaattgggttccttcagtgtttcttaaacaacatcattaaacatcattacacacatataattcagttatttaacaaccctacttttagacttttaatcaacctgaagtcttcgtttcaaatgaattatccctcaccaactgcatttccttccctcagacccacaacacataaccagcatttaattcctgatctctcttattcagctttgtaatttattgctattatttcccagtaaaaccctcattggcaatcaggcttcagggcgtccacaaagacgaatttctactctattcacttgtaactgcctgttaagcaatcagtgaatcctagaagatgagaaatggaattgaccacagaaggttatttaacccataccttcttgttagaaaagaaaaccaaaacccagagagatgacaggactgacccaagctcacacaactattcgtagctgattatagctggaacccaagtctcctgacacctaagccagttttcttcttactatgtaacaattgcttctgtgggcatgctgccatcatatgctttgctcaaaacatagtctccttacataccttagaattaattatcttgactgacaaagctctgtcctccataatttccctttgggcttttagaagcctcagcgtgcaaccaaatacaacttttgtgtttttcaaactgacttttcaatggataaatattcctctatgccaggtgtctcatctcttatcttggcaaggattccatgtaagctggcataactggtgtgggccctacagggctgaggtgggtgataggactgtctatcacctacagctgcaggtgtttgtaacggtgatggtgtgtacaaagttgaaagttgaaaattgtatacagagagctgaggtaaataaaccagagaaataagtctaaatagattgttgaataaaaaagtgcctaaggcaagcattagaaccagagtttagaaccatttggatctgaaagtcagaaaagagatctggttgaaacgggcaagcaggagagcaaagacccaaggcagaattctgttcctgaacctgggcttttgcatgttgcctttagcatattacagagatgatccagatccatttaaaggactagtgacagggacagaaacaataccacaggctgacagaaaacaagtcaaatgagtaccctccctggatcatgcttttggccctctgcttctttgcaagaatcagatgcaagctgatggtcccagaattttatctgctcaggcctagaataagtttcacaactggacaaagttttacacagtgtcagcggctgggcaagctcctgttggcactgttcatttgccacctttcatgtccagtcagtccttggcacctctgttgaaacccctcaagagagtgccatgtatgctggtgatctgatcccacccagtgggaacactttctgatgatgacttgtctgtctcatattgacattgttgtcttatggttcaatagcacatattaaagcaagcttttttttctttctttctttctttatttttgagacagagtctcactctgtccctcaggctggagtgcagtggcacgatctcggctcactgcaacctccgcctcccaggttcaagcgattctcatgcctcagcctcctgagtagctgggactacaggggcgtgccatcacgcctggctaattttttgtatttttagtagagacagggtttcaccgtgttagccaggatggtctcgatctcctgaccttatgatctgcctgcctcggtctcccaaattgctgggattacaggcgtgagccactgagtctggccaagagcacatgattttaaaatgtcagaactctcattacttgggttttggtgtttattttgatgagaaaatcaatattaagggtgtgtcaggcattagcaaggggaaaaaggtcatgaggatggcagctcagaagttgatctctctgatatcagagataagatttttaagacaatcaagatttccttttctcccaaacccccataaaattaaaagtaaaaattgataaataacatcataaggtttgtcaagcaagccacagcaacctcattcaggaatcgtttctgctaaattttctggtaaagaagtagggacaaaatgcccactaacttctaagtgaaagcaagaccctcatattgttctgtctgaactcctttttggctagtttctactgttattcttcaagttcttgttattttcttattttttttaattatactttaagttctggggtacatgtgcagaacgcgcaggtttgttacataggtatatatgtaccatggtggtttgctgcacccatcaacccatcatctacattaggtatttctcctaatgctatcccttccccagcctcccatgcccccccaacaggcctcggtgtgtgatgttcccctccctatgtccatgtgttctcattgttcaactcccacttatgagtgagaacatgcagcgtttggttttctgttcttgttttagtttgctgagaatgatggtttccagcttcatgttcctgcaaaggacatgaactcactgtttttttatggctgcatagtattccatggtgtatatgtgccacattttctttatccagtctatcattgatgggcatttgggttggttccaagtctttgctattgtgaacagtgcctcaagcaagcttttccatcacacctgtagcttcagaaacaattctcaggtttgatgtttgtgttttcagcactccttttctaggcagccatgcagcaagtcctgtgtcatttattctcatgacatgctggcaaatttctgtcctaaacgtcccatcatgctgtattttttccctctttgattgtgtagttcaaggctgccatatccctaggaagctttgtccaatgggcccagcctccaacctgccataacaatttccttctcccaatacactgtcattttgtattcctgggttgcttttgtgtatattttgaggagttgagtgtacttcctctaatcaaatagtaaaatctgtagtctttgatagcagggaccatgtctaatcttagctacgggccaaaagtctcaaatgcaatgtgatcagacaatatatgtaaataagtaatatgaatagtcttgataggtatggaaacaaaatagtgtggaggataaatgcatctgacagtatttggttcccatttgagttctgccatttattagctgtgtgaccttcctcaaggtagttgatatctctgaaggtttggttgcttcatctgaaaatggggtatatctattgctaccccacacagttttattaaacaagtttttaaaggtatctcaggtaaagtgcttttcacagtgcctgacacataatgagtattcaatacatggtagctaatattatggttggcatttatcaggttaattgcccaaacatgtgaattattatgtctgcggtcgctggcatgggtaatctgtggccttggcctgactcatcactcccaagatcattattacagttgtgctactatctccagcatatgttcaactttattctctctccccttgtgctctcccttgcccttctttacttcaagtttcccagacaccttgtctcccactccagattttttttcctatcatgcccatgacatggacctgatcccatactcggtacccagaagctttcctaagctgttctttttgctttagtggtgaacctggggttgaaggaagctcttcgttgtgttcagagctgcttagcactccagggtaaaggcagggttgtattacatgaagctgaaattacatcatagcaattggcgggagggcaagtgtgtgtgcatatgtgtgtctctgtctggatttgtgtgcattgatttgtcagtgattttgtgtagctttgtccaatagttcaaaccctgaggcttttcattctctgaagaggggctggattaggaagggcaaaggcttataattaatattctttttcttaatggttgtaatagcaattggctgtatttgccagttttgcttttttagagatagccgttttaggagccatttaaagaaattatcccatttttataaagtgtcatcaaaccatttatattactttgtgggaaggcagactgctgttggtcaagcctattgagtcaacatcaatcactgaatacctatttttttacctaatcaatcaggtgcagtggaagatataaaaacaggtaaggcaaaagccctaccttcaaaatagtttggttagtacaacgtggataagtgtactttctgaattaggtcaaaagcctcaaacccttaatctatcccagcctatatccccatgacagcaatgaaaatctgcctctcagttctcttactgtgaggagtgtacttgagtgacagccccagctgctaagttctgaatctgccactgcattaggggccatacttttcacagactgctcccagccagtgactaaggacactaggacaggcccatttctgggagatgcagtgttaccagccagcctttgctcccaaagctcccaagatggtggtgggccgctcccaagatggcggcaagccttttgttctctgacttggggttcttggcctcagggattccaaggaatggaaccttgggccatgcggtgagtgttatagctctattagaagccgtggctcacggaagagaactgtggaacccagcgactagtgtttagctcccgggcacttagctgcacaggaacaatagcaagcctctagcctgatcgggagtggcaatgagtgcctcgctggatcagaagcgtagcggacaccctgccagatccggaggggtggaagccagcgatgggtctgtgacaacagtgatcagcagtggtggacagcgagcgaaagctcagctggagccagaaaaaaacaaggaccagaagagtatgcagtttcaagatttaatagagtggaaacagagctcccatacaacgggaggggacctaaagggggttccctctaccggctcgaaatgcctgggtttatatcccgatcattgtccctccccctgtactctcaggcttagatgatttgattatttctttacctcctgcttttagcctaattggtattttagtgagctccctttactacctgatgcgtcaggtgtcagctgagttacaaaccccgtgtttaaaggtgggtgcagtcaccttcagcagctaggcttaggaattcttagcctaggaaatccagctagtcctgtctctcagcaggactcctctgatggatggcttttactctaggacttcccattggctttgccaaaactttttaagaattgttctgcagtttaagactcattaactaactctccattcttccctttctcctcaatagtcacaacagtatcacaatattttggctctgccaggctcctttgtctctctccccattttccctcacgggttctttagccctcagcaaatctcttgcaggtatgatcttgccatgacatctgcttgttagtggacttgaaccaatatatcatacaactctatactttgacttgccaatgttgcttggtcacaagttaaacctgatgagcagtccaatgactcagtagccatagcacaatgtaagaaaaagaacttgcaattattacttcagttctctaagcctttgctatatcttgcagtgttgttgggaagaattatgataatgtaggcaaaatctcaataacatggtaagaacttgatacgttcattcatattaatgagaagataactgtcctactaatggcagttcttatgaagcagcttcttaaatgaatgacagccttttctcattaagaaaactgctagataatatacaaaagggaatcaggaatttttctagtacccagaattgtattgttcttttatgatagaaatcatgagcagtagaacatgttcaatacaggggtctgggctcctggaaattctgcctgtggcttaacttgctaggaatatgtccagtttcttttctgcaggttgtctcaggctgatatggaattagaatttttaaaaacaagataaaaactgaaatagagagaaagaatgaatttcaagttctagatgcaacttaataatcaaatggatatgcttaactaccctcaacaacttcaccaggtctgtgatactacaagtaatcagcagagcacttcacaaagtgaagtgctttcttcacaaaaatagaaaagaaaggacagattctccttccctcagggctgcatcactattgcattgtagagtttgctatactaaggaagaagctgttaggtgtttaacgtagttggcactgagctattgtaatgtattctgttttccaaggcaacaaaactgtgattcttcctttggcaaaaggcacaggcaagctgatcactaatttcacttacttgccctagtgtagggaatttctgtgaagccactgaaaaggtcagggaaggaataacagggcaaggttaccagtgcactcaatcccaagtgtcagtgtggtcgcagagccctaggctgaaggcaaagaagaatacagtacacctagtggtccctgagggtaagaagagtctgtaggctatttaaagctggggttaaagcctttcagattgcctaagtaccattttctgtgttaatggtagatgataataggaagctacaactgaaagttagtgtacatccaatatgcaactgagggcactatatcattatttttaactttgtgctttgcatattttctatgtttctagataaaaagaaatgtgtcaagatttcgacaataaatttccataacatggtcacctttatcctctttctttagtctgccaatatattcactcagggcccaattctgttttccagaatttgttaattgaactaaatcctttagccagcatcagtcaagcaaaaagaggcaaatagagaaagactgctaaccatgacccacaggcaataaaagatcctaatgagccatttaaattgtcaagtaaagattacatgatgttcgctatagttttagcatttagtgtatttggtttctttccaacttcttgataaaacagttagtctattatggtatttctaatgactcacagttaactagagactttgattaaccagaatgactctattatttccaatactaaataatagtcactacaaacttgaaaacatattggccaggctcaaatcacaatgtaggtaacttctcaacaaatacttgagttgagtgcatatggaagctacagagaggcagaggtcagacccaaggagtgtaggaaatctgcctgtgggtagaaatggaaatgtttaaggagtggggcaaagaagctttgtcctctgtaaactacagaggaacattcctgtcatgtcaagggaaaggtcatatgctttctctggaatttcccataagacaagagattgaaagacatgtaacaggaaatataccgcacttaggggtgcaattgggcattgtcttcccaaggaggagagaaaagatatctcaagtcttctgaggtctttccatccttcagaaagtaaggaggaggagagaggtagtagggccaagcacgcagaacactggtaaaagaccagcattccgagtacagcagattatgatataggggctaataggagctgtcctcccctaattagtggtgttggtcaaggggcactctttaggccaagatttcttaacctcagcgctcttgacatttcaggctggacaattctttgctgtggagggccatcttgtgcactataggttgttttgcagcatcccaagctttgacccactgaatgctagtaacaccaatatccccagttatgacaaccaaaaatgactccagacattgccaaatggtctctggaagtcaaaattgcccctaacagagagccactggtttatagggacatttgaagacatacccttatggtaatggaggacgatggcactttcacagcgtggttgagttccagctattactctactagggaataagaccaaagttctttatgtgtttttgtttgtttgcttgtgaccagggttcctgggactcatattcttcaaatttttaccaaatcaaattggtggggctggggaaaatgcttgatattttttgaaaaatgtgacatttccccaaatcttctctttctagatatagcactgtacttctcttcttaaagaaacatggcattttaccttgaattggttatgactttctaaaccctctgacagttagtctttgtcccttacattttgggaaaatgttactttatcatttgaaggcctgggatttttccctctatcattagctctatttgggttactgaggagagctaggaaaggcaggttcagagttcaggaacataacctttgcctgaggctatgtaagttggtaaagcttcctgtgtcagtgacactttgagtaaattctccctttatgtaactatgcaatttacccatgaagacagaaaaaaaggttgatttttgtccacgtcagaaataattcttctgcacagttcaactccttagagaaatactgttttttaggttaagtaagattttccactggcatttgtcattgagaaaaggaaaagaagctagtttttaaaatattcttggccttaggaacctaggcggatatatgctcttttttaaaacagttagagctttaattgtgtgactatttggcatgaaagacagcaaggctgtttttcttattataaagctatcccacacagacatgataaacagcaggaaaatcagccgaagaatgaaaaccaaggggaattaagattgttcagcccatagaagagctggctaagaggtgacttagtaatggtcttctaggacctgaaagacaatcattaggaccagatgctccacatctgcagagagggtggagacacaggaaatgacactatagcaggagaaagcttaaggaagaatttcctggcaatgaaggatgtcaaacatcaagaatacattactttagagattatacaattacctctgggctgttttacattttggtttcaaacaggatagattctgtcttgtgtgagatggctgaggtgaggttttgcatgaagatcaagagaatggacaaaatgatatctcaagattcttcttagttctataattctgtgaaatctgtatctttatatattatttgcactatgtcccccaaggtgctcattttacaatgtgctatttgcattatattttcacttaatggggtttcaatttctgttattcctagttatggaaatttattatgtgacttttgtaccctcttggattgttgaaaactgcaactctgcctcactgttcttctattttccaatactgtattttctccttttgttaattctctcacttttcagtcatgtgtttactcccctgtgaagacctcctgaaagcaggtgcacgctttgcacagtatttagcacaattagtgttttaagccaatttaataactaattattgttttataatttcaaaatgtaatgcagtatgagaaaatgtgatcccatacaatgatattctcatataatctataaacttttcacttgaccttcaccgagtatatgcctttagagccacatttgcagtgtctatgtcaaaataaccatttggttcagtaattttaaggcagggggtaggtggcttcagctagaaagagaaactgtcaatccacttaattggcaactttagattaaaattatcatttgattgcctgaatctttctttgtactaagttgtgttggctgacatgtaggtatgttatatgcctgtcttggtaaaagaacctacagatccatttgattctagcaagaacccatcaaatgccagaggctcctcactgcctaaacaaaattcttaattcatcaacctcacactcaaggttcttaatcttgacatgaaccttcctctgctattttgattcctcagaatgtgtcctcttttctaactaaactgttcctgtcatgttatgcttatcctaaaatccactgcttgctcagatgctttctattacctgaaaattaccatcctctccaattatccaatcttctttctcttcattttactgaaattattatcattgtcatcatagatactacttgttggtggctgaccacgttaagacactgtgataagccttcaaattcattatcgcacttagtatttgcaaggacactatgtgatacagattattgttcagagttcatttctaatagcttctcttccaagagaccttttttaaccagttgaactccagtaatgcccccttctctgaacggataatacttattatctttaccacttattaatcttacttcacagtttctctcataatattatttccatgagtaaactgtaagacttgaagggaagaactgtggcttatactaatttttatagtagtgtaaatgcaaaatatgtaataaacccacaataaacatagtactgtatggaaggatgaaaaaaaagatggacaagtggatgggaagggtgaccaggatcaggtcaagttacaccttgtggcatcaatggtatgttatcgcttcattaactaatatttattgggcatctactgtatacaaatactgtgctgtaatctatgagggataaaagagaaggggaaaatactgcttttgttcacaatatagataggaagacaaaacaaaagccaaacaaaccaaaagaaacaataccaacatggtgctgaactgagcagcatgatatagtaatggaatacggaaaatatagcttctgaaatccctaaaatatatcctcctttttcagtttccttaggaaatttcagttttcttcagaaacttgaatttcctcctttaattctgcacataaaaatgcatgagaatgtgacacatcaaaataagagaaagaatttgtgatgctgaaaaatggaacctcgacccattgtttggcatagtaatggcatcacagatgtattataaaattgaacatttctgaaactcaattagtgtaagaatccaggcaaagaaatttaaactatatctgatatagcaatgatattttatgcatctgagactgtgtggtcatttttcctccctcccttcttccctcccttcctccttccctcctttccttccttccttcctcccttcctttttttcttcctttcttccttcttgctgagactttttcttttaatgcagtagacagtagtgttattttttccctgtaagtagaacaattttaaaccctaggaaaaaagtgaaaaacatgttcccttcctcacactcaagcaagtattactcatatgaagtttaacttgaaggtatatctttaaaatttctcaagataaatactccttcctctcagagattaaattgttttgacttaaaagaaccagggccatccactgttttttgtgtatgtgtttttgcttgtacatatatttggcaggaggatcagtgaggaggctgagtatcagtcttctttataaactggttttgagtctcctttgtgattgtcaaagtatgtatacaaagtgtggttgtgtgtgtgtgtctgtgtatgtgcacacacacaaacacacacacacacgcacacaccctttatgttagagaattgaattgctacaagtaacatacttcaaaagtgcccaacttgatccaaggatgaaaaagaagccacagaaatctcaaaagcaagccctggagattccagcggcttggctgtgagttactcatactttgacctttgaggtgatggctgaaactgaatgcttaaatcttttaaactccacactccagaagaactttgtgaaatattgtaaactcctgtcaatatttctggaggccagcagaagatagaaattaggtctccctctcctctacccaaatggaggaataagagctaatttttcttttaggccacttagctcctctctaggtcaacactccataggctcaacttctacttttcttttatcccctttaatctcttaccttagcctgtgaaacatgaaggtttaaatctggattgatgagatgtttctttgatattttgaataaagtttataatcaatattcagtaataatatggattatggctatagtaatttgagaagttgctaagtggcttgccttcaaaactgtatcaaatatggtcctatttgactattttcagtcagaatattttaaattaaatatttaaaagtcctcagccttcctttctagtcctccattgcttgtgtgccagtatctattaccaaacaggctaaaaacatcttattttatttgcttttctgcaaataagctccattttaatactgcaaccaaagtcatgtttctggcatttattgacttcctgttttagaatagtttcccttctttgcttttcagaacacaccactatggctttcagatacacatcaacttgttctcctgtcatcagaatttgggctgaaagaaaatgaatttggaaaatctgtgagacctaggtacagatcactctccagtttaattctccctccctgctcttcccacttatcccattgacagacaatccctggagcaagggtaggcagaagcccccgggaagtgtgaatttttcaagaaattttagatttggttgaaatggtggaaaatcctcttgtggttctgagagtgaagattcttcaatatggccatgctggcttacaccttttcatttggtactttaaaactttggatgtttctttctgccgtaagcctaacataagtgatattaggtcatacacttgatctgttcctaaaaagtgtccaagtatcacttttctgtgctggaagcaaacatctatttgggctctaaatcaggacccaggcacaaagtaccaatctttagtctgtgacagtggaaacttatggggcaccccatctctcccaccatataacatctcatcccatctcatcccaacccatctcattctgtatacatatataatttctttaattacaaaataatcatttctatttctgaaattgttttctgtatttccaattatttagtgacttttggcttattaagctctgtaatctgttgctcttcttatgttccaatggacttgtttggctgcaaaaatgttataaacagtcttagcctattttgcaattatctgtattacttgaatgtcagagtacaagtaaaacacatttttgatgaagagaattcatttaacattttagccataaacctggatctttgaaaaagcatgaatcagacagtagaatgggtcacaattatatcactcttcattttggttttcagtccttctaaaagtgatattttgttgattaaggaattagaccattggcatcaacatggtatatctgacagcacccttcctttatcattgcagttatcaggttttcttgtctttgcttttatacattttttgtttaatttttgtgggtacataggaggtatgtatatttatggagtaaatgagatgtttttatacaggcatgcaatgtgaaataagtacatcatggaaaatgaggtatccatccccttatgcacttatcctttgagttacaaataatccaattacactctgtaagttattttaaaatgtatggttaaattattattgactatattcaccctattgtgttatcaaacagtaggccttattcattctattttttggtacccatcaaccatccctacctccctcccaaccccccactactattctcagcctctggtaaccaaccttccattctctatgtccatgagttcgattgttttagttaacaggttcttgtcggaattgaaatattgggagattgtcatgtaccttttaattttaatttcccattttaaaaatcttttattgttgtagaggttagcaggtgatgggagaaaagagaagcaagtgagttctacatatgcatacccccattatttgtattatctttgttttggagtagatacatgaaaggaaaataattgccattgcataatagcaagtcttcatatcacaacctgtttggttatttttttttactactattcaacaagaaagaacatatttattgagcacgtattttgtgagaagtactacataatgtgctctaggagaccaaaaataactgagatacagactatatccctccaaagaatgtattgtccagtagttgtatcattttttagtacacactttacctttgttttattttcctgcaaagcaagagaccataagccctaaccaatcactcatttgggtacctgtcaagaagtggtatggtttctggaggactttgtggcaatatcttttgctcgagaggtcttttggttctcttctctcttttcacagggtgtacagttgacaaattttgcaaagaatatcacaggttcctctgtctctcaaatcaagagtcttggttttagctgcacaagaagcacatattctctgttctaaagaaagcaataactcattgttcagaatattgtttattctacttctgactttctctagactcatggatcacacataggttacatataactttccattaatatctttgaccatgacaaactattttagatttcttttacctttgcaaatagagtccatttcctccgtgtcacatttataggccctacaaaatctatgatcacactactactatgactctgactctgactactcctattactactactacatacacacgcatgaacacataccctgcacactcatgctattcctgaaaagagcatgaagatatatagtggtagaatgatgttatctgtgatgtcaaaataaaaaattgaggacatccctatatattcctagccatctttaatttattatgagcctgtcatttagaaatttattctaaattctccttgaacctaattgtacttgtactttcagccatttccatcagttggtatatcaaactctgtgtgtctactacctacagtgggaagtataagtgttctgtttaattttcataacattatttctaaggaaattcatctctttgggatgtctcagataatttggtgaccaactttgtgttttctcatccatctgtatcttgatattgtgaacatgtaccttactcagagctatactttcttagacttgagaggtatgtcttactttgcttctatctcccactagagagttcagcatgtagtggtgtactaaaagacctgaatcaacacagtcattatcattcttcttttgttgagatggagtttcgcccttgttgcccaggctggagtgcaatggcacgatcttggctcactgcaacctccgcctcccggttcaagcgattcttgtgcctcagcctcctgactacctgggattacaggcgcccacctccacacccggctaattttttgtatttttagtagagatggggtttcaccatgttggccaggctggtcttgaactcctgacctcaggtgatccacccacctcggcctcccaaagtgctgggattagaggcatcagccaccgcaaccagcctatcctcgttaatccaatggcctattatagtagctatctatcatgtttggaagcaccaaattaaaaaaaaaaaggactttctaaaatctacttaaatagatcacattctgattaataagattattataacatggctggccgactggaccttagagtataatactattagtctatgtgaactattaaagtacattaataatgtataagacccatccttctcacagaaagctgcatagactaagaagttagaaaaaaaaaataattaactcgcccctcctccagttacacacagttcagtgtggagagagtgactccatttgtttaggggaaagtaagggaagagaacaagagtctctgcttggtgatccagggaaatgcccaagaccacaaaagcaatacctccacaagtacgcaagagccacagtataactgggctttgggtgccccctaaagcagatatgactatagttacaaaaatcttgcattgcaacacccacatcctttaaatgcctggaaagctttctcaagaagggtggacacaaacaagctaagattgcaaacactaaaataaataactctttaatatccagacactgactaacatccacaagcatcaagaacccccagaggataggcacagtggctcacacctgtaatcccagcaatttgggaggccaaagcaggtggatcacttgaggccaggagttcaagaccagactggccaacagggtgaaacctgtctctactaaaaatacaaaaaaattgccgaggtgtggtgcctcacgcctgtaaccccagcactttgggaggtgggcagatcatgaggtcaggagttcgagaccagcctggccagcatggtgaaaccccatctgtactaaaaatacaaaaaaaaaaaaaattagccaggcatggtggcacgtgcctttagtcccagctacttgggaggctgaggcaggagaattgcttgaacttggcaggcggaggttgcagtgagccaaggtcacgccattgcactccagcctgggtgacagagcaagactccgtctcaaaaaaaaaaaaaaaaaaaattaggtgtggtggcacgtgcctatagtcccagctatgtgggcggctgaggcacgagaatcacatgaacctggtaagtagaggttgcggtgagctgagatcatgccattgtgctccagccggggcaacagagtgagactctgtctcaaaaaacaaaacaaaaagaaaacaaacaacagcaacaacaaaaaaccaccaacaccacccgggaacacataaactcaacaaatgcactaaataaggcaccaaagaccaatccaggagagacatagatagagacctttcagacggagaattcaaaataactgttttttgaatccaagataacacagagaaggaatgcagagtcctatcagataaacataacaaagagattgaagtaattaaaaagaatagggacgggcgcggtggctcaggcctgtaatcccagcactttgggaggccgaggcgggcggatcacgaggtcagcagatcgagaccatcctggctaaaacggtgaaaccccgtctctactaaaaatacaaaaaattagctgggcgtggtggcgggcgcctgtagtcccagccactcgggaggctgaggcaggagaatggcgtgaacccgggaggcagagcttgcagtgagccgagattgcaccactgcactccagcctgggcgacagagtgagactctgtctcaaaaaaaataaataaaataaaaaaaaataaataaaagaataaaaaaaattctggagctgaaaaatgtaattgacatacagaagaatgtatcacattctcttaacagcagagctgatcaagcagaagaaagatttagtgagcttgaagacaggctattcgaaaataaatactcaaaggagacaaaagaaaaagaataaaaaacaatgaagcatacctgcaagatgtagaaaatatcctcaaagggtaaatctaagacttattggccctaaagaggaaagagagagagatattggggtagaaagtttattcaaagatttaatgacagagaacttcccaaacctagaagaagatataaatattcaattacaaaaaggttatagaacaccaggtaggttgaacccaaagaagacacctcaaggcatttattaatcaaactcccaaaggtcaaggatgaagaaatgatcctaagagcagcaagagaaaagaaataacatgtaaaagagcttcagtatgttctggaatcagattctcagtggaaaccttacaggccaggagagagtggtatgatatatttcaagtgctaaagaaaaaaaactgtatcctagaatagtatatccagtgcaaatgtccttcaaacatgaaggattaatactttcccagacaaacaaaagctgagggatttcatcaccaccagacctatcctacaagaaatgctaaagagagttatttaatctgaaaggaaaggacattaacaagcaataaaaaatcatctgagggtacaaaactcactgctaatagtaagtacccagaaaaacacagaatattacaatgctggaattgtggtatgttaactactcatatcttgagtaggaagatgaaaagatgaagaaataaaaaaataataaccataacaactttccaagacatagtacagtaagatataaatagaaatttaaaaaagttaagaagcagagggacacagttaaagtgtagagtttttagtagttttcattttgcatgtttgtttatgcaaccagtgttaaatttttatcagttttaaataacagggtataagatatcatttgtgagactcatggtaacctcaaaacaacataaaacagatatataaaaaataaaaagcaataaattaaaacacatcactgaagaaaattgccttcactaaaaggaagacagaaaggaaggaaaaaaggaagagaagaccacgaaacaataaaaagacaaataacaaaatggcaggagtaaatccttacttatcaataataacattgaatgtaaatggactaaactctccaatcaaaagatgttcagtggttggatagatttaaaaaaaaacaagatccagtgatatattgcctacaagaaacacactttagctataaaaacacacaaagactaaaaataaagggatggagaaagatatttcatgccaatggaaaacaaaaaagagcaggagtagctatctttatatcagaaaaaatagatttcaagcaaaaattgtaagaagagacaagatcattatataatgataaaggagtcaattcagcaaggggatataacaattatatttgaacacaacaatggatatcccagatatgcaaagcaaatattactagagataaacagagatacagcctcatgcaataatatctggagacttcgacacatcactgtcagccttggacaggccttccagagagaaaatcaacaaagaaacattgaatttaatctgtactatagaccaaatgagtttactggatatttacagaacatttcatccaatggctgcagaatacaatttattatctgcagcacatagaccattctcaaggatagaccatatgttgagccaaaaaacaagtcttaaaacattcaaaaaagttgaaattatattcagaatcttttctgaccataatgggataaaactagaaatcaataacaagaggaatttggggaactataaaaatacatggaggctggtctgagaatctcaaatattgtagctgtctaatacttatcagtttctaatttctgtccgctgattcacagagtagcttactactttcaaaagagaaagagcttgaaagccattctgcattctttttctacttcccagttgacactggagttgctgcagagggttccctttaaaactagttaaaaagtattccataaaataaatgcaatatttttcatcttttctttcttttatttactaaagatacggacttactttcaaagtctattttcttctttactgcaaagtagatttggcaatcctgagctagatccattccattacaaacttcagataaaatggcagcaatagaaatagattattaaatcattagccagttgtctaattacactgtgaaatctaaagcatacctcctttattgtcactcacagaaactttccctatcttagcaaaatcttcaatcagtgtttatctctcattccttttcttctacactcttcctactttatcttccaccaaagccagaattttcactgctctcatgcttttttgtttctgtacatcagaagctcttccagtgatacttacagaatgctcatgcttatgagtgggaatagcatctgaaaagctttgttagcatgacatctctttatgagctgattccacatcttagacagaactctcagaatctccctttgtaaaatcttagatttttacactgacctttatgttatatggcttgtgttttgtgtacccaatctcttattggatgtgtgactaatgtgagtatcatcaactgatacaaggaaagatgcccaaaataaacaagttagccatggtagtgcttttgaaaaatatacacacattatttgaaactcctcccctcaagaagtggagactagttcctctctcttagagtatgggctgaccttaatgcacttctaacaaatagagtaaaacaaaggcaggtgtgtgtcaccttggcgattcgatcataaaaggtactgtgtcttcctcctcactggctctctctcaggtcgtttgcgcagagggaaatttacagccatgtcatgaggacatttaggtatcctatggagaggcctaccatggtgagaaactgaggcttcctgctaacagccatgtaagtgagccatcttgaagtggatcttgaagacctagtcaagacttcaacctcctaggagatactgaacagaaccagctaagccatacacaaatatctgacaaacagaaactgtgaaataataaatgttgattattttaagtcactaagttttagggtaatttgttacatagaaataggtaacaggatattcataggtttaacaattagcctatcacatctctcaaaaatggtaaaggggattttctatatgatacttacctatatagttgacccttaaaacaacatgtgtttgaactctgttggttcacttacatgtgggtctttctccacaaatatatcagaaaatttttggagagttgtgacaatttgtaaaaactaggagatgaattgcttaacctagaaatatcaaaacaataagaaaaagttatgtaatgaatgcacaaaatatatgtacatcctagtctactttatcatttacacaaatataatatacaaaagtatattacgaaaagttaaaattaaagacactgtatcaaaaaagtttaaatttatcaaaacttatacaaacacagatcatacatggtgccattcccagttgagagaaatgtaaacaaatataaatatgcagtatcaaactataactgcataaaattaactgtagtccatactatactactataataattttgtagctacctcctgttgttattgcagtgagctcaggtattgcgaatatccacttaaaatgctgtgtgctgccaatcatcttcatgtgagcaattcctctctcccgtaaattgagtatcacagaaaaaagtgacctctggtgttattcatgtagttttcattgattttagggcaataccataagctttggataataccatgagaacccatatgaattgccacaagtgatgctggaagtgtccccaagaagcagagaaaagtcttgacatgacaggaaaaagctgaattgcttgttatgtacgatagattgaggtctgcagctgcagttgcctgccatttcaaggtaaaagaatccagcttgaagattattgtaaaaaagaaaagaaaagaaaagaaaatttgtgaagccattgctgcagttaccaaaaatgttgcactttttgaaaaatgcctttttatttagtattgaaaatgcagcttttaggtaagtgcaggattgctataagaaaggcatacctataaaatctaacatgatttaagcaaaagtcaagtcaatatatgataacttaaaacaaaaggaagcatacaaagttgaagaatttaatgccagcaaaggatggtttggtaattttagaaagaggtttggctttaaaaatgtcaagataacaggagaagcagcttttgacaaccaaagaggcagcacaagtttccagatgccattaagaaaatcattgaggagaaaggatatcttcctgaacaggtttttaatgcaaatgaaagtgccatattctggggaaaagtgccacaaagaacatttgttggtaaggaagagaagcaagcaccaggattaaaggcaggaagagataggcgaattctactcttttgtgtaaatgcagtcaggtttatgataggattgctcctatttataaagctggtaacccctgaacctttaaaggaaaagataaacaccagttgccagtctgttgattgtacaacaagaaggcctggacaatcaatgagaacccttttcctggattgcttccatcgatgctgaagtcaagaagcaccttgtcagtaagagactgccttttaaagttcttttgatattgaacaatgcccctgactacccagatgcccctgtgagttcaacaccacaggcatcatagtggtctactttccccaaaacagaatgtctctaatctagcctctggatcagagggccataacaacctttaaggctgattacatacaatactctgtggaaaagattgtcaatgctatggaagaaaacctcctcaataaagagggtgtcagggaaatctggaaggatcacaccatttaagatgctgtctttgttatagaaaaaaccatgaaaacaatcaagcccaaaacaataaactcctgctggagaaaactgtgtccagatattgtgcataacttcacagaatttgtgagagaaccaatcaaggaaatgatgaacaagatttctctttcttatgattttcttaataacattttttctctagcttaaattatcagaatacagtatataatgcatgtagcatataaaatatgtgctaactgaataagtatgctactgataagggaccaggcaacagtaggctattagaagtaagttttagatgagtcaaaattatatgtggatttctacctgcgtgtgggcgggggattagcggccctaacccctgcattgttcaagggccaactgtagttgataatcagtcaagccatcaagcatagtggattttcatactttcacccttgtcttgaatagttatagcccaaggagctcagccttacataaaaggaaattttatgagcctttattttatgcgcgtgcgtgtgtgtgtgtgtgtgtgtgtgtgtgtgtgtgtaatttaagccaccttaacaaagcatcttattgtactgtttttcctcctatcatttgggaggacaaaaagacaacttacaggagaaaacctgttacctctttatggatggaattttaaaacacttgatcttttgaaaactatattcaccataatattatttaacattacttgtttttctgaaaaagacaaataacaagatattttctttcattttgacagattagaagagattaaatttcactgtaaattgtttgctgagtgactgaaataaaatattaattcactagctgagtatgtgtttattgaactggatttatctttttgtcctttcaatagtttttatttttgtttttttgtttttttgtttttttttttttgttgttgttgttgttgttgttttccgagatggagtctcgctctgtcgcccaggctggagtgcagtggtgcgatctcggctcactgcaagctctgtctcctgagttcatgccattctcctgcctcagcctcccgagtagctgggactacaggcgcccgccaccacgcccggctaattttttgtattttttgtagagacggggtttcaccgtcttaaccaggatggtctcgatctcctgacctcgtgatccgcctgtctcagcctcccaaagtgctgggattacaggcgtgagccaccgcgcccggccgtaatagtttttaaaaatgggtttttttttttttttgctgttttgagcaaacatgaagtacaaaatacagaaatttttactttccccaactcaaaaactaataaaaaacccacatagctttataatctattgcgggatctggccagcagcccacaatgcaacagggctctctctttgttcccaggtggataggcaggtcgagaaataatagacacacacaagatagtgaaagctgggtccaggggggtcactgccttctggtcccgtggtgccaacaatgcactgaatataccagcatttattattaagtttagtgagggcgggggtaggttagtgagggatttagtgtcatttgattatgaggtgagatggtcacatggggatgaagtaattctttaacataacatctgtatgcagaagtacagtatacagagaaaggaatttacaatatagtgtgtgcatcggtaatttctaacagagccgtaaaacagaaacacagtctttccataacctattattagcaagatattaatcagcagtaacagttgcagcaaaagctggttacaaacaatccatagaaacaggacttgaagctagacaaccagttagaccagaaattctcagaaggcagtatgccttaaccctaaagaagcctagaagagccgtggcaagatgagggcatttatagtcctatcttatccatatggacaggcgcccctcatgtgtccatttataggctctccacaagggtcgcattccattcccagagctatgaacatctgcttttctgggataggaatcttggtgatgtgaaacctccctgactgcacgtccattcataggctctctgtagggggaagcacatcacgcgctgttggctcattctggcagtccagcctggcattgtctttacacaatcctgcatgcaactttgtatttacaataatcaggagcatttcatcttttattccatagcaatagtttcagggggtctccctacatctcccccttttctctgatttaaatgaaccatagcaatcatagcttggcactgatcacgactggattgaagaatatttttttccaattttacatatgaacaataaaccaatagcacaaattatacacagaacaaaattaacgatagtggatcctcccaaagattttacccattgaatggggttgaggttagataacccctcagagataccgtctaaaacttcaggaccgggtaaagcagttaagtgtgcttgagaggcctcaaaaatctgttgttttagcttgcttatgtctaaacttaaattgtcttcacttctttgtaaatggcgttttactgattcccaattgtgaacagactcattatattgaaacagagttatacaaaaatcagaattattccaatcacattgcatttataatctatgttctaaactcaattctatctcccatccatataacagtttgtcttagatcattaatttgattggccaatttttgatcaatacctgactgagaattccacatccaagtagaatttttttgccatttatccacaaaatgaacagtttgaatagattgatgtaatgcaactccagcagtagcagcagtcacagtaacagcaatcaagcccattattactgcaattaatgtaaaaataaatcgtttactccttttaagagttttccgtagaatattattaataacatggatagaaggggaagattcccaaggcctgtgtaaggctacggggagccaaataccgtctctggctctgactattaaaatactatgatattgattaaaggatgagtcaatacaagtatacaagtaacaattaacacaggtaattatgttggtttttgaactaacatgcatctttcctataataacatatatggtgatttaacacaacttttaagtggtatagttttgttggactccatatagatagtatatatattttgggatggtactcctttttgtgaatatggggtggggggaatgggttgtatgagaggtggtggggggacattagaacgagggggtataagtccttataatctttactgtcccatctttgaattgaccttttgacaattgccatagtgatatttttggctgtatggaaatagtagtgtaaatcaatctgttgtcttagtttttgaggtgacaaggtggatttacttataacactttctccagcccaaactctcataccagtcatagctatggttaatctccataattctgaatgttcaggtcctaagtggggaacaacgagccttggctttggaggggcaacccctgcccctttccacttaagaggaaaaaaggagttaaatctacaatataataggggagggttgtcactacttttttgataagtaatatcatagagaaaatgttgacaatctctatgaccttgagagcaatcattagtaatatgacctttgggagcccaatcaacaatggtgtagtgagaagaattaaataacacagttccttctgaactaacacaatccttccatattaatttgccagcatttgaagacaagttgagaggacatgcaggtcctaaaggcttatattgggatgtgtgaatataatcagtgattcctgttttgatctgccttagaggttttaatgagagccctgataccaagtgtcctaaaggagggacagagtgaccagacggtagtgtgaccacccatgtttgaatatctaataagagacatccattagtgggtcccaggcacaaaggtggatacctaaaacctaaagcgatattgaaaggggttccttcttctgaaggttgggcaggacaaggatcatctacagaaccaggcatccaaataccgtcattaacatagacctcaaaaggagcatccatccatgtcatggctcgagtaagaggaggaaaaggaatataggcccaatatgtatagttttaacagtctgtggggttaaagagggtggaaggatctcattttaaaattatctaacattattttaatagcaagctgcagctcacaattagttgatctctttgtgatctttaccatgttttcaacaatatttaaataaaaataagattacttatttttgtgagttatgtggattccaaaataagttagagtaaaaagcagggtgggtgtttcttaaccttgtacaaaaaagcaataaaagatttcccatgttgattatttctcattcattacgctttctgggattcattggttcaagttttctccgtcttctgcacatgtgcttaatatccccaaaggatgtgaaaggggtaaacattttatattaattatgtatagaaaatcctggcttgtcccacccacaatttcaccttggtaccccatagccaaatacctgagacttcatttcttagaagataaactcaagcatcacattgtcctggtcttgcggcattcttctcttctttttccacccaaagcaatttttctaattaatttttaaattttgagatgaccattttacaatcacatgcaggtgtaataaataattcagaaagatcccatatactctttacccagttttccccagtggtaaactcttctggaactatagcacaatctgacaaccaagatactaacattgatacagtatcataacacagaacagttctatcctgacagaaatccttcatgttgcacttctatagtaacacccatttccctcccaccactatcccctatttaacttctggcaaccactaaacttctctccatttctgtaattacgttactttgagaatgttgaatttgtttatttttctaaaacttttacagtgctacattttacatttaagtcctcagtccattttgaattatttttattatataacttgtgagacttagttcacggttcattattttttgcctatggatgtccagtttttctagcaccatttgttgaaaagcctgtctttcctccattgaagtacttgaagtacttttacatttttgtaaaaaatcagctgggaatatttgtgtggctctatttctgggtttcctgtatatatatatatatatatatatatatatatatatatatatatctccaccagaccacacagtcttgatgactaaagctatataataaatcttgaaatcaaatggactgatttttcctacttttttttttttgcaatactgttttagctattctaagttctttgacttttcacataaatttagtgtaatcttgtctatatctttttttttttttgagacggagtctcgctctgtcacccaggctggagttcagtggcacgatctcggctcactgcaagctctgcctctcgggttcatgccattttcctgcctcagcctcctggtagctgggactgcaggagcccgccaccgcgcctggcaaattttttgtattttcagtagagacggggtttcacagtgttagccaggatggtctcgatctcctgatctcgtgatgcccccgcctcagcctcccaaagtgctgggattacaggcgtgagccaccgcgcccggccaatcttgtctatatctaaaaaaaaaaaatctaactggaatgttgatagtaatgcattaaaccattataacaatttggggtaaattgacatctgtactatgatgagtcatccaattcacgaacacactgtgtctatttatttagatcctttatgattcatttattcagtgttccatatttttgacatacaagtccagcacatgttttgttagatttacacctaagtactttattttttcaatgattgtaaatgacactatatttaaaatattttttggtgtgtgtgtgtgcgtgtatatatattatatatatataccatacatatatacataatatataatatataatatttattatttatttattttgagagagagtttcactctttcacccaggctggagtgcaactgtgtgatctcagctcactgcaacctccgcctcccaggttcaagtgattctcctgcctcagctcccgagtagctgggattacaggcacccaccaccacgccctgctaatttttgtatttttagtagagatggtgtttcgccatgtgggccaaggtgctctcaaactcctgacctcaggtgatccaccggccttggcctcccaaagggctaggattaaaggcatgagccaccacgcctggctggtttttatatttttaattggtgtctatgaattgattgcttagtttataaaaatacagttgattcttgtatgtttatattatatcctgaaacattgctaaacaactctcttattctaggagttgctttttatttttttatagattccctaggattttcaacatagacattatgtcatctggaaatagaggcagttttatttctttatttccagtttgcatgtcttttattttattgttttgctttattgcactggctagaacttccagcaacgtattgactaagagcagtgattttcagctgttgataaggggtcatttggctctgtctgctttcaaaaatttgtctttgtgtttagtttctagaagtttaaatataatgtgtcttggtatggatttctttgtgtttaccctgttagaggtacacccaactttttaaatctataggtttatatttataccatatatgggacatttttaggcattatttatttgagtaccaacatcatttccttttctccccaggactccaatggcttgaatgtgaaaccttttgttatagtcacacaggtcctagactatctattcatttttttttctagtctattttttctctactgtccagaatgagtaattactgttctattttcagttcgatggtttatttcatctatcccctccattctgtttttgagcccatctattgagctttctatttcaattattgtactttttaattctggaattttcatttcgttctttatatttctaattctttgctgggactttctattactatactgaggctttagacttgattcatgtatcttcataattgtttgctggagtttttttattatgactgtttaaataattgccacataattttaacatgtctgtcatcttggtgttggtatccgttatctttgttcatttttttttgagattttcctatttttggtataactactagcttccaatgtaaacctagacgttttgtactatgttcttatttaaatcttctattttagctgtctttctctaatactgctccatcagggaaaatagggaaattagctcattgttgctaggtgaaggtagaagcccaggttccccactcagcttccactgacagccaaagtgagagtctcctaactactactacataggtgagagttccaggttcttccatggtctccactgataccttggtggaggtggctttattattacttggcaattgtgaaaggcctcctccgacagaacccctgtagggggtagagggatgtctcattacagctgagtcggggtagaagtccagacttctcacatggtgtctcacatagatactgcaaaggggcaagaggagtgtgattctcattaacaacaggcagggattaagtcttagctttctatttggccatctctgataccatcccaatggcatgctagacaacttgttacagcatcctaagagtgaatgtctaggctctctagttatcctttgctggcatgggcagggatggtaccatatttttttctgtgatgtttggttggactataataattattatccaaaggctttctatctttctaggcttccccttttttagtcttttagataggaagagcagatctttgctgggctttttatgtctgcgactgttgccatttctgggtttctggcttgttcagtaacaagtctggtgtatatgagacacaaagaagacccagggacctaaccactgtgtcatcccttgtgtcctgtagtccttagcctgtctgccttcttctccctgtttttcagcatcatcttatgtttgctttacacataatatccagacagcttagttgtacctcgtgggaaaaataggagatattatagcgactctatcttcccagaagcataaggctttatttctatttttagttttagttctggggtacatatgcagtatgtgaaggtttgtaacataggtaaacgtgtgccatgatggtttgctggacctatcaacccatcacctaggtattaagcccagcatgcattagctatttgtcctaatactctccctacccccatcccactcgctgacaggccccagtgtgttgttcccctccctgtgtccatgtgttctcattgttctgctactacttataaatgagaacatttggtgtttggttttctgttcctgcattagtttgctgaggattatggcttccagcttcatccaagtccctgcaaaggacatgatctcattcctttttatggctgcatagtattccatggtatatatataccacaatttctttatccagtctaccattgatggacatttgggttgatttcatgtctttgttattgtgaatagtgctgcaatgaacatacacatgcatgtatctttgtaatagaatcatttttatttctttgggtatctacccagtaatgggattgctgggtcaaatggtatttctggttctagatctttgaggaattgccacaccgtcttccacaatggttgaactaatttacattcccaccaacagtgtaaaagtgttcctctttctctgcagcctcgccagtatctgttgtttcttgactttttaataatggctgttctgactggtgtgagatgatatctcattgtggttttgatttgtatttctctaatgatcagtgatgttgatctttttttcatatgtttgtgggctgtatgaatgtcttcttttgagaagtgtctgttcatgttctttgcctgctttttaatggggttgtttgtttttacctcaaaaatgtgtttgagttccttgtagattctggatattagatctttgtcaaactgataaattgaaaaaattttctcccactgtgtaggttgcctgttcattctaatgatagtttctttttctgtgcaaagctccttagtttaattagatcccatttatcaatttttgcttttattgcaatcgcttatggttatttcatcatgacatctttgcccatacctatgtcctgaatgttattgtgtagattttcttctagggtttttatagttttgggttttacatttaagcctttaagccatcttgagttaattttttaataaggtatgaggaaggggtccagtctcaattttgaacaaatggatagccagttctcccagcaccatttattaaatgagggattatttccccattgcttcttttggtgaaatttgtcaaagatcagatggttgtacatgcgcaatcttatttctgagttctcttctgttccattggtctgtgtgtgtttttgcaccattaccatgctgttttggttattgtagccttatggtatagtttaaagtctggtagcatgatgcctccagcattgttctttttgcttgggattgtcatggctatatgggctctttttggttccataaaaaaattagtttttttctaattctgtgaagaatgtcaatggtagtttaatgggaatagcattgaatctataaattactttgggcaatatggtcattttcatgatattggttcttcctatccatgagcatggaatattttttcatttgtttgtgtcctctctggtttccttgaacagtggtttgtagttctccttgaaaaggaacttcatttcccttgttagctgtattcctaggtattttattctctttgtagcaattgcgaagggggggttccttcatgatttggctctctgcttgcctgttgttgttgtataggagtgcttgtgacttctgcacattgactttgtatcctgagactttgctgaagttgcttatcagcttaagaagctttggcgctgagacgatggggttttctagatataggatcatgtcatctgcaaacaaggacattttgatttcctcccttccgatttgaataccctttatttatttctcctgcctggttgcctggccagaacttacaatactatgttgaatagcagtggtgagaaagggcatctttgtcttgtgccagttttcaagaggaatgtttccaggttttgcccattcaatatgatattggctgtgggtttgtcataagtggctcttatgattttgaagtatgttccttcaatacctagtttactgagagtttttgacatgaagggatgttggattttattgaagaccttttctgcatctattgagataatcatgtggtttttgtctttagatctatttatgtgatgaattacgtttattgatttgcatatattgaacaagacttgcatcctgggaatgaagccaatttgatcgtggtggataagtttcatgatgcgctgctgcattcggtttgccgtattttattgagaatttttgcatcaatgttcatcagggatattggcctgaagttttctttttttgttgtatctctcccaggttttggtatcaggatgatgctggcctcatagaatgagttagggaggagtccttccttttcaagtatttggagtagtttcagaagaaatggtatcagctcctctttatatttatggtagaattcagttgtaaatccaactggtcttgggctttctttggttggtaagctatttatgattgctttaattttggaacttattattggtctattgagggattcaacctattcctggttcagtcttggagggtgtatgtgtccaggaatatatctgttttctttagattttttactttatttgcatagatctatttgtagtattatctgatggttgtttatatttctgtggatcagtggtgatatccactttttcattctttattgtgtctgtttgattcttctctgttttcttctttattagtctagctaaaaatatggaacacttcatgaatttgcgtgacatccttgtgcaggggccatgctaatcttctctgtattgtaccaattttattatatgtgctatcaaagtgagcacagcataaggcttctaaaacgatttttaaaaataagaattgtgtccacctgggtacctcttccactggtagaaagtaatgagctcatttaagatcactgaaacatcacaggccagactagagctcattcacagtagcttccatctcatcgtagtttgatgcagtctgttggtaatgataaatatttttctagacacaatttctccttgattggttagctggaaggcaggagagcttttcagtctccctaggtggactgagctgattatgaagagaccacagaaaacttgtcttttccttgatggcatcagactcaatagaatccgcttagggactatacacaggaaagcaagatggggctaactaaaataatgtaggaaaaaggtattctcttgtacctgatgatccccctttggcaaaagggaatctctgtcacttgaacatctatgtctctaaaggaacctgctaaaggttactgctacaaatattgggaaattggttttaccattagattttgcttgataccacattgcatgggctgcttcccaaggtgcaaaagtgttagataaatgtcttcttcaataattacatagtaacaactgaatgtgtaactacatgacaccttgtcaaaactcaattacatagtatttttgttttcctcaactagtgctattatatcagagaaacagttatactaaatcataatgctttagtgatgacatatttatttactaaatgatcaggtatgacatgaaatttcttcttaaattatatttaacaagatacatagtaatttcatcattttctgctgtttgctatgtgaagtaaacctccaattttttaaagtttccagtgtctcttgtggttgttattattcttgtttttgtttattaaaagtgtttattaacacttctgttacatttaaaagacatgttactctttcattggataatgtaaataatttagtttagttttgtcttcctgtttccagctgtgtgttgaagatattttcaagttgataacttagattacaagggaaaattgtcattgaacactgccagatcaaagaaaatgtcactagttctaacagttgctgagaaattgaccctctttgaatgaaatgtaagcattggatcccacagtacaagtaaaacttctttaacttgaagattttattcaataagcatctatatatactgcacattctaaagctcacattacttttctcattctgtgttatttaaaattctgtaatttcctctactcctaatcaccaggctctatagaacaaacaaagagaaatacttgcattaagttgcagacaactttaacaatctgattttacaaaagtcagaaagtatttttttcttggtaatccttatttgaaatgaagcatttcaatagcaggcaaacagcattgttgacacactaatccaagctctctcaatctcagtactgttgacatttaggatctgaaagattttttttggtggaagaaggggctgtcctctgctgtttagtagtacaccactggcctttaccagctaaatgtcagtagcatttcccaccagttgtgacaacccaaaatggctccagacattaccaaatgtaccctagggggccaaaattgtccctagtatgtatcctctaaaaaaagattaaatggaagttaaataatgttctgatggagattgcagtgtagtcaaattctaccacatattagcctattaatgaagtgaagctattcgagaagaacatttcctgagaagaaagctgtatcccctgcccatttgtagttaagtgccaatagggagtttatgtgacctcctgaagctccaattctttgcctgatatcaaaagtatggttacgttatcctgtgcctagtaactaaaaccaagagatgttgacaaatgtatagagaatagaggtgaataataaaaaaagagagaaaacacaaacaatacataaatattagtctgtaagattcagtactgacataaaatatgagtaacacatgagcaataaactttttaaaaaaatcttgtgagtacataggaggtgttgtattatggggtacattagatgttttgatacaggcatgcaatgcctaataatcaaatcatcaaaaatggggtattcatcccctcgagcatatttcctttgtgttacaaacaatccagttatactcatttagttatttttaaatgtacaataaattatttttgtttgtaatcaccctgttgtgttatcaaatactaggtcttatctattatttctaactactttttgtatccattaaccatccccatcccccccaaccctcattacccttcctagcctctgtaaaccacccttctgctcagatgaacagtaaatttaatggaacatatagacactcacaatgcattttataggagacctggtgctcatagctgttcttcaggttatgaagtctattgccactgattttttttgtcttttcctgacttctgaatagttgatactaggagtcaatagggtaatagccaaagtttaagatcaaaagtctctgatacttgaaattgcaacccccacccaatccctgtggagagccctaaggagataccaggtcttatcagagagcaacaattctcttgtctttctttggcaaactagagagtaacaaaggctaatttatattgcatataactaaaacatattataattttctataacaagcagaaacattagttttaaaatatgtatgcacaataaaaaaatgcataaatgaaaaaggcaagatattatttggttaggggatggattacagcctccaaatatgtcaaggaatggcttgcagaaaagtttctcttttttttttttttttactatcatgtgatagacaaagtcatttcttaattacttttcacagcttctaatcccctagacttgtttgctatatggaatcataatgaaagatgcatgaacaacaagctatgatactataatgacacttgaggctctacttaagttataatccaagttatatgtcatggcagatcaagcacttcttttgtaaatactttttgttaaatcataaagttccttactagggggaacataactagctctatgatttaaactcagaaaggtaaccaggaattaaatatcttgttaaaagttcactttcagaaagttcactttcagaacaaggtaaaatcatgactttcatacagacacaaaaattgattaaggatttattttattcatatggtatgagggaaccaggcagatattataactggttcaaaataaaagtcaaaagagctaaaatttttatggagtaaaggaatgttgacaaatggagacaaaactggtttttccaaggtgaagtggatgaaccaaatgtctaacagacagagtagaatttatatatcagttaccttcaacttacaagaagttgcaaaataattcagacaaggaacaatgaacaatgaacagaacaatgattttgcttaaatcaggcctaaaggctagagatgatgtatcatttcccaccaaaacatatcaatttttactaaaattcccctcctttttgatcaaaaaagcctgaaaaattatcttgatcaaaaaataagacatatcatcagactggacctaattatttatgaaagtgcagcaagtgtgctaatttgccatatggaccttcttaagtttattttgatggatgttttcataaagaatctcagattggacttttaaaagctctttattatgtgtggacctgaggctaggaaacaaggattttgccaatagtatctacaaatgtgggtgaatttctttctttctttttttaattttttgagacagagtctcgctctgtcacccatgctggagtgcagtggtgcgatctcggctcactgcaacctccgcctcccaggttcaagcgattctcctcctcagcctcccaagtaactgggactacaggcataagccaccatgcccggctaactttttctattttaagtagagacggtgtttcaccatgttagccaggatggtctagatctcctgaccttgtggtccgcccgcctcgtcctcccaaagtgttgggattacaggcatgagccaccgcacctggcctgaatttctttctttttaaggttctcaaaacgtcctaaagtccctggcttgccaggaagtgaccttccttactcatctgtaagtctgagaaccctggaagccagataccatgccagttttcccaagtttactttgtaagcattggctttataaagtcagctttggtgccttaaaagtatctgttcatatctaattgaataagcataattttcacatataacatcctaggcaagtccttggttgtataaccaatgtttccaattattctccagttaaaggagaataaattcttactgcaactatgcaaatcactacattgctatgaaaataaaaatgttcgataagagtttctgaattctgaaggggtcaacaaggagaataaaatatcatttataaatatttcatttcagtttataaaagcagagtctactaaattattataagttgtagatagtgtaaaagtacaaaagtgtgatacctttcctcaccaatcataagggtaacagccaagactcctataacaaaagataggttaacaagagacaagcatgacaaatttatttaatcaaaatttcacatgacacagcagccttcggaaatgaggacccccaaaacctagaggaaaccatctatatacttaggttcaataaagaatggatagccacgtagaaatgtgattagacaaaagagtatgacctaatggtaatagattgcgtggggggatccagcaaggcctatctgttcagagactggttgacttctctgtgtagcattccttcttcctcagtatgatacacgacctctctggaatgaaggtcttcaagggaaaggggaacagggagagagttacctttctaggtttaatggcttgcttttggggagaggggttctagttttcatgaccctctttggagaagaggaattctggtttccatgacttgctttgggggagaacaaggaggaggagacaggagaatgtaagaaagatcagaaagaccttgcttctgaggcctttctagtttccttcagttcgaagtattcagtatgccaaggtgccatacttcggggtatcatgttctgagccccaacaatagcataaaagacaaaggacttccttatacatcttgaaaagaaaacattaaaacatcaacaatattatttaaaaatttacatcataggccaggcacagtggtgcacgcctataatcctagcactttgggaggccaaggcgggtagatcacctgaggtcaggggttccagactagcctggccaatgtgacgaaaccctgtctctactaaaaatacaaaaattagttgggtgtggtggcaggtgcctataatcccaactactcaagaggctgaggccggataattgcttgaacccagggggcagaggttgcagtgagccaagatggcaccattttactccagcctgggcgaaagagcgaaactctgtctcaaaaaaaaaaaattatatcatatcattcagtcttatataattattcttgctccataagatcttgtattagcagaagcctatacccaaaagtacctgttgtaatccttttccatgaggctctgagacagtcatccttttttaatgacgaagcactgaggactgtagttgattgcatatgctttcaagaaaggatcagagtaaaacaaacaaaaaaaatatctaagacaaaagactatggttagttattactgatagctttcaaaagtgaaaggtctaatgagcatttgttgtaagaaaaatgcagctgacaataaaatttggttttttctttgacatgcaatacaagatagttaagcctgccgaaaaaagttttagacaaaataattataaacagtgattaaatctattattaaagaagatagtgaagattacatctaaattataaaaatagatgaatatatcctttacagagaaaaaatcttgagatatataagtctgaaataatatgcaataaatatactaagcatatagtaagaatatgccaaaaatatgtcaatattaagtaaaaagattcagtaagtatggaatacaccacaaacatctgtatattaataaaactccatagttaagtgatgtgaattcctatttgaaatctagtggcctagaagatgccattttcaatttaaagtagcaaagttgtaaccaagttaatattttttaaaataactgaaattatgactgataacactatactgctgtcatctaatatcagacaaaacaccactagcactctgataaataaaaatatatatcatggacagcaagggctttgacaaatttcttgaaatttccctagcagtataccatttctgaaatatttataccaataatattttagccacacaaatttaacttacagaaggctcagcatcttttctgatttgaaaactattctcatagaactcatcagcagtaacatatcaataaacctaattatttttaacacctctcattttactagatgaaggaaaaaatctttgtgccattgcacagggcctaaaaaggtaattttagttgtaaaagataaggtgaaagctttattttatttttttatatgcaggattagacttggggaaggcaaaaataaaaaacgtcatggtatttgaacatttaagatacaaattggatcataggtgcctgagaaataatacttaattattcatttcaaaatgtcaataaaacattaaaagaaaacttagaagataacgtgattgtaatgaatgtttgtttttgtgaggaaactttgttttcttgaatgaccaaggacattatacagacaacataaaccatagaatcttattgtggtatgacacaaatctttgttatctaagcagattaacgggaaacaacaacaattacaacaataaaaaataacctttcttatagtaggtgaaggcaatgaaccaaggagacaggcctatcaatttaagcaaactctgctaaggtttttaacacagttcataacttttcaaactcaggtattataaagcaagggaagtaaaatgtatttctaccttttgtctatcattatactccttcatcttctggaataaactgacactttactctaggacccatatcaggatgtccacaaggtcagaattaatttcataatattattagtaacattcaatgtgttcattgttgctatctttgaattcatcaataagtgtgcattttaaaaattccccagtttcaatttccaatatagtaagtatcaatagaacctacaaaaaaaaaagctctatgtggtcctcaataagctttaagtgcacaaagagatttgaagagtaaaaaaacagaataaaaaaaaactcctttaggaagaaactactcctttccatggaaaataaaaatacatcaaacacagttgtaattctctgaaactattactcctacatagtctcattcacatatattaattttaaccaaagcaatttctacttcacagagtaaacttccttgcagtgcatccttgcaatctagcagagctcatgaatacacataatacaactttctacagtcatactttatatgatttctcaaagttgcaaaatgaacatgttcattaacagacccaaatatatcatctctctgtagcatatacaaataagaagcaaaagtatataagcttaatattatgattagtaatcaatattttggcattctatcctacttagaaatgatctagatatccaatgactatctattaattaacccaaaaggatatcaactggggtgatcattccaagatggccgaataggaacagctccagtctgcagctcccagcatgatcgacacagaatatgggtggtttgtgcatttccaactgaggtacttggttcatctcattgggactggttggacagtgggtgcagcctacagagggcgagctgaagcagggcggggcgtcgcctcacccggggaagcacaaggggttgggggatttccctttcctagccaagggaagctgtgacagattacctggaaaaatgggacattcctgcccaaatactgcacttttcccaaggtcttagcaactggcagacaaggagattctctcctgtgcctggctcagtgggtcccatgcccatggagccttgctcactgctagtgcagcagtctgagtttgaactacgaggcagcagcctggctcggggaggggcgtctgccgttgctgaggcttgagtaggtgaacaaagcggccgggaagctcgaactgggtggagcccaccacagctcaacaaggcctactgcctctagactccacctctgtgggcagggcatagctgaacaaaaggcagcagacaacttctgcagacttaaacatccctgtctgacagctctgtagagagcagtggttcccccagcatggcatttgagctctgagaacggacagactgcctcctcaagtgggtccctgacccacgagtagcctaactgggagacacctcccagtaggggctgacagacacctcatataggcagctgccctctgggatgaagcttccagaggaaggatcaggcagcaatatttgctgttgtgcaatatttgctgttctgcagcctctgctggtgatacccaggcaaacagggtctggagtggaactccagcaaactccaacagacctgcagctgagggacctgactgttagaaggaaaactaacaaacagaaaggaatagcgtcaacatcaacaaaaaggtcatctacaccaaaaccccatctgtaggtcaccaacatcaaagaccaaaggtatataaaaccacaaagattgggagaaaccagaggagaaaagctgaaaattcaaaaaatcagagcgcctcttctcctccaaaggatcgcagctcctcaccagcaacagaacaaagctggatggagaatgactttgacgagttgacagaagtaggcttcagaaggtcggtaataacaaacatctccaagtgaaagtaggatgtttgaacccattgtaaggaagctaaaaaccttgaaaaaagattagaggaatggctaattagaataaacagtgtagagaagatcttaaatgacctgatggagctgaaaaccgtggcatgaggatttcatgatgcatgcggaagtttcaatagccgattcaattagaagaaaggttatcagtgattgaagatcaaattaatgaaataaaatgagaagacagggttagagaaaaagagtaaaaagaaatgaacaaaacctccaagaaatatggatctatgtgaagagaccaaatctacatttgattggtgtacctgaacgtgatggggagaatggaaccaagttggaaaacactcttcaggatattatccaggagaacttccccaacctagcaaggcaggccaacattcaaattcaggaaatacagacaactccacaaagatactcctcgagaagagcaaccccaagacacataattgtcagattaaccaaggttgaaatgagggaaaaagtgttaagggcagccagagaggaaggtcgagttagccacagagggaagcccatcagactaacagcgaatctctcagcagaaaccctacaagccagaagagagtgggggccaatattcaacattcttaaaataaaagaattttcaacccaaaatttcatatccagccaaactaaggttcataagtgaaggagaaacaaaatcctttacagacaagcaaatgctgagagattttgtcaccaccaggcctgccttacaagagcttctgaaggaagcactaaacatggaaagaagcaaccagtaccagacactgcaaaaacatgacaaattgtaaagaccatcgatgctatgaagaaactgcatcaattaacgggcaaaataaccagcaaacatcataatgacaggatcaaattcacacataacaatattaaccttaaatgtaaattggctaaatgccccaattaaaagacaccaactggcaaatttgataaagagtcaagacccatcagtatgctgtattcaggagacccatctcacatgcaaagacacacataggctcaaaataaagggatggaggaagatctaccaagcaaatggaaagcaaaaaaaaaaaaaaaaaaaaaaaaagcaggggctgcaatcctagtctctgataaaacagactttaaaccaacaaagatcaaaagagacaaagaaggccattacataatggtaaagggatcaattcaacaagaagagctaactatcctaaatatatatatgcacccaatacaggagcacccagattcataaagcaagtccttagatacttacaaagagacttagatgcccacacaataataatgggagactttaacaccccactgtctgtattagacagatcaacgagacagaatgttaacaaggatatccaggacctgaactcagctctgcaacaagcagacctaatagacatctacagaactctccaccccaaatcaacagaatatacattcttttcagcacctcattgcacttattctaaaattgactgcataattggaagtaaagcactcctcagcaaatgtaaaagaacagaaatcacaacaaacagtctctcagaccacagtgcaatcaaattagaactcaagattaagaaactcactcaaaaccactcaactacatggaaactgaacaacctgctcctgagtgactactgggaaaataacaaaatgaaggcagaaataaagatgttctttgaaaccagtgagaacaaagacacaatgtaccagaatctctgggacacatttaaagcagtatgtagagggaaatttatagcactaaatgcccacaagagaaagcaggaaagatctaaaattgacaccctaacatcacaatcaaaagaactagagaagcaaaagcaaacaaattcaaaagctagcagaaggcaagaaataactaagatcagagcagaaatgaaagagatagagacacaaaaaaaaaacccttcaaaaaatcaatgaatccaggagctggttttttggaaagatcaacaaaattgatagaccgctagcaagacaaataaagaagaaaagagagaagaatcaaatagatgcaataaaaaatgataaaggggatatcaccaccgatcccgcagatatgaaaactaccatcagagaataatataaatacctctatgcaaataaactagaaaatctagaagaaatggataaattccttgacacatacaccctcccaagactaaacaaggaagaatttgcatctctgaatagaccaataataggctcagaaattgaaataataatagcctaccaaccaaaaaaagtccaggaccagacggattcacagccaaatactaccagagttacaaagaggagctggtatcattccttctgaaactattccaatcaatagaaaaagagggaatcctccctaactcagtttatgaggccaacatcatcctgataccaaagcctggcagagacacaacaaaaaaagagaatttagaccagtatccctgatgaacattgatgcgaaaatcctcaataaaaactggcaaaccgaatcccgcagcacatcaaaaagcatatccaccacaatgaaataggcctcatccctgggatgcaaggctggttcaacatatgccaacaaataaatgtaatccatcacatacacagaaccaacaacaaaaaccacatgattatctcaatagatgcagaaaggccttcaacaaaattcagcagcccttcatgctaaaaactctcaataaactaggtattgatggaacctatctcaaaataataagagctatttatgacaaacccatagccaatatcatactgaatgcgcaaaaactagaagcattccctttgaaaaccggcacaagacaaggatgccctctctcaccactcctattcaacatagtgttggaagttctggcaagggcaatcaggcaagagaaagaaataaagggcattcaattaggaaatgaggaagtcaaattgtccctgtttgcagatgacatgattttgtatttagaaaaccccatcgtcacagcccaaaatctccttaagctgataagcaacttcagcaaagtctcaggatacaaaatcaatgtgcaaaaatcacaagctttcctatacaccaataacagacaaacagagagccaaattatgtgtgaactcccattcacaattgcttcaaagagaataaaataccaaggaatccaacttacaagggatgtgaaggacctcttcaaggagaactactaaccactgctcaacgaaataaaagaggacacaaacaaatggaagaacattccatgctcatgaagaggaagaatcaatatcatgaaaatggccatgctgcccaaagtaatttatagattcaatgccaaccccatcaagctaccaatgactttcttcacagaattggaaaaaactactttaaagttcatatggaaccaaaaaagagcctgcattgccaggacaatcctaagcaaaaagaacaaaactggaggtatcacgctacctgacttcaaactgtactacaaggctacagtaaccaaaacagcatagtactggtaccaaaacagatttatagaccagtggagcagaacagaggcctcagaaataacatcacacatctataacaatctgatctttgacaaacctgacaaaaacaagaaagggggaaatgattccctgtgtaataaatggtgctgggaaaactggctagtcatatgtagaaagctgaaactggatcccttccttaaaccttatacaaaaattaattcaagatggattaaagacttaaatgttagacctaaaaccataaaaaccctagaagaaaacctaagcaataccattcaggacataggcatggggagaacttcatgactaaaacaacaaaagcaatggcaacaaaaggcaaaattgacaaatgggatctaattaaactaaagagcttctgcatggcaaaagaaactaccatcagagtgaacaggcaacctataaaatgggagaaaatttttgcaatctacccatctgacaaagggctaatatccagaatctacaaagaactcaaacaaatttacaagaaaaacaaaaccccatcaaaaagtggacaaaggatatgaacagacacttctcaaaaaagacatttatgcagccaacagacgcatgaaaaactgctcatcatcactggtcatcagagaaatgcaaatcaaaaccacagtgaggtaccatctcacgccagttagaatggtaatcattaaaaagacaggaaacaacagatactgaagaggatgtggagaaatagaaacacttttacactgttggtgggagtgtaaactagttcaaccattgtggaagatagtgtggcaattcctctaggatctagaactagaattaccatttgacccagcaatcccattactgggtatatacccaaaggattacaaattatgctactgtaaagacacatgcacacgtatgtttacttcggcactattcacaatagcaaagacttgaaaccaacccaaatgtccatcaatgatagactggattaagaaaatgtggcacatatacaccatggaatattatgcagccataaaaagggatgagtttatgtcctttgcagggacatggatgaagctggaaaccctcattctcagcaaactgttacaaggacagaaaaccaaacactgcatgttctcactcgtaggtgggaattgaacaatgagatcacttggacacgggtcagggaacatgacacaccagggcctgttggaggatggggggcttggggagggatagcattaggagaaatacctaatgcaaatgatgagtcgataggtgcagcaaaccaacatggcacatgtatacctatgtatcgaacctgcatgttgtgcacatgtaccctagaacttaaagtataataacaaaaatttttttaataaaaataaaaaaatttaaaaaatgttatcaacttaacgttttaagttatctaaagatcttggaaattatcttcaagctgacatactataaaacataattactggttaaataaagtttgccagaataattattctgtttgattaaacacaaatttacattcttcataatcttcaaccttaagtagatgcaatattagcttattccctcagtaaatctgtacaactttaggaagaacatgccgaagtataataaaatctacacttctacttaataatgataaatcagaaaagacataggtcttttattaagccaaaatattaagctagtctcattcaccaagcacttacctacattatgtgaactcgaattcttaaaatgttttgaattggtttctgaattctgtgagaatacttttaaaatctaacataccaaaaacattagaaattcaatttccttattttctgagaattttaggaatattctaattacataagaatttaaccatctctataagcgaatcctctaagatactttatattctaatttattaatatcacccaaacatagcaaaatattataccctgtcttagtttactcaggctatcaacaaagcaccataaactgggtggcttaatcaacaaaaattttttcctcacagttctggaggctgagaagtccaagatcaaggtgccagcaagataggttttattctgaaggtctcttctcttgacttgtaggtagctgccatcttgctgtggtgcacatgacctcttctttggtcacagtcctatcagatcagggccccacccatatgaccttatttaaccttaattgcctccaaaagagcctatctctaatgcagtcacattgagggttagggcttcaacatatgaattttggtgggacacaattcagtccatggcatatccttacaaaaaaagaagtaaagttccttatgaagtacagacacttagacatgcagacacagtaagagcttatggcatcaattctaaaatatcagccaggagccaagagtaaactcagaagtatataactcattggtccaaatcaatcagatggtctcttcccattcttcaattcttaattgaacttgagcttaaaatagacaaacaaacaagcagaaaagactaacaaatcggattttctattgtccctcagccaacaaagatcactaaaaaccattaatccacttacagagatcactaaatagtcataccacaagaccaaattctcaatgggaagcaacttattggccataaaccaaaacaaaattagtagagtgcaaaataaatattacaaaaacagtgtcagcatagttctattgccactttggattcaccttcttagagccaagtaaagacatgcttggattaaactgttaaaagataattttcagaaaaaggtaaaatcatggctctcatacagatataaaaataaacatatcctaaagattttactcatatattattaaagaagccagacatatgttttaactggtttttaaagtcaaaaaatcacaaatgtatatagaataaagtagtaatgagatgaaatgcaaatggaaacaaaactgatttttttttatgaagaagggtggcatagggtgaagaaaagtcaattaattctccacccagtagcacagactttaaaaattccagttataacatagctgaaagaaaatgagcagatctagaattaaacagggcacaagttttccactgaaaaatagatttctactgaaacacagtatttttttctacaaatagaaataatttggaactattttagaatatattttataatgagttttattgggaatatttcagattccattcctaatatggttttgtacaggttaatcttcaactgagttaacataccctcatagatagtagagttaacaaacatcaccattactatgaccactaccacaacaatcgttacaacgattcttagtctgcatagcactttacatacattaattcacttattccccacaactctgagataggcactaatattatctccatgttacaggcaaataaacgaagacacagataactgaaataatctgtccatgcttacagagctagcaaatgttgatagctagtccactgagatgtcagctagctatttggagactctcacctgtattttaataagttgattaatatgatctacaaaatgcagaagctaaatttcctgaaattgttaactgaggaacattatagcccaggtgctgtgctaagcacctgaagtatatatgtaaatgaagcaacatccttggctttgagttcccagtctagggatggagacagacatgtactcagataattacaaagcaatattcaataacaaaagctagaattaaatgatgcaggggcacacatttcaaagaaatgaatgctgaatgaaaaaaaaaaaaaggtgggagagatgggcaggattgaggttggtgagggccttgaataccatgctaagcaactttgactttatcctgaaggccagagggggctatcgtagggtattaagcaaggaagtgacataatcaggattccattttagatagattgctctagtagcagtatggaaaaagaattagacagtaagcctatatcccaagagaacaatatatcagttatctgataataaaaatacaaaaccctcaaaacgtagtgaactatttatttaagattcttctgtggatcagcaatttgggctgtgctcagctggactattcctctgctgttctctcctgggcctcatccagaagtctgatcatttgtgctagctctttcctggtcctctctatacccatgggttttcaccttaaaagggtagcgtattcttctttacatggtatggcaaacagaataatggctccgcaaaggtgttcatgtcctaatccccagaatttgggaatatattattttatgtggtaaaagagacattgcaaatgtgattaagataaggatcttgatatgatttagatttttgtcccctccaaatctcatgttgaaatgtgattgccaatgttggaggtgggcctggtggcaggtacttgggtcatgggggcgaatccctcgtgacggtcttggtgccatcctcatagtaatgagtgagttgttgctctattagttcacaagagtgctggttgtttaaaagagcttgacatctctcttacttccttctctcttgctccttctctcaccatgtgatatgcctgttccctcttcatcttccctgacgaatgaaagcttcctgaggcccacatcagaagcagatgctggtccatgcttgtacagttggcagaaccatgagccaaataaacctcttttcttcataaattacccagcctcaggtatttctttatagcaacataaaacagactaacacagaccttgagttgaagagattattctagattatctgggtgggcccaatccaatcacaacagtccttataagagagaggcagaaggatcagagtcataaaaggagatgggatgacagaagcagaggtgaaagagttggagagagatttaaatatgctacaatgatggctttgaagctcgaggaagctgggccatgaaccaaggaaccgaggcagcctactgaagctggaaaatgtaaggaaacattctccccctaagcttccaggaggaaagcagccctcatgacactttgacgaatccactgaaagcagttttgggcttctgacttttagaactataagataaatttgtgttattttaacctactaagtttgtggcttttgtcttttataacagcaataggaaactaatacacatggcattctcagggcaacaagagattaaataaaagcagaagctacaagcctcctgaggccttgctcagtagttgcacagtgttacttttgccctgttctgttggtcaaagcaagtcataaggccagcccagattcagggataggaaaatagaattcatctcttgactggaagacctataaagaagttgttgcctcttaaaatgcactgcaacaagttagggggcaattagagtaacgcaggtaagacatgaaaaggactttaaggtgctataggatggatggtaaggaatggagaatttcaaaacatacttagtaggtaaaaccatcaaaatttgatgattaattgaatgcagagggtgaggaagatgaaacatatttgatcctcacatcaaacctgtgaagttaagtaaacattatcatctacctttagcagaagaggaaactgaagcccagagaggttaaatcatttgcttgatgtcccatagcttgaactagaacataaaattcctgacccatgatcttttcttctggttggactatgttgcttacatatcccttccccttcctcatcccctcctgagatctcatattaatggacatatgccgccacttactcttccatctggaatgggtacccttgttcacttctattcttgtgactttatgtaactggtacagcaacatcaacaccttccatgtcagctaatatagaaaaatcaaaggagaaactaataataaaaaggcagatccaaataagccactttttagtaatcacatcaatagaacactacacataatatgatgaattgattaagatttcatttgggaggctgtgatttgtaaaggaaaaatgacctttaaggcatttttcccctggaaatgagactagttcctctttatctccttgtgaatcattagtgagctgaggaatcaacgaacactgaaagttgaggaaggttagcttcatttcttaagagctattatatcatgtagctagtttccttagcaacagtgtacatatctccccacatggtatcttgaaaattgcaaagacaaatatggtaggtgccattcttaaagttatcaaaaaactgcttctaaatgatcctactttgaatttccatgtaaaaaacttattctaattttttgtctaatcattgtagacaaggactgtaacattttataaatcaatggatacatgaggtagttaagcaacaaaaagaggtatcgtattttcagggaaaaatgtgtcagatccaaaggaaactttcagattggaaatcctcatgccaccaaatacagaagatcatgtcttttagagcatgaatattatttgcatgaggcttacagctagatgatattagcctatggactttttcctacggtaggaaatctagccaatataggataagtgttcaataaatgctggttgctattattattataattggaaatttacagaaaataatctaaaaatagaattgcagctgcttccttggtatgtattatccatgcatagaaactcatggtgtgtttaggcctcaagttacaaaaaagtagctatagtaacaacataaaagctaccctttatggagcattactatgactcagacattgtgttaggcatcttaacgtaccatatcatttagtcatcacaaaacattgtacaatagatactactaccttcacaattgtataaatgaagaaattaaggtgaatagaataagtgtcttgaccaaatacccacaactagaaagtgagaaagctggaaattgaatccagagatcaaatccttttctgcctaactcaaatgccatgttcttagtcaattgctctttcacctgtgctgcaatgtctgcatacaatattctctaatgatgtttcatctaaggccaggaggacagttagaggactgggaaatagattcccacttaactgtgacttctctcccaatccttttaattccccacctcatgtatcctgactctgctctggaaaatttaaatgcagcctgctaatattcagtatgtactaggaatgtgcaaagatgtaagaacaggaaatggttcccttcttgaaggagttcataatctaggtagagacattaaggataacacattaaataacgagaatcatagatgactgaataaaaacagtatcaaattggtcattttaaaattttgagacatgtggcgctttagccacataaatcagtaaaacagaaaggataggtcagcccaggactagggtgagggggcctggcacagctggagggcatgattctggatggttagcgatcattccagtgtgtcttatttaaagagatgtgctatctgaagggatgtggttgatctggactatggtaaatagccaaggagcaccaatctggtgtttaggactggtaatacttcaaagcagatgaagtgctaacaatgtgtttattgacgatgaataaatataggacaccacatccaccccccccacaaaagtaataaaatcgagggactagaaaaaattagagtgtcatggtcctggccaaatggactggagttcaaatccatccatgagggaatttgtaagaattttgtaaacatggcagggagaagactgtgacttagggcacatgtgaatacctagggctcaccttaaggataacataggctagccctgttatctggtttcctctccggggaccaggaaaaacctagccaggtacccctggatacgggtttctgggagccaggtgtagctaaaacagggtatttactttaggtggctatgttagtccactttgcattactataaaggactacctgagactaagtaatttattgagaaaataagtttatttggctcatggttctgcaggctgtaaaagcatagcacccacatctactaggctcctgatgaggacttaggaagcttttactcatggaggaaggtgaaggggaagtaggggagtaggtttgtcctgtggtgagagaggaagtgagaaaaagggggggaaatgtcaggctctttaaatagccagttcttacatgaactaatagagctctcgagagctcattaccacgagaatggcaccaagcccttcataagggttctgtcctcatgacacaagcaactcccactaggccccactttcaaccttggggttcacatatcaacatgagatttagaggggacaaacatccaaactatatcagtggcctaaaccaacatagctcaaaaaaaaaaaaaaaacaccaaaatttcagtcaaggaaggaaggcaaagttcttggtaaaaatgcattattaaatgccaatcctgaggtttgaagcaggactataagtgggagaaagaataatgagattaagtggcagaggaatcagcagttgattaggcagtgctcagagtgggtagaagcaagctatttagggctgcgatgtgtacggagagagattgattgacccttttgtttatatgatgccagctgactgcttgggaactatagcggacatggtagcttaaagaatatcaagacaggaagatgaattccagacccacccatggataggatggactgttctaatgtactgtctgctgaagtcagaattggcttagaaactgcaaaggcatattatggcacatgcatataagtacacctgaagattgaatcaatattatgtcttattcatatatacaccactggcatgtttgagttgtgtacaaatgctgttatgatgaataaaataccaatttatgttaaagcattagtgaattagtagctatttttctcattatatatttttcttcaaaattgcatagtaaaaataagagtggtaatccagggaattcttgacattgttaggaccagaatttagaggcccttttctatggaatcactacattaattatgtagttatataagccaacagtttttccctcctgcttcctgagattcagatcagacaataaggatttggttcctaccagagatgtttaagggaggggagtagacacagcatcagactgactccaagtgttgcttctcccataacttgtcatcttctacaatatttaagatcttttacattacacaatcatcatcattgttgtcattgccactatcattatcatcattattattatctgtatttgtataacactctgcactttgcaaagtgctcttatcttcagaggtcgatttgcaatgaagctaatgaggcataagccttacaaaccccctccaaacctcctagagtagctttagcaatgcttttatctgactatatgtttttgtaaagctttccgaagatattttaactaaacttaacttagacactttttctcttgtctggtagcattggagtgaccatgaaaattttagggctttagttaagtaaaatttgagttggtgaaatatttaatttgggtttagtaggacattttcagtgcacagtcacctctgtatatagttagattatgctagccaccccagtatcaaatgacttccaagaaatcatcctgccacccactgtgctgactaaaccaagggccagaggccacagaaccagaagtcatttcaggataataacatgtccttaagtgattggcaacagaagtagaagtgaatgtaagagaaataagctttgaaatatagagagctaaaatcagtctgtgaaaaaatactttatatctaaaagaaaattgagagaaaactgatttttaaaatgggtaggtgttccccaaatttgacagcaattctcaaactttacatgacattagcaataacaattataaacctgaagaaaattcctaaacttattaataaaaaacaaatctcaatcaaccatgctagaggaactattgaattccctttccattctgtttatagaaaatattacgaagttgtcatatgaagagaaaaacaaagtatatgcaatacaagtataagttataaaagttattattgaagtatgtcaggcagttaattcatgaaaatatgtagggttttttttctggattttgtgatgtttgtggcatttatcatcttttaaaatgtgttacatataccagtttattttctcatcctaaaaataatcaattttatacttaattttgtatttgtaatcttgcattcttcttaagacaatcccccttgacttgtataaactttagacacacaaaacctggattaatcccggtgcatgcattctgtcacccaactgccacaatattcctagacaaattatactttacagattagagagatgcacctcactcattcagtctttcagcaaatgtttatgagagcctactacgtgtcaattactcttccatgctctagggatgtagcgatgaacttcacacataaaaatccttgccttcctagatctacattctagtgacattataacaaggtatatagataagttgttatttattctgtgtcatatgatgtaaaatgagtaaataatcttggactagaacccaggtgttttccctccagttaaattctctttctttgattatcttaatttacatggctcttgcttcatcttccacattcctctgtgggatgggatttgtaatccatcatcttctaggcttggacacatctctgctttccctgtgaccttctcaagagtcctagtacaaagctagatgcaattcttagagaggcttatttatttttaacatggcccaattttatctcttttggatgaaacacaccctgaacataaaacttgctgtgcctttttgtccttttctctaggtcactgcttagatttttttgagtttccaagttgcagtcagctcatgttgcagagaacagattcttagccatcaatttttgccttctaggtaaaagcgaataaattactcctttcaaatgtcttcaagcagctgctgaatttttctcaggagtatctgttgttttgttttaaatatattctgagttttgttttttgtttaccaacagaatttttctggctggcaatttcttccacttttcattaattgtggaagtggttggtgttaataagaaagggtaaattctcccaaggatatagaacacagtaaaaacagcagtataaattggtgagggctaagttgttcagtaagagtcactttttctgcattactttcggctccatcactgcattcagagaaaagtgagtggtgaaatcaatttcctatataaatttggcagagaactgaatctgaaaaactgaggcaaaagaggtctattttaagcttaaattattggagataattgagtcatgtaaccacttcattctctatgtttagacagaagcttagacatcatctgattttcttcaaagatgtacattgtaaaaacaatttccctaaataacttgcctagtcttccaaactcaatcctgtaattttattcccttcattccaacatagctgtctgtcattctcccaggcaatgggggttgaaattcttgaaaagcacttaagtctcagtgggacttcatggtgacattttgctaatgtgccttggtaaacaaaacatcctaggttgtgaaaccaaagcctacttctatggcgttgtttttgttttaaacatgtcattaagaaaaaagatattactgcttcagtatttctttgatttattattggtctagaacttgtttattagactctatttagtaataacattcattattttactacccctttatttcatagagaaatatgataaagatctcttaatgatcatgttgatttgataagcagatgaaaggctaaaatttttaaatctatctcataccactaggttgacaaaatttgaaaactttattatccagatgttcttttcaatgctcccctctctactcaagtgctccccagtggtgcttcaggtttaccacccataactctcctcctgctcctctggacctcatcaatatttcctccagggtcacatgtcctatctccctttgggacttcatggcaggtgccctaatgaggatcttaaaaatgaattgaggtttgaatgatgggaaaaactatctgctattcctcttcccctgggagtttaaaaattttaataaaggacaactgaaagtaaaatgcattaacctgagaaaggaatgatagatggaattttgggcactatgcaggccaattaggtttgcagaaggaatgaagggtatggagatgtaagagtagagttcaaacctttacatcataaaacacatagatagtgatctataatgcacaaatacgtgcctacccttgagacaactcaagggtgattttaagtccactcatttagacattttccatctgtttaagaaatgaattttcactataacagctactgttcattaaacaaacaggtacaaagagtatttattttttaatatattgcgacattgaattcctgcaattcctcttaccagcttctcagttggtttaaaatgtgtatgtcattccagtctacttagatctatatcaagctaatcacttcagggcagctgtagattgatgtcccaagccagggaggaactggccacttacctacctgcctgcctgcctgccttcctgccaagtagagcaattgttactttttagctctctcatactccataatgacagttcgactccttaccaatttatttgatcattttaagagcatcttcatagatttcaaaggaaaaactatatccttgttttttgcactgatatcatgtgcattgttgtgttgttgttgatggttgtttgctttttcttttgttttgctgtgttttcctcttttcagaattttgttcttagattgcaagagtgacctctagtgtgaaacatctgtatagttattatctcaagctccagggcctcttatccagccttaatttccataggtatttgtgttatacaaaatataattagcaagacctccacaaatatggcaagttatcatctaagaataaaaactccaagtcaggttttttcttattactactcatttattttattcttaaactttggctaacaaagtacagctgcattctggggattctgggatggcaaaggcaacacttccaaaaatgtctttgcaaggaactagaagtaaattacggcattctttatgagctgggtgtatttgactgcagaaaaaaatgttttgcaggcctcttgttgcccctggcattcctgttgtgaataatcggttggtgcactcccctgttctctttcttctccagaaaaaggaagtgttttccttaccaccatactgggtagatgcaaggcacaaagaacacactgtattcttcatggggaaaattaaagtcgacttaagcatatgtcctgccctcacacaaggccagccagaaaatttgcagtatggtcacgggcattgcttattccctacacgaggtaaaatagaagctttaactgcctttcaagagctagctccccttgcaataaaaataacaacccctcatattggcatagtgctttaaaacttacaaagcacttttattcataaaattttacttcatcctctgaccacctttaggaagtaggcattattagtcccatttcagtgatgaaaagtatgaggcccactggggtgcaatgacatgtgcaaggttaaacatatttagtaaatggtggagttagaagtctttggactccaaacttagtgtacattttctcacagattcctcagagtctaacaatcagactttggcaaaataatatataagattttcaaaaataaaaacagtctgcattcatatttctatgagccttgaaaagagaaaagatgatctggttgtaaggatcaaagaaggtttttatggagcaggttatatacttcagtctttaacaaataagaaaaatgtagacagatgaggaaaaccatttcaagctaagcaaaatcagggcaataggaaagtatagcacatctataaaaaatagaaagcacttcaatcaatgtttctaagtgtgggaaggttgtaggaaataattctggaaaagaaagttaagatcaggacctgaaaatcctctaattctagaataagttttcttaatctcagcactattgacatttgggactagattattctttgttgtgggggatgtcctatgcactgtaagatggttagaagaatgcctggtctataccaccagatgcccataacaccacatccctcagttttgagaagtaaatatgtcccagatattaccaaatgctccctctggggcacaacttcaccctattgagaaccatttaaattggtagattatggggaccttttcatattttgaagcaaagttgtgtaatgaatacacctatgcttagggaaaacaaatatggcaaaagtctacagaaaaaaaatggaaaagggaagaggttgaaagccaagaaaaagcccctcaggaagatatgacaggggtctcacaatgtaagggccacagatagctgctatattggaaaaagcattaaacttagaggcaggcacttggactacattgcaagctctgccaacagtcagtgtgtgttcttggacaagtcatttaaaactgtgccctctatttctcatctagagtgagaagatgagaggatgagacgatgatctcaaagttcccttctaactgcattagagaaagatatgcaatgctgtaactaactttatctgcattcattcttctccatatgtcttttgaaagaatcttggtgggtatcaaatgtgtgtttgatttctctgtgtaaagataaacagcataacctcactgtctcagattaagttggatgaaatgacaagtcagaaatagtgaaaaatatgaattattaagtgcattttaaagacatgtagttatattactttcaagtacatgaagtacttagaacatagatgttgaagtattgcttaggcgaggtctcttggaagctagtttagttcattaatttagcatgtactgaaagcacacaatgtgcaaaacactctgctaggcttttcagaggttaccaagatggattagttatgtgacctgccaaagagcttacagtatagtaagggaagttagcaatatacacaacgataatacaaagcagaatgttgtacattccaaacaaattgtatgtgcaagtcttatatacaacaacaggctgatttttagattgcttagtcatgtagaatacagcttaaatccaggttttaaaataatcaaatatatatttaaaacacatacacaactttttcaccgagttgctaaaatatttgagtaagaaaaaatacaagctaaacaattatccatcaactcaactaagatatctgcgtaatatataactgaattgtaatggtaccatacataggctaacctcacttgccagtggagccttaacaagtagacaaaaatggttggcatcaagcaaattgcttatatttaaatggttgttttaaagaacttgtaataattctcctttttaaagtatttaaaatattaaatatactttaaaaaatcttgtctatgctattttgtcccttgctttgggaatctttgttctaaagaagcagcaattttcttttcttttaaattttatttttagttctggggtacatgtgctggatgtgcaggtttgttacataggtaaacatgtgccatggtggtttgctgcacctatcaacccatcacctaggtattaagcccagcatgcattagctatttttcctaatgttctccctcccaccaccccacccaccaacaggagaggcagcaattttaatgttaaagttttactatatacgatgtaaccaagtgcaaattctgtaagaacatttttcccgttgagctgttttctaattttaatgttaaagttttactatataccatgtaaccaagtgcaaattctgtaagaacatttttcccgttgagctgttttctatggtgttccttcttgctgtatcttcaggtgattagcagagccaaatagcaaatgtacaactttggtcaacagattatatctgagataatttttgatttacctactacatactcatgtgcacacatacactatgtaagagggctgtggtaaaaactgatgtaattaattcagggagagaatgccatgtcatttggggtgggggggatgactaataaatagatagatgatagatgaatagatagacggatacagatagatagaaaataaaatatctgtactagtagatatatatgtgtgtgtatgtgtgtgtacctgtatatgtaggccaaagataaaaaaatacagaaaaatcgcagttactcaggaatttgttgtacagtttgtacagaaaactaaactgtgagtgtctttttaacttgagagcttcaggggaaagaggctgttttttaatcagatttttgactacagaagtaaatacaagacagtgtgagaaatggaccaaagtggaagaatattgaggtccctgttggttccagtcaagtagagagatgggtgtaacagaacaattgactttgagatattttccccaactatgtcactcctggtctatttattttacaaccttcatactgtgggaaatatggaacagtataaggcacagtcctggccctaggaagtttataaaagttcagaagactgaacaaaaacaagtgataagaaaactaccaatctaagacatgctatgaagctatctttgataaattattcttagtgacacaacaatccttgaaggcagagactgacatatttaacgtatccccaaacacctaggaagggatcttgcccattgtagatacttgttatatgtttgttgaaatgaagtggcatgcttatggaacaaaatataaaagcttagaaatacaaaatagagagatcactgttttcagaagcctatatgcaagatacttatgaagtaattaatagtgtgactggaaggttgtagtgtgtgatttaattttatagcatttagtattttcatattaaaaaattacagctttatagaagcttataaaggaaagggcagggaacaacttattgaagacagaactagatccagaggagaggaagagtagggatgactgaggagacaggatagttccctgtgaatttggaagagaattttgaaggagagagagaaaggattgttgagcaactgctttgaggactttgagtcagtagatgagtagtgaggaattttagaaatctccgctgttaagcaattcttattgcttaacaattttcccactatttgagaaactgctaaagatacacattaattttcaaagaaaaaaatgcacattacatggtaaagaatggagaacttccttattagctttatcccatactggaaaatgattgggcattatttgatgagactagccaattgttttaccaaggaaggaacaaagagtagtggaaagttccagtgaggaagggttgtgtaaactagcaaggctgagtgactagaatagaggcagtcaaggatactcataggaaaggcaagaacaatgatggagttgggaatccattcctagcaggatggctggctcagttttacaggaggagtaatgtaaagacccagagctggagagtacatggctcaaggaatgcggataaagccctggaggatacaagagaacctcaccaactttgtgaattacattcaggccattcctgcctaagactcagaagctgacttctgacttttcttgtgagcaatgatgggtctttacttttttaaattatgcccttcagcagaggcagcaggagaggtgacttctttattatgatattgctaactgcaataattagctttaatatcctttattttctgtcatttatgtaacctcctgtcttcaaagaacagaacaaaaatattcaaacttattaaatggcatataactgctacactctcccatagtggatacattgaactcatttccttctctcttcaggaacttatggacatggggaaagaaagattacatacaattcaagataaaatccaaatttcaagcaaaaagagatggtgacaatcgtagattggtatcacctgaatacagcactcggaatgatttccacaggcatataaacattgaggttcttttctcccattttgttgttgactctgccttgcaagaatttttgaaaaggcaactcagatcagtttggctcctcttccctttcctttctccctcctccttctttaaaagggttagcaaatgaaagggaaaacttgaacttcaaggccattatttattatttgtaccctggttcattccaaaatggattggtgaagaccggcaaagatacatttaatgctgcaagagaaaaccgatttaaaaataagaaaaattagtcgaattgaactaagcgtttgagaatcaaacaagtactattgagcacaaccatgtgccttgcagcatgctagttcctctaaggaaatgaaagtgaaatataagatatggtttccatccttaaagactgtaacatttatttgggaagaggaggcaaacacctgtgaaatgcagtatggaggagtgtttaggatctttggctctagagtctagctgtctgcttttatatttctcccacttacaatgtttgtggcttcaaacaagttaacttctttctacttttctctgctcattgtaaactgagaataataataccttactccctgggtttctgtgatgattaatttggtcagaataccttaagcacttagcttattttgttgtaataattatataaagcaaagtgcagctaaacttttaacttcctgtgacatgtataaaaatgggattcagagaaagcagagtgtgcattaaggaagtcagggatggcttcatggtatcggtggcacttgagctatattttgatggatgaggctttaagtgagcaaaagtggagggtaaaggcatgccaatcacgtaggctacaaaatagagtataatgaatggcaagaccagagggatttgtcatcaaaggaaattaatagtctaaaagaacccttataatacttcagaaaatcaatactgtgacatgaatctgatcagtaatatgtggacagctttgcgtttcattttctcaactaggcattaaaccttgatatttccattttctaaaggattaaaggatccttgtgggattattttgaacatcatttctagagtcacggtgtgcagacagccaacaagacttatcaaagtgaatgggacctatgttaaaactacagacacatattattcatttattttttgaggatattttaaaaactttccacagctgtgttttaaatctcactataatgtccagaaaacacatcagtattttcttcagtcaccatataatacctggatcaatcttcagatatacaataagaattgccatgtttgtattgattcattttttttccaaacttgtacagcaggatttaactagcaagtcattcctagtaccaaaagttgtgatcttattagtaagggattcaaagtacttttgatgatacagaagttgggaaagtgaaaaagatttctgtttccaatcagatgttctcaaatgacaaaggtgacctcttttttgggaagtaatggttactctgtgttctatttttactactctcttgtctagctgctagaatagacctaactttgtaagctttaacacttaattccatgtagtgtagagccaagtaaataacttttgaaacaaatgaaaataacaactttaaatatgaatttaatatggactgaaaccatttttcaattgatatgattgtatagattggctactctacaaacctagatttctaaatcaatatgggaatttttagtttctttccttcacctaacacaatacaaagaatcatgtgtatttaattttaaactattaattcaatccaaatgaattattttgcaactatatgcacatttgaatacacacatacaacatatttgcttgcttcaactctcctgacatctcaatttgctgagtataatttggacttgctagtatagtgagttaatatccaaggattttgtcttttccatagggagcttttaaaaattcctttgtcaagctgagatatgaaaaacactgggtcaaagaaagcagggtcataagccaagatcagcagagccaacagaagcagccagggtcaggttaggtggagagaacctagggttcaaggcaaggtagggtttataggcaggaaacccactatgaagtaaacagaggttaagggatacacaggaactgggattccaggcacagaaagcaagctgattcaggccaaaaaccaaatggcccagggaccttgacgctaaagttaaaagctacctgaggcacagagatttacatgctttttattttgcagaaggaactaatgactggcactcgagagctaggactaaaagtgacacagttcatcccacttggaaaattctaacactctaggccagctacaaaatatgagaacatcagacctgaaagagtccttagagattctctcagttgaccctataatttttagaagaagaaagtgtggcttattagaggaatgggcttgtcaaaaaaatcaaagcagtatagtggaagggctggggctataacgttgacgtcctaacactagtactctttacatgaaatgtctttgccttgcctacatttggtacccttaaatgtgagatatgactgagaaaactaggatcttaagactctgagccacactccttgtccaaaggaaatgaaaaaggaaaaaggaagcaaagttaatgggcgggatatgtagtaacaatgggggttttattcattcaacctagataaaattcagtaacagaaacttctattgggattggggcaacttggtgacacaactatgtaagtcttataactaaacaattcctcatccagtggactttgtaactcttatctgattgagccaattgtgtaccaaaacaataacaacaataacaacaacaacaatactcctttaaccaagaaaacaatgctctgtctcatcttactttgaggtctgctgctgtgctacttccctctagcacaggcaaataactatgaacatattccccaccatccccaagaaacattacctggcttcacacatacattctttgaaaccagaaatagtagaaagtttatgggtctcagtctctctttgtctatctctttctctctcccaaatcattattctattctaaggttactcaagtattttctcctggtcttcttccttctcagattaattagctttggtagccactgtcttatctcacggtcactgttgtctgggtagaaaatcctacttttttttttttttttttttcggtttccaccatctgggataactaactcatgtctttctgcctcatcaacttttcatctcccttgtatcttactggaagaaataaattctttcttccttcctttagcttcataatagctttatctcaactataatttagaatttacctctgtgactgtttcatttaatttagaaatgatggggagagggctcttctttagaataaagaatttaaaagggctttataaaatcactctgaaatgtcaaacttcttttttttagtagattaaacactgtactacatattggaagacattaatttctgtaaaacaacatcaaagctggttcataatttgacctcagaaaagtcagttaattcctatctgagcctgtttctaaatctcaatgattcattcagtttgtttgagataataatctcagagaaagaaaggaccttggtatttttaccagtacaacattggctgcaagtgggtacttgatatattggatgactgatagaaaaggccagtgtgaggaatgatgaactaccttgtgattaaattacactgatatacatataaatatatatatatatttatatatatatgtgtgcatatgtatgtgtatatatacatacacatacatatacatatatagatatatgtgaatatataggaattttattttcaaaatgagagaatatatgtttctctccctctcagtgaagctacacccggggatcactggctttcagctttttccttcttaacatatagaacagatgatacgtactgtaagaaaaactattaatgggtctcttagtccattttctactgctgtaacagaatacaacagagtggacaatatagaaaaagatttatttggctcacagttctggagactgagaaatctaagagatggcaccaacatctagtgagggtcatcctgtaatagaaggcatcacatggcaagaacatgagtgtgcaagtcagagagatgaaatccagctgaattcatccttttactaggagtccactctctctctctcaataatggcactaatcctgtgataatggcattaattgattcgtgacagcagagcccttattacctaatcacctcttaaagatcctgcctctcaacactattacattggcaactgaatttcaacatgagctttggaggagacattctgctcttggtccctcaaaacttatatccttctcacaatgcaaaatacattccttccataccaatagccccaaagtcttaactcattacaacataatctcaaaagtctaaagtctgaagtcttatctaaatcagacatagatgagatttaaggtatgatgcatcctggggcaaattcctccatctgtgagcctgtgaaattgaagaaggtatctacttccaaaatacaatagtgggacaggcatacaatagacattcccataccaaaatggataactggtttcaagtaagtccaaaacccaaaatggaatacaacatttaatcttaaaactggagaataatttgctttgcctccctgtcccatatcctgggtacactggggtatgtggctgggtcctcaaaccctcaaaccctttggcagccctaaccctggggcttttatggattcagtctactcagcaattctcacaggttgtagtctcatgcctgtagcttttggaggctggtgttatatgcttgtggccctacagttctggggtctctgaggtgaccccactcctacagccacactaggcattcccctagtgggaactgtctgtggtagctctagccctgtggctggttttaccctagggccctaggctatcaacagcatccatgcacacacaactcttgcattttgcaagcctgcagacttaactccatcaagacttatagattataccttccattttggcaagtctagctacatctgggccctcttgagccatggctgggtggctgaggggtgctacgctgggattcagggagaagagtcctaaggtggccctgagcagtgagcctgtatcagtttattcccacactgctataaagacactacctgagactgggtaatttataatggaaagaggtttaattgactcacagttctgcttagctggggaggcctcaggaaactaacaattatggtggaaggtgaagggaaagcaaggcacatcttacatggtggcaggagatagagagtgcacagtggaaactgccacttttaaaaccatcagatttcatgaaaactccctcattatcatgagaatagcatggggaaaactgcccccatgatacaatcacctccaacctggtccctccctttcaacatgtggtgatgccttcccaatagtcccccaaagtcttaactcattccagcattaactcaaaagttcaagtccaaagtctcatctgaggaaaggcaactccgttccacctatgagtctgtaaaatcaaaagaaagttagttacttccaagatacaatgggggtacaggcattgggtaaatgttcccattccaaatgggagaaaatggccaaaacaaagaagccacaggccccaggcaagtctgaaacctggccaggccatcattaaatcttaaagctccaaaatctcctttgactccatgtctcacatccagagcatgctattacaaggggtgtgctcccatggccttgggcagctctgcccctgtggatttgcaaggtacagcccctgtggctgccttcatgggctggtgttgagtgcttttagccttttcaggtgcatgatgcaagatgtcagtggatctatatttctggggtctggaggatggtggtcctcttctcacagatccgctaggtagtggcccagtggggactctctatcagggctctgaccccacatttcccttccacactgctctaacagaggttctccatgagggttccactcctacagcagacttctgcctggacatccaggcatttccatacatcctctgaaatctaggcggagggtcccaaagctcaattcttgtgttctgtacacctgcaggcccaacaccatgtgaaagctgccaaggcttggggcttgcacactctgacacattttaaaaccatcagatctcatgagaactccctcactgtcatgagaacagcatgggggaaactgcctccatgatccaatcatcccccaccaggtgcatccctggacacatggcaattacaatttgcgatgagatttgggtggaaacacagagccaaaccatatcagagcccatggaggataccccaggcctgttaccccaaacagttctgccctgctagagcccctgagcttgtgatgggagaggctgtctcaaagatcttcaaaatgcctttggggtcttttgtcccttgtcttgatggatggcacctggcttgtttctatgcgtattaattcctttaacaaatggttgcttggccacactttttgtattctcttctaaagatgccttttcactctttaccttgccagcttgcaaattttcaaaatttttctattctgcttccctttttaagtattaattccatctttaagccatctctttgctctcatatctccctatatacaatgaaaagtagccatacagtagcctgaataccttgctgcgttgatatttcttgtaccagatgccctagtttatcacttttaagctctgcattccataagccctggacacagacacaatttcatcaccttctttgccactttataaaaaggatagcctttactccagttttcagtaccttgtttctcatttctttctgatacctcatcacagttgcctttactgtccatattcctaccaacattctggtcataaccccttaagtaatctctaaaaagatcagactttccctacagctctcctcttctcctgagcccttgtcagaattctctttatggtctgtccacatcagtacaagatttttctagccttttcctccagattcgttcagcctctgctcattacccagttccaaagccactcccacatcttcaggtatttgttatagcaacaaccccactctcggtaccaatttttctgtcttagtccattttctgctgctataacagaagaccacagatggtgcaatttgtaaggaaaagagatttatttggctctcagttctagatgctgagaagtccaagagcatcagcacctgttggcattaggtgagggtcatcccatggcagaaggcacacatatgagacagagagaggaaatccagctcaactcatccttttctcagaagcccactctcagaaaacactaacccagttccacaataacattactccattcataagggcaaagccctcatgacctaattatcttccaaaggtcttacttctcaacactgttacattggcaattgaatttcaatatgagttttggtggggacattcaaaccataacaatgaaacatgcctcatatacaagttatgactttaccccttaactcccattcaaaaagaagtatactggaatgcatatgtgtaagagtgacataatataatggtgacttcagctctcctgtaaatttttaaataactaattcgttaacttcattattaccattattagcaacaatcttcttaaaatatgtcttacaactgaaagtagcatgctccagtgttccatgtgttctgacactggcctgctagactagagcatgtggttcagggcactctcacaaatacagataaaagatttgtgccctgattgtggattatcttaaggaagaaataaacgtcttgaaaggtgaagctacaaagttaaatacataaagcgcagcaggaaggtgattagttttcacattggcatcacaactatccattcttctttttatcttatgttgaaaggccatatcaaagtgtgggcccagggaagaaaggatacattaacagtaacattaatataaactctatgtttaactccttggtaagactggtgaaattaaaattaacttgattacgtaggacaaagatacacaatttatagatttttgtggtagaatttcaggcacctagtcaataaggtagaatgaattgaaatggtaaagatcacctcttgttctaactacagagaaatgctggtcaaaataaggcaaataatttacatgcttagcccagctggaaagcaagtaagggaaattctcaggccttagtgataaatagggagctcaaagtaagagaaaggagtataaattgaaattgaagatctcctggagatatcaaaaccaaatgtggatattcagggtacatgggcttgagtttaggatctatgtgaagtatggagttagagcagatcccagcaaaaatctagaaaactgaatgatttacaaaccctgaaatctatgaaatggggcctagaaaactctgcttattgattcaggaaagtgtacagaaaattcacattcactccagggccatagctatgaatccaaggaaacatttaagagaaactggaactctaaacctgtaccaagcatgggtgtggactctaaattcacataactcatatatgacacaagcccccaagcaaagaaattgacagaaaaactggttccaaaccagtgaaacttgtagggccttggtagaagcaaccttggaacttctctaagggaattcctctataaccctcagcatgtgggactaccacagaaaacaatccctgctgtagatgaaaatacagcaatgaaattataaacctcataagaaaattaaccaccatgatgttgcttcccttgacacaatggaaaaaaaaactgcataccaagaagtagagataataggacaatttaatagagactttaaaagaggttgaaaattgtttaaagagaaaaacagaatggagaaaaattgtttgtcaagaaaagggcagtgatggttatctgtggcctttacaaaaatatctgtctcttgtgtttatttaacaagaacctgtttaatgggagagtaaaaacattcctcccaggagaaattgcagcaatagtcagtaccttatgtgtagtgccaagaaaagagcagtcattttttgatagaccacctcaaggaggccccattttacacagtgccttcattctgatttcttgttctatccaggcccacagccacttggatgcttcctactcacactgaagtggatcttgccactcagccaccaaactcaaataccaatctttcctggaaaccccagacagacatacccagaaataatgcattaccagctatctaggtattaatatttcttaatccagtcaatttgacacctaaaaataaccattatagtttatattacctaatttttcttaaaacatgtaaaaatcagaataaacaaatttctgtgtaatcttaataacagtggagagtatattatgatacgtcttctcaccaaccaaaaatttacttatacttttgattaatgttagtttcaagggcaagttcaagttagcagtgcttaatattctcaaaaataaacaaaaaagatagtcttttcatttgattttttcgtattatttcataagaaggaggcagcaaaaataaacagttttaaaacctgtgtaacaaacagctttgggaacatagggagaccctgtgtggtcccagctacttgggaggctgaggtgggaggatcacttgagccagggaggttaaggctgcagtgagctgtggttgtgccactgcactccagcctgggtgacagagtcagaccccttctcaaaaacaaacaaacagaaaactgagtaactttgtattcccacttttgattatactttgaatttaagtttttttctagaagccctcataactatttaaaatttttcccaggtacaatgataagatgactagaaaaagagttgaaaattgggtcacctctgagttttcctttggatgttaaatggtcgcttcctgtctcccactgataatcaggagtcatttgctcatttctttttctctcattctcaggtaagcctctgaacatcccctgcaaagcattcttcggattcagtggagagtctgggccaatgatctactggatgaaaggagaaaagtttattgaagaactggcaggtcacattagagaaggtgaaataaggtagagagcttgaattgcttatctttctttgctgtcttacgggattctgctcaggattttaattgcaactccaaatcattccattctctaaaagctgatcttatggagagaccaaggatgactgccttaagaaatgccaatgtgtaagcttctaacataagtaggtctttctcccatttaaagattatgtcaccagggtataatgaccctccaaaagctgcctaagcaaattcctttgagtttctaaagctaaaaccactggtactccaacagtcacagcaaaggtccagtctttgaaggtgactcctcagaccactgggcaaattgtttattttctacctgggaacagacaaccttcatatgtcataagtgtaaaactgcagtggcaatggtaagctggtcttcagccaaaataactgttaactcttgttgaatactgtttatttttcccaacatctaatacttatcctgaaaagactgatccttcaatttagtacatgtttagacctcttttcactctcctgttacacaaataattctctggtttatagataccaattctattggttttctaattctatttagtactttctcatttgtacaaaaaagatataaaaatataggtaacctttctcgcctcactcagtttgtgaggtttctctttggtttcagagatgatgatgtgtagtgtatgttcctgattctgataggaattgggattcttccctcttcactcccattaagaatcatgcagtgaaaattaatctaaaatttcagtataactaatgttaaagtttattccttcagttttcttattgaatatagagcagcataaatgagacaagtatgctttgtattatttactatgtttaaatgttatttataattactctcatgacagtttctctccatgtgtctacccaataactcttttctaggggttcataactttgaaggtctgtgaaccccttaagagtctatgcaaaatatttactataggagcatatttctaggcaaaatacacatgaaaaggtgtttgacatgtttagtaatcaaggaaatgcaaaccaaaaccacatgataccactttatactcactaggatgcactaggatggctataatttaaaaagtcagattataggctgagcacagttattcaggcctataatcccagcactttgggaggccaaggtgggtggattgcttgagctcaggagtttgagactagcctgagcaatatgataaaaccctgtctctccccgcttccctgccaagaaaaaatacatatatatgtacaaatcttagccaggcatcgtgctatgtgcctgtagtcccagctacttgctacttgggaggctgaggtgggcacatcacttgagcccaggatgttgaggtggcagtgagtcatgattgttctactacactccagcctgggtgacagagcaagaccttgtctcagaaaaaaaagtcagattataacaaatgttggtaaggatatgaagaaatgggaaacctcatatactgctggtaggaatagccctcctagggatataaacaaagtaaatcaaaacatatatctacaaaaaactggtccatgaatgttcatagcagcattgctcataatagacaaaaatgaaaacaacctaaatgtctatcaactaaggaatgaataaataaaatgtggtacattcatacagtgaatattatttaaccataaaaaacgaaatattggcatatactacaacctgagtgaaccttgaaaatgttctcagtgtaagaagccagaaacaaaaaaaacacatactatatgattcaatttatataagatgtccacaataagcaactttatagaaacagaaaatagattactgggtgcttagcgccagtggggaggaatggaatatagatgtgatagctaaagtgtatgggtgtgtttttgtgtgtgtgatagaacacaacataatataaaattcatcattttaaaattcacaatttaatggcattcagtacattcagaattcatacaaccaccaccactttatagtaccagaacattttcatcactctaaaaggaaacgttgtacccatcaagcagtctggggcttctttataagataatgaaaatattataaaattgaccatagtgatagtttcacatctgtgaatattctagaaaacaaagaattgtatacttttaatggatagattatgtggcatatacattttatctcaataaagctgtttttcttaaaaaaaaaaaaacccttgaaattaattgcctgacacagaacagattttcagaaataaataatggatatattacaaatgattctaaagtattaattgccatttgtactttgaagtttgtaattagtaacactttattaggcaattttaatttaatatttatttgaaatcaatacaactgaattcattttaaattgttatagaagatacatatttaggattactgtcaacgtatctgtgtataaaagaccttaagggtcacttttcattctacagaacaagaaactggtcccaaaatggatatgtgataggtacactagtatatagttagtagcagaagttccatcaccaaaaagctcagagatatgttttgtgatcaaaggtactaattatatgagcctaaggtaataatctccctttttgtatgtgtgactgcatgtaacttttaaaataaacagctttatcagagtataattgacatataataaatcacacaatttaaagtatgcaatttgtaagggcggattgatatatgtgtacacctgtgaaaccatcacccacaatgaagataacatattaatcacccccatgtttcctggtgcccctttgaaatccctccctcccgcccttctccaacaacagggatcttctatcactataaatcagtctgccttgtctagaattttatataagcagaatcatacaataggcacttgttttgctctggattatttcatgtagcacaattattttgagatttctcccatcttgttatatgtgtcaatagttcataccatttttattgccaaatagtattccattacgtgattatacaaaaattactcttctattcacctgttgatggacgacatttgggttgtttccagttaggactattatgaagaaatctgctaggaacattcatatacatatctttgtatgcacatatattttcttttctcttgcctgaatagctagacatggtgtgcttgaattatatagtagacataaatttaatttttagtttattctttaaataaaatttaaatcatttttaaacaaacttttttagaataatttttgatttataggaaaatcatgaggatagtatatagagttcctatataccccataccccgtttccccaattatcgacatcttaggttcttatggtacctttgtaccataagaatactgctcatgtctaggtattcaggcaagagaaaaggaaatatatgtgcatacaaagacatgtatatgaatggtcatagcagctttcttcataatcgtccaaactggaaacaatccaatgtccatcaacaggtgaatagatgagcaaattgttgtatagtcatataatggaatatacttggcaataaaaaaggaatgggccaggagcggtggctcatgactgtaatcctagcactttgggaggccgaggtgggtggatcacctgaggtcaggagttcaaggccagcctggccaacatggtgaaaccccgtctctactgaaaatacaaaaattagctgggcatggtggcaggcacctgtaatcccagctactcgggaggctaagacgggagaattgcttgaacccgggaggcaggggttgcagtaagctgagatcatgctattgcactatagcccgggtgacaagagtgaaactccatctcaaaaaaaaaaatcaaaattaatacattgttattaactaaagacatttctttacacacctttctttagtttttgcgtactatcccttttgttctgcaggattatttaactttttaagaatctgcctaactgtattccaaactggttataattttacaaaagaaaagtgaggcactgctactctctccagcagcaaatgattagagttggtgggagacaaaacatatatacatgagttggataaatcctgaacaagccaccatattaggggccaaatgagtcaaccagctaggaaatgctataggaagacaacctttcaggacttgcaaaatgacattgtttaactgattttgttacatcctgtttctccaccaaatcccccagtaaaataactatattagcagtgacggaaagttccaggaaatttattttgaaaatttcacaagaccctactagctaactaaagtcaccttcatagaagtgccaacaaaaaggcagaaattcccagcctgggactacaggcacataccaccatgcctggctaagatacagtcactcattttgtaatatagtcaggagttgcctaatgatggggatacgttctatgtaatacattattaggtgatttcattattgtgcaaacatcatcgagtgtacatatacaaacctagattatagcctactacacacctaatctatatggtatagcctattgctcctaggctacaaacctgtacagcatattattgtactgaatactgtaggcaactgtaacaccatggtaatatttgtgtatgtaaatatatctaaacaaaggaaaggtacagtaaaatacagtgttataatcttatggggctacctttgtatatgcaatatatcattgactaaaatgtcatcattccacttcatatgtcttgtgtgatccatgatctatttggaagcttgtgtggtttctataattctttcagtctagagccatttatgctaatacaggaactaattaaccatgtcttctagcctccaaagtccttgaaacaaagcatacaagattttatacagcacagcaaattggaacaaatccagcattttaatagaaaaaaattgctaatcatactatttaggtgaaccaagagaagattcacattttttcataacccatatattttctccataaggaagagttctgacggcagaatactgagaatttttaattaggggattcctctcaaaggcatttctagaaacaaaatttatttctggatgcatggcccttattcagtgctctctctgtctgtacaggacattgttaaaaaataccttagactggggtaatttataaacaacagaaatgtattagtcaaagttctggaggctgggaagtcaagatcaagatgcctgtagatccagtgtctggaaagggcctgtgatggctggggtagccctgaaaatctctagaattccttcttctatcgtcctaatgaataccctctggcttccttatatctatactaatcttatcaaacgttttcttggccacactcttggtgttccctatttaacacactctttcattctttgcaacatggctgggctgagaatgtcccaaatctttaaattctgcttcccttttgattataaattttatctttaattcattttcttctctcattttaccataggcaatccagagaagccatgccacaccctcagtactttgcttagcaatttctttcactaaatatcctattgcaccattcacacgttctaccttccacaaagcactaggacatgaagaaaattcagccaagttctttgccactttataacgaggatggccttcacttcagttttcaataacgtgtttctcatgtaagtctgagcccacataaaaatggcctttactgtccatatttctatcaatattctgatcatgaccacttaagtaatcgctgagaagattgaagcttcctctacagttctcctcttctattgaaccctcaccagaattgctccttacagttagttcatgttgatataggctttttctagcctgctcctccaaattattccagcctctgttcattacaaagttccaaagccattccacattttttggtattttttttaaccagagcaccccactgtcagcaccaatttttgtcttagtccatttgggattctataacaagataccttaaatgggtaatttaaaaacaacaaaaatttatagcccacagttctcaaggctgggaagtccaagatcaatgtgctggcagattaagtgtctggtgagggcctgttcctcgtggatggaaccttctgtgtgtcctcacatggcaacaagggcaagggaactcattcatgcttcttttataagggcactaatcccattcatgagtggggagccttcatgatttaatcacttctcaaaggccccacctcttaatactatcacgatggatattaggtgacagcatatgatttttgggagaccacaaacatttagaccatagcaagggcattgctttgggcccatttaaaaattgaatcatagctcttgtgttgtgcacacatttcaaaattgcattgtgtaatataaccaagcagtgaggatgtaaataaatagctctcaggcagttgacttgtggagaagcttccccagaagcactgggtctggcaggagaactagcccctctgcctaggttctcaatttcctgtgcagcagcttgatcctagaaatgtgtgttacaactttttatttcttagtttgccacagaggaatagaggacttaaaacaatacctagtaaaaaaaagcttagatatttactgagagcttgatgagataatgtcacttggacttcagtaagtataacatctgtactcagcatttcccctgctgcttgaatagcattttagatcaaatcctgtctaacattttggagttctcatttgtttgctctctgggtcagtttcaccactgtggtcccgagcctctcctgattttcagcccattgccaaagcacttagaccccactttgggcatacagattcccctttatctccctttaagcagagattggcacagttctcccatgcctctgatgttgctaagagactaagccacaaggaaatctgaacccaaatgtggtaaccattcacaactgctaatctatcccacacaactgcatcacaaccctttcactaactccagaagatataatttatagagatggtaaaataattttatgtgtgcagtaacataagatgtaattgtacaagtttggttatttatttctacaattttaaaatcattccaacaatctgctctctgccaagctctaccatgtttattcagagaagtcaaataattatttcgaggaaacctagtaggaatcataaggggaagacttcttactttctgtccttctgttaaagcttaatgggaactgctgcaaaggaggatcagagagtacccgcacaatgtcctttggggataatgattctaggaaggccacctcagtcctgtaccactacagaacttccttctaatcaatcttacaagaggcttgagaattttgttttaaggaatttgctagtgaggtatgtattctacatagctaatttaaaaagtcagaaaaattgaaccagtcctattaaataagaaataatagtattatagattgcctacagggttacgcattgcatctgattgtcaaaaaagactccacgaatttcaagacaattgctttgtcccaacagagagtcattttcaattataaatctcactttacaaatcgccctatcaatacctaatgttttcttcctcaggcaatactataaaacagtttaccaaatcttttctaagtcttgacctgaaaaacatattcaatttatcttaaggttttcagaaaagcttactaaaatgcaaataattttatttaccttcagttcctgaaaggctgtgagctgaatatggtctttgctggtttgttttagttttggtttcttcactgctgctttttaccactttctggtcttcggtttcattcctttaccttaacatcctctccttgcatgactgaaatgctctaataaagagggaaggtgatataagcatgaaaatttttattcttaaaataaggtgagtctatcttaaagaccaaaactaacctaataatgacccactctttttaaaaagcaatatggagctgtgaatatgttgtttgtccctaaaatacagaggaaataattggactcccaggcagtcctagggaaaatgatgagatgtattttggcaacttctcacacaatttttaatgtcttgaaggaccccacatgtccttggttttcccaaagttgagcttcaaaaaagtattttcctttcttctactctcagctcatcctactggaagaagaaatacagatcaatcactttgctttaatttaaataggtttcaaatctcatcacacctgtatgtgaatgtacacattataaacagcatagttttacctagggccgtccttaatttctagttaactaaaggtacatttttgaaggagtggtgaatactattgatgattccagggttggtcttatccttgatctatgcataaaatactaaaagcctacctaaaacatgtttgttgtttctcttcatttattgagcagattttagatgctcagtctcaactatgttgtgttgggttgtaagctactctagacaaaaacctataattagtaaataataataataataattccagttcatccttttatagtacactgcatattgcaaaagcatttcacatcttaaaacatattggatactcataataaccatctgagataaatactattagctttattttgcagataaagaaactgaagtttagagactgaggaagagctgctgccctttagtgattgagggttcctatagggctagactgaattcatcaaagctagcaagaatcctcaattgtccagaatgttttgttgtactccagatttagactataaaaagtcaaaatctgtcggggactgaaagagtgaaaatcagtgtggactgagaataagcagccctgctattaatcaggctgggaggacagacagataaagccagctgcaaagttagcagaaaacactgtttctcccaaggtcatgcagcagttgtaaaatgccataatgaccccctcctcctttgagtgactactgctttcttaccagtgatgccccaaacctgctttgctgcttacattaactaccagggatacccaactgctaagctatccttgccccataagagaacccagtccctagttaacccccattttttccaatcctgcctcagaaactccaaccaatccaggatttacccctgcttccctaaaacctcatcagaatctttcactgtaaatgtaaacattacaaaactttcttccttccttcaatcaaggattaatccatagttcctctagaatgcccctccctcaatgcattgagccaataaatctgattttgtcagactctgggcatgatgctggacttggagtaataatgctttaatggggaggggggagcaaataacaccaagaaagagatcttgtttaattgaacattttaatttttttaaacatacctcccatccttaattttatcaatcatcattcctggacaatgattactcatactcaggataatgacccagaaactctgcaagacacctagccatcaaaggaggactcagaatacttcaagggaccatttacgatgaatgaaaattggtcttagaaattttataattatttacctcaattaagaaaccaacaggactttctatttaaatttcaggtgaacagaaaattcagttagccagaatttccatccctgagcaattccactaaccaagatttcactaaaatttcattgcatttgtgttcttatctgaatgttatgttatcattcccttcagcattgcttattttagtttatgatctttaggacagcagggagcacctacatgtaaatattagtacaatgtctggtagagcagattgctgtttacaaataagtactttttgataatgaggacagcagaagtgctagtagtgatattgatgatatgggcagatattgaagagtataaactctctggtggcagttcaacatctttataaaaaattcaaagtagcatgtcccctggaagaaactggaaagtaatttggaatctgcctgctaataaagtatttacttgtttactttctccttttattgccttagttaaatttattagaggaagtcaataatgagaaataatgcacagtagtttgagacggtatttgtttattaatacttcccagcttaccacattgccaggcatatataacttttaaaacatctgtttaatggcattgaattgtactaaaatgtgttaatatagtgtcttgctagcattacacacacactgtaatttttagagcagatttaagttcacaacaaaattgagtggaaagtacagagttcccacattacccacaagactccccccactatcaatatccagcaccacagtggtgcatttgttgtaatccatgaacctatattgacacatcctgatcacccaacgtctatagtttacatttagatttcactcctaatgttgtaccatctatgggtttcaacagatgtatgatgacatgtatccaccattacagtatcatacagatgagtttcactgccctaaaaatcttctgtgttccactttatttatctctccctctcccagaactcctggcaactccttatctttttactgtctccgaaatgttgccttctccgaaatttcaatagttgaaaccacacagtacatagccttttcagagtggcttctttcacttagtaatatgcatttaaggttcctacatgtcttttcatgacaaaatactttaaaaaatgcattcatttattcaatgtgcctttactgagttttcttaatgctaccagcaccatgctagttgctagtggtacaaaaattaaagctacagcacaccataaacaagtagttccagtaaaacaccttttgaagaggcaaagaagatttatttatttaataagctttatttttcacaaatagctttagggttacaaagaagttaacagataagaggatacatttttttttgaagagttgagcagaaagtacagagaactctcatatagcccctttgcctctcccagtttcccattttgttaatgtcttgacttagtgtggcacatttattacaattaatgaaacactatacattattgttaaagtccatggttgacagtagagttcattctttgtgttatacagttctatggtttttgacaaatgtaaaatatcatggatccaccattactgtatcatacagaatagtttcactgtcctaaatatcccagagctttgtctattcatctctccctttctcctcaaaaactcttggtaaccaatgatctttttttagtctttatagtctttatagttttgccttttccaaaatgtcatacgtttggaatcctacagtatgtagccttttcagactgacttctttcacttagtatatgcatttaaggtttttccatgtagttctgtggcttgatggttaatttctttttatcaatgaataatattttattgtctggatgtaccacaattgtttacccatttacctattgattgacatattggttatttccaagttttggcaattatgaatgaagctgctataaacacttgtgcaagttttcgtgtagctataaaaagtatgattaatgcatcatactgtaagacaatgtttagctttttaagtaactgccaaaatatctttcaaagtggctgtaccattttgcattcccaccagcaatggatgataatttctattgcttcacatccttgccaaaatttgatgttgtcagtaatactgggtttcagtcattctaataggtgtgtagtgtatgtcattgtctaaatttaaaattccctaatgacatatgacattgagcatatattcagatgcttatttgttatctgtgtatcttctttgattaggtgtctgttcagaacttttgcccatttttaaattaggttgttagtttttttatggttgagttttaagaggtttttgtgaattccatgtagaagtttcttaatctgtatatgttttgcatatattttctcccattttatggcttagctatttattctttcaactgtttttcacaaaacagatgtttatgattttaataaagtccaacttatcaattgtttttttcatggactacatttttgtcgttgtgtctaaaattttatcagcaaacacacaaatgagaaagagaaagaacacaaatattaccagtacagaaaacagaaaaccaccaaaccacaatataaaaaagcaagagacgaaggaaggaaggaaagaaggaaggaaggaaggaaggaaggaaggaaggaaggaaggaaggagggagggagggagggaaggaaggaaggaaggaaggaaataatacaaaacaaccagaaagtaattacaagatgacaggaataagtccttacatattaataataaccttgaatgtaaacaaattaaatatcccacttaaaagatatagattggctgaatgaattttaaaagtaacctaaatatattctgcctaaaagaaacacatttcacctgtagagacacatatagactaaaagtaaagggatggaaaaaatattccatggaaaaggaaatgaacagtaagcaaaagtggctacatgtatatcagataaaacagactttaagtcaaaaacagtaaaaagagacaaagaaggtcattatataatgataaagtgatcaatttggtaagggatatagcaatggcaaatatttgtgcacctaacacaggagcacccagatatataaagcaaatatttttagatctaaaaggagagatagacatcaataaaataatatctggggacttcagcactccactctcaaaaataaataaattatctagacagaaaacaacaaagaaacattagatttaaactgcaccttagacctagtggatctaatagacaattgcagaatgtttcatccagcagctgcagaatatacattcttctcatcagcacatcaacattctcaagaatagaccatatgttaggacacaaaacaagtctcaacaaattttttaaaattgaaatcatatcaagtatcttctcagaccacaatggactaaaactagaaatcaataacaagaggagctttgaaatctgtaggaatacatggaaattaatcaacatgtccctgcacaacgactgagtcaatgaagaaattaagaaataaatttaaaaagtcgagaaacaaatgaaaatggaaacaaaacataccaaaacctgtgggatacagcaaaagcattacttgtttataggtataaatttgtagtaaatacagttaaaagtttatgcttacatcaaaaagtagaaagatttgaaacaaaccacctaacaatgcacctcaaggaactggaaaagcaagaacaagccaaaccccaaattagtagaatgaaagagtagagatcagagtagaactaaacaaaatagacactcaaaaactacaaaggatcaacaaaatgaaaagttattttgaaaaaataaacaaatttgataaaccactagctagactaaccaagaataaaagaaagaatacccaaataaacaaaattagaaatgaaaaaggacacattacaactgataccacagaaatacaaaagattatcagaaactactatgaacaactatgtactaatgaacccgaaaacctaggggaaatggataaactcatggataaatataacctaccacgattgaataaaaaagaaagtgaacccgaacagaccaatagcaagtaatgagattgaatcagtaacgtctcccaacaaagaaaacagtataaagacttcttaaaaaaacaaaaagagaagtaccatatgatccatcaatcccactactgggtatttatctaaagaaaatgaaattagtatctcaaaggcatacctgaacccccatgtttattgaagcactattgacaatagcaataatatggaatcaacctaagtgtccatcaatgggtgaatggataaagaaaatgtagtatatttgcacagtggaatcctattctgccataaaaagaatgaaattatgtcatttgcagcaacatggatggaactcgaagtcattatgttaagtgaaataagccctgtactcacttatatgtaggaagtaaaaaaaattgatttcatgaaggtagagattagaatgatgattaccagagcctgggaaggatgtgagtgtggggcttgggggaggaagagaggttggttaatggaaacaaacatatagttagatagaaggaataagttctgatgttcagtagtagagaagggtgactgtagttaacaacaatgaattatatgtttcaaaatagctgaaagtgaggacttgaaatattctcaacacactgaaatgataaatgctcaaggtgatggatatcctaaataccctcagttgattattgcacattctgtatatgtaacaaaatattaaatgtacaacataaattaaaaatattacgtattaatagaaaataaagtgatattgatatagctggttaaacatctactatatttataacagtttttttattcattgctcttattatttgtttccttttttgttctccatgctttttctgccttctctggttttaattgagcattttatattattctattttttcttctctcttagcatgttatatggtttgcttctttgtactcaccaaatctcatgtggaattgtaatccccattgttggaggtggggctggtgggaggtgattggatcatgggagtggtccttcatgaatggcttagcaccatccctttggtgctgttctcatgatagtgagtgagttattgtgagatctggttgtttaaagtgtgtagtgtgcacctccccacccctctcttcctcctactcctgctatgtgaggatgccttgctctgtgtttgccattccctgtgagtaaaagctgcctgagggctccccagaagcagatgcttctgtacagcctgtggaacggtgagccaataaaacttttcttattaattttacccagtctctgatatttctttataacaatgtgagaatgaactcaaacagcatatcaattatattttcaaatttttaattgtatctctagagtttgcaaaatacatttctaactaatctaagtccacttccaaataacaccataccatgtcacaagtagtgctggtgcatgataatggagtatttccaattccaccattttttaacatttctgtcattaatttgcctatttataagctataattaccaaatacatgattgctattattttgaacaaactgttgcctgttagatacggaataagaataataaaataaaatattttattttgatttatccctgctctaacactattctttatgtggatccaaatttctgatatatatcactttcattttctctgaaaatcttttaacagtttttccaacacaggttgactggtgacaaattccctgttttagtttgtctgagaaagtctttatttatccatcacttttgaaggataatttaactgaatatcacattctaggtttgtaattgttttatttcaacactttaaatatttcaccccactctcttcttgcttgcatgatttttacagagaagtctgatgaatttcctattcttgtttatctataggtgtggtgggtatttctttttacccctctggcttctttcaagattttgtctttaattttatgcagttagaaaatgatatgcctaggtgtaggttttttggtatttattctgctttgtgttcttggagcttccttgatttgtagtttggtgtctgttaataattttagaaaattttccaagcttattaattaaatatttctactgttcctttcttctatttctggtatttattatatgcatattacttctttcgtaattgttcctaaactcttggacattttttacattattttttgtccttttttctctttgaatttcagtttaggaggtttctattgacatatcttcaaatgcattgattctttcgttggctgtcaacatattttgatttctagagtttccttttgatttttttcttagagtttccatctctggttaccttactaatttgttgatatatgttgtccactattttcattggagcccttaatatattaatcatagttatcttatatttccagtttggtaatttcaaaatctctgccatatctgagtctggttctgaatgtttgctttgtctcttcaaactgtggggattttttgttttgttttgctttgctttgatttttaatatgccttgttacttttttgttgaaagccagatatgatgtattgggtaaaagtaactgaagtaaataggcttttaatgtgagattttatgtttatctgactaaaagttagactgtgtttactctttggtatagctataggtgtcagaggctgaaattccctctagtgtttttgttcttgtctccactgtcttgtttgaattttcctcgagattacttcttaaatagggcctgagctttgcaggttttttttttgcaaataaaatcccttattattatacaggagcctgattgatgttgtggaacatatttcaaaattctatgatgtcactgcctttagtgagcttgtgcccctggtatgttaccttcataagtgtttcttagcttcccccatccctttaggtgagaggaaagctagagtagtcatttcccttctcccaggtgggctaggctttggtaaaacctaagtagtttaggtcatgataaagtggtttcccttgagagcaagcttttaaaaaaagaaaagaaaagaaacaggatcttgctctgtcacccaggctggtatacagtggcacaatcatagctcactgcaaactctaactccaaggttcaagtgattctcccacctcagcctcactgggaatacaggtgcacaccatcaagcctggctaattttttaaaattattatttgtagatatggggtcttgctatgtttcccaggctggtcttgaactcctggcctcaagtgatcctctagccttggctcccaaggctagaattataggcatgaaccactacactgagtcaacaagcatttttaaaaggaggacaaagtgctctgggctcattttaaaatggtcacttttccctttccccctgccagaagcataagggaacctttttccaatcttcacagtaagaacttagtagcgcttatgtaggcaaaactcacaaaattgtggggtccccctaaatataggtctcatggtgtttttaactctcaagatagttcatggtgggtctccaggaatttatctattacattataagtgtttgtggtggtactggctttgctcctggggatctcattccagtatgctgtgattctctgcatttgcctttctctcaactttctggggcagaagtttgccctgtgacttgttatttgagggatttaagaaaagttgataattttcagtttgttcacttttttctttttgtgagaatgagaggaacaatttccaaactctttatagtattaatttgtactaatagtaccaatctaaataaaattttggaatatagtgatgtctgtcacctgaactggttactttctattgtatcagtgttcactgctactataacttgcctttaatgttaatatttagacccctctggttactacccctccctcacttgccatggatgcatgcatatgtgcaaactcatcaaattgtatatattaaataagtgagtttttttgtatatctattgtttcaataatcagtttaaaatgtatgtggttcttaccctcccacataatatcaatacttggaatgagatacttctaaggtcatatgaaatatatcccaggattcctcccttataacctcgactctgaaaccagtctctttaatacctctctttcacacattctgcaaaaacctactcttgtcttctattctggaaaaccctcccttcttttcatttagtgagaattttcttaagcattttttggataacttagtcaacagacatactgttgtaagcatgagtgtaccaccctgctttgccttattctttctgtaattttctgcaactgtgtacatcgtgtctcctcatttaaattttaaagtttaatggaagaagggaccacatcttttaatgtttctatttcttgtatgccaaatatatagcccagagccaggcacttactaaatattggaaaagaatcatttatggattgttatactcttcacggaattagaaaaaactatttaaaaatgtatatggaatcaaaaaagagcccgaatagccaaggcaatcctaagcaaaaagaacaaagcctgagacatcacattacctgacttcaaactatactacaagaatatagtagccaaaatagcatggtactggtacaaaaacagacacatagaccaatggaacataataagcaatgccaccaatcaacaaccatctgatctttgacaaagttgacaaaagcaagcaatgaggaaaggactccctattaaataaatggtgctgggattattgggtagccatacacggaagattgaaactggactccttacaccatatacaaagatcaactcaagatgaattaaatacttaagtgtaaaaccaaaaactataaaaatcctgaaagacaacctaggaaatagcattatagacatagaatctggcaaggatttcatgacaaagatgccaaaagcaattgcaacaaaaacagaattcgaaaaatgggactaattcaatgaaggagcttctgcacagaaaaaaaaaaaactatcaacagagtaaacagacaacctacagaatgggagaaaatatttgcaaactatatatctgacaaaggactaatatccagaatccataaggaacttaaaaaaattaaaaacaaaaaaaaaactccataaaaaagtgggcaaagaacatgaacagacacttttccaaagaagacatacatgcagccaaacaagcatatgtaaaaatgctcaacatcactaagcattagagaaatgataatcaaaaccacaacaagataccatctcacaccattcagaatggccattattaaaaagtcaaaaaatagcagatgttggtgaggttgcagagaaaggagagtgcttgtacactgctggtgggaatgtaaattagttcagtcattgtggaaagcagtttggcaatttctcaaacaacttaaaagagaattatcgttcaactcagtaatctcattattggattattgggtatatacccaagggaatataaattgttctaccataaagatgcatgcatggctatgttcaccacagcaatattcacaatagcaaagacatggaatcaacttaaatgcccatcagtggtagactggataaagaaaatgtgctacatatacaccatggaatagtacacagcaataaaaaaagaatgagatcatgttctttgcagcaacatggatggagctggaagccattatcctaagtgaactaacacaggaacagaaaaccaaataccacatgttctcacttataagtgggagctaaatattgagtacatttgaacacaaagaaggaaacaacaaacaccagggcctacttgagagtcttggagggtggcaggagggtactatgcttattacctaggtaataaaataatctgtacaccaaacccctgtgacaggcaatttataaaacaaacctgcacatgtacccctgaacctaaaattaaaattaaaaataatatatttgctagaaaattatgactgctctgttgagtgatttgtagtcataaacaccattttgatctttaattccaaaaaacacaagtcacctatgtttttcaggagctgataattaagacacctcatatatattaatagatgaaccaaggatcatttttcaaatcctctctccagattctttctgcagcctgtgaagagctgtttttggaaactgcattagaagaaggaaaggcttggtttggaagaacaggatcagctttccaccctgtgcctggcagaggctatggctgccctccatgtgaagcttcaaattaaaatgaagttgtggtgcctacgcagcttctggaactacagggggttcttccacagcaggttacacagagctaaaataattgagtgtggtgttgtttaccaacatcagggagaaaaacagcaaaagtcaatataaaccatgaaagtagtaaattcccaattttgtcttggttaggtacatgttgggagagaagagaaaaagagaaactacaactttagtcaggaaaaataaaaacaatttatagaaaaactaaccataagatgtggtctcccaaatgcagttaagaaaattcttatacttgtctggttctgtgatggtacataaatgtaaagggcttgagattttagtatgagagactcagattttagaaactccattccaccaacccaactttaagcccttcctgctctcaaatgggaagcagaagaggttaagccaagccaatcttaaatgtcagtaaatgtaaatacaaatatttttggagtagctaaaatacaatctaccttcagataatgaaatgtttgtgtttaataacatacctttacatatgcatagtgctgtttacttttcaaatcactttaacccattttacccttacaacaaagttaaagtgcgtatggtagttattttacagtttcaggatgagttaaattaaggcaccattgagttaatgatttgtaaagaccaagctggagcttgttgtaattgggaggcgggtacttagagcccagtttttttctaagcagtcatgtttccaattttatgctgagtgccagtaagtcatagggatattccctgcatttataaccaggtgtccaaaaagaagatgagaattacttctgcttctccaatttcccatctaaaatatttcatgattgaaaaatatatgtatttaagaacctactccagagctaaactgcagggttgtcaccatgtagacccatgatttgctccttctttggccaaaggcaagagaaagaaaagagaagttgacagggtacccattttcatctcacccagaaggtagctggtcgttgttgacagtataactctccaaagaaacaggaggcgcactcttcaggaaataacccaagcaattcagcccctctgcaaagaacatctgttcctggccatacaagatcctttgcagctttaaaaaaagcaaggctaggagaaaatgttgcagagggcttctcctgtgagggcagaaagcagagggacagatggggagcagtgtctggagaaatcagggtcatgggggtgttagcatttttgggggattagggctcagagcacattactgcattggacaaaagccaggagaaaagcagagagcaggcttctcactaatgtatggagatagaaggccactaaaaatcttcaatttgcttctcataaggcaaccatattcaaggcccccttctttacacctttacctcactactgtcaaaactctaacctctaccacaaaacctatactcctacagattttttcccttaatgccatgatgcaaaaatccaattagtttccatgatcttagtttagagcttggaacccagtgtttcctccttttcaccatacaagccatgctgactttatttatcaaagcctagtggcatgttaatatttctttttttttaatgccagaaatgttttacgatttatttatttatttattatactttaagttttagggtacatgtgcacattgtgcaggttagttatatatgtatacatgtgccatgctggtgcgctgcacccactaactcgtcatctagcattaggtatatcgcccaatgctatccctcccccctccccccaccccacaacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctgcaaaggacgtgaactcatcattttttatggctgcatagtattccatggtgtatatgtgccacattttcttaatccagtctatcattgttggacatttgggttggttccaagtctttgctattgtgaataatgctgcagtaaacatacgtgtgcatgtggctttatagcagcatgatttatagtcctttgggtatatacccagtaatgggatggctgtgtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgggcagtttttcatgtgttttagctagcagaaggcaagaaataactaaaatcagagcagaactgaaggaaatagagacacaaaaaacccttcaaaaaattaatgaatccaggagctggtttttttgaaaggatcaacaaaattgatagaccgctagcaagactaataaagaaaaaaagagagaagaatcaaatagacgcaataatatttctttttgccaagtgaattattcacttcttttcttttccatcttatcttcatgtcaagagccactttttgtgttttcttgtagaaggtcccacccacacatacacccagccaggattctccacgcccatcatcagagacctgtgtgagctgtgtgaccatctgtagtcttggcatggctgctttctccccaaatcaagccaattcagccaagaataccgtctttatttcaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaagggtatttatttttataactataactatggtttgcttagctatcaacaactattgaagttagagatatttcctggctttattttatcatgtagtgtaaacctttattaaccattttgtcttttcaaggaaagatatttctcttgctctgcatattagcataaaatacctatgatcttcaataccattaggaagtggataaatgaaatgaagtattgtcatatgttaaatccagtgatataaattgtaccttagttataagtgttacataaaatttgatatatatttgacattcaatattttctccacattttgccttcttatatcttatattgcttaaatgaaatgcaagagattttattattggatgagaaacacagttgcttttttattccctgactaaaaaataaaaaaataataatcccatataatatgcttacaattgttatcataaaaattataaaccatattttatgatatgacttggtattaagagatctttatcaggtgcatatatttctaaatattttggcatccctttctcaagttggttccagacggggtggaaattgtatataatgaacaaagaaaagaaactctaaatttacatataaaggagataaaaaacagatatacgaacaacaaacaatctcagcagctagagtagcttctgaattggctcttaccttgctatggcttttgattgctacaaaagggtaaatactttttgtatatgtacatccggcaaaggctttgcaaatgtagcagaacaaatgttctcaatcagtgttcttgttgcccacgttttagagcaataatagaacagattcaatcagcaaggtcacttagttgtacttcctggccaggatggaatttatattttccagccagccctaatacttgacaatgacaagcagctcttgaagaagcagagaggaatcattattctgaaaataaggcgtttatatctctagcaccacttcgtactccattagacttgattttatcttaaaataaaggcatatttaagtgtaaagaagtctaaaagagaaagtaaagtcagaagacccagattcaggagatcctggttcagtaggactgacttgtcttattagactccctaaaccttagttttcttatctttaaaataggattaataatacctaccttgcagagtcactttgaggttcaaataataatgatataatgggtgtgaaatatgccatgaccaaacagtctttattattatactgaacttggataatttatcctaggtaaccacttaggaaccacatgaagggcaggtattgatcatgcccaaacaccttgtggcaaggatcactttgtttctgttcatctcagtcttatttcgggcttagagatcctccaatcagagcctgctgctatacctctgtatcctcagagatatcaacttgagcagtgtctagctagtaataagcacttagaacccattctggtcaaataaatggctaattttttcttttattaatgaagacttagctatagccagcactatgataggtgctggggaatagaatgctgaataagatagacatacccaggtcttcttggagcttatactctttggaggagtgagaatgcaaagaaagaccaagattaaacattttttaaaattccgcaaaagatacatagtgttataattaaaaacctgctatgaggaaaaataatggggggtgtcttatcaatcagcccatgtggacagaaataaccttatttgagttttaaaataaatccatttctctttaataagtaaagcaacacaaggcagcccctaaaaatttctaaaaatttgacactacaaaccaagacacactgtaatactctgctaccacccaaggcttctacaagaaaactggtctaagtcatgttaactgacaatgttaattctcatcttccaaatatttaaatattggagttccccagggttcaggtcccctcttctcactcattcagtaggtgatttcattctatctccatctcatggttttgcttaccacttatatgctaactactcccaaatttatatctagcctggacttctcacctgtatactcaattgcctactaaacaactcttcttagagatctagcaggcatatcaaatttagcttgtcccaaacaggattcctaatttctcctgcctacaaacctgatcctccagtccccttctccatctccatcaccattgttctagttgctcatgccaaaatctttggagtcattcttcactttctcttttttctactcacatcctatatctactccactagcaaatcccatggcttaactttcaaagcctatttagactctgaacacttttcccaccttcactacccacatcctcttctgagccaccagcaccaattacctggatcatggtaacagcctaactggtctccctgcttccacccttttcctctcacagtctattcttatcacaacagtcagaaggatcatttaaatatgtaagtaaggtcatgttattcccctgatcagaaccctccattcacagttccttccctttccactaagaatgaaatcccaaaactttatcatgtcctataaggcactacacaatctgttcttacatctgatctcattttctaccacaattttcctcatacattataacactagcctgctttctgtttctcatgttcaccaaacacagtcctgcctcaggtcctttgcacttgctgtttcatctgtctggaacactcttgcctccagctgtctccatgactccctccttcccttcatacagatttctacttaaatgttaccttcttcataggtattttctgtccatcctatataaaatgatattacctttcattttctttttcttctaacctgtctctacttatttttgctttgtctattactattggatattatattacatatttgtttgcttcttgttttcttcccccccactaaaatatggaatactggagaacaggaacttttcttgctgtatttactgctgtatctctagtgcataaaacataataagtgctcaaaactatttcttgaatgaaaattctcctcatagaggacaagcacaatcaggtgagcaatagataacagggattgataaaaagaagatttgatctgtgattttgtcatgactaatgtcttccctgaattagctaaatgcattttttcttttcaagtattgtttactttccagggttcgcaaactcaaaagacctcaggtcccaggaaaatactgaattttttaagaagagggctggatattagacaaaatcaaaacatagaccagagaaaacatgccttgctttaaaagggcaacaactactttgttctataagattactgctgtttttgctggaatatatgcccagggatatgagagctttgaagttttcaagtgaagctgaaagactggatatgatgtcttttaatttttaaatattagtattcatttttgaaacattgtgtgatccaacaaaaccaattttttggcccatagtataccagtttgtactctccgttctaggtagcagttaaatgatttcattgtgctttacaaaagtatgcagttaatcttccctcacttggtctccttaggagcttctgacaatatagtggaagcccaagaaagagcaagaatccttatggaactgtcataatttttttaagtcagaacaagctctggcttgttttgagaaacttaagatatttcctttggagttggaccttttaagctttatcacatcatagcctggcctcattggcagtagtattcctacttggaatactagtatggcttgttttatggaacaataacttcttgatgagctgtaagtcaaatatttaaaatgccttaagtgatcatcatggagaagaaacatgatgcatcctttcattaagtgaaaagggctattgtaaaatgaaaactcacatctaatatatccaattaacaggatcaagttttgtaacctatccatcttcttacctatctgtcttctgtctgcacctaccacttccttattctcaggtgaacaatttgccagtaagtgcaactagcatttcagtaagaagttcatcctaaattttttctttggtgagccaagagtctgaacttaggttcaagaaattctgataattatttctgtttctctgcacatacttcctttctcataaaacaggggcatatcattgaatctctctctcttcattctcagtgctgctgcttcactctgtcccaccatacctgaatagaaaactttctaagcctactcaggatgctataacaaaacaccttagactgggtaatttttaaacattacaaatttagtgctcacaatcctagaggccgggatgtccaagatcaaggcaccagcagattcatgtctggtaggggcctgttcctcatttttgtctgagatatcagaatggccttcaccattcatatttctactaatattctgatcacgactatttaggcaatctctaagatgactgaggaattctctacagctctcttcttccaagccctcaccagaattgcccttaaggctcttttcatggcaatatacctcaaatctcttctaccctctatccattacccagttccaaagctggttccacaactttaggtatttgttacagcagcaccccacttctcagtaccaatttctgtcttagtccatttgggctgctataacaagataccttagactggatagtatataaacaacagaaattgattgttcacagttctggaggctaggaagaccaagatcaaggtactaacagatttggtatctggtaaggacccattttgcatagatggcactttctttgtgtcctcacatggcagtagcagcaaacaggtttcctcaggcatctcttataacaggccccatttatgaaagttctaccctcatgatctaatcacctctcacatgcttccctcgttttttattttttatttttttagaaacagggcagggtctcagtctgttgcccaggctgaaatgcagtggctcagtcatagcacactgcagcctcaaactcctgagcccaagtaattctcccacctcagcctccagagtagctgggactacagacacaccaccatgcccgactaattgtttaaattttttgtagagacagggcttcactttgttgacctggttggtcacaaactcctggcttcaagcgaccctcctgccccggcctccccaagtgttgggattacaggcttgagccactgtgtctggccaggcctccctcttatataatcaccttgggggttaggttacaacatatgcattttgaacaaacattcagaccatgacagaagccctcaggtgggatctcctaacctgcttcccaacttgtgagtcagaggagcaagctcaaacattccctgcattccctctctccagtcccttggcttcagttgctatttgtcccattctataatgtctgatctttgtgttcacagtgaagaaataggtgggttcaaactaagaaggtaaaaagagctacacatgtactttgggtgcctagaaaaagttacaagcccataaatatttgctgttcttgctacagctctctttgtgaagcatatacaagacacagcccaactaaaataactttccattttttagtcagtaaatgtccctagaagtatagatcctgctgagattgaaaattgcaattgaaaatagaagacaaaagaaaatccaggtgtcattagggtgatggcaattctgccctctgattataggatagatgtttcccttttgatgtgactgcctgggctgaatcaaagaatctggttgagtctctgggcctaggttcacagttttcaacttgaacagccatcattacataatatctttcaaagacatttttataaaatggaccccaaaatcacaaaggtacttttttcaccatggttttcttccataaatttactgctgaaaaaatatctgctacttgagagcacaaattgttcctgctgctgaagttttccatctacctaatagcaactctactctgtaaataacatagaaattgctgaaaaacttcccattccacgacttttaaaacatttgaaagctcttctgaccagagagagagacagaaagaccaaaaaatttatagcataaagtgaacatcttaaaacaggaaaaaccttttgaatcaagtcaattaatgccccaagatgaaagagaagtcagttttcagagtaacaaagaaaactgtattgctctatttaaaattggcttttaataatgtataattgatggtgtatataagatggtgagaaaacaagtaaaaattgtgatttgcagcccacagagatttcttaagaaagcctgctttatccccaacataggcagaggcagaggaaggtagtggttcctggagagccacgttttacatagagggcaggaagcattgctaattatgtggtgaaattttttttttacctgaaattttgtggcttagttttttaaaagaccacctcctgcagcaggcatgacagacacatattccaatttcctacccctattcattgtgtgtgccctcacaatattccttgttggcatattttgtccttcacagcagccccactctcttcctttttctatccttccccctctctccatactcaaaaagagtgacatttatttgtgtttcttacatttccattctatgactctcctgattggctgttctctctctctctctctctctctctctctctctgtgtgtgtgtatgtgtgtgtgtgtgtgtgtgtgtgtatatatatatatatatatacacacacacacacacatatatacacacatatatacacacatatatatatattcttttttataaaatataaactactaaatggatcttgttatattgagcctggctaatttctcttaagcaataatcctgtatagacataagggacattcctagagaaaggttgacagtctggctttcaagagtgacagactgtcaatggtcagcaatttgattttgacagtgccccagaattgatccatccaggaagactgactgatgccaactaaactcacaaggaactgatgtacaaactagattgtctctctcttttccagtttccagttacatggtaagctgaattagtactaaaatagtcacttggtaattatgtaattacgttaaagggaggttaggtaatcttgtaggtaattttatctaattataatgagaccgataatgtccctgtggaaaatacgtctctggtctgatgtctctcagattcagtatttttcctatggacattgctgaactcacattctagattctcctctgacttcccattttctctaaatttcatgataccataccatcttttgatgatacactctttatatttattaatatcactgattaactacaggttaagtcactgttccctgagcctgggagacattatgtcttcttccattatattttgatttaattgttccaatgctcagagttctagggatgcccccctggagcagcctaagtctgctatcaggtaggctggtgttggctgaagaggccaagtgattagcctggatttctcattctgttttagctccattgggcatattatatcacatatatattattacagtcatttattcaaataagtaggggaaatggataagctaattttacctgcttaccttatattggattatgttctactggggttaaatgaaacagttaaatcctgcaaactcattagattttatttgattctgaaagtaattttatgatgttgttctgcaaaagaatagggcctgtggcctgagaagtactagatggtaatcttgctaaaccaataagataattaaacagaaataagaaaatattggccttggacccagaataaagtagctttaatagttccctgaaatacatttagagcaaaagcatatatgtgacatcttagatgcgttcaaaacgaattgagagcaactattccttttcagatagacttaccacttttaatagtaaattaatcaaattttaaatagtttattttacaaaaatttgattcatacaaatgtatcaagagcaaagctactgcattaagcaagaattttctggaaaggaaaacagaatgttagtacatcttatatactagaaatatgggaagatcccaagtgttgctgatttaattaccttttcctgtttattctgttcgctccagatttaatctataaaattgagcttgcagggggcctgggagcaatcttcctcctccttgtactgctggtggtcatttacaaatgctacaacattgaattgatgctcttctacaggcagcactttggagctgatgaaactaatgatggtaagctgtcttctattgttcaaattccattaaacggcatgcatttgtgattatgtaagagaacttccctatttttagaaagtataagctgaaatatttaggggtaaagggctatggcaagttacttacctttaaatagtttagaagacttaccaagaaaaagagaaaagaggagaatatattgacaataggtaaatctgagtaaatgctatgtatgttttttgaaatggttttatttttataatattcctatacatttgactttatttccaataaaaagtttaacaatgagacattagttgctcaggagataaaacaattgctgtcaaatccctcccccttagtaagaagcaaattaagaatcaattccaatttttttcagaaaatgcaaacttaagtacagatcatttatagccattgctgccatctacaaaacaagcaatcatgcaagaaacagattgaaagctatggagacaatccttttaaagctcaaagtacatgtatctacatattttgaatgcttatagcaccattctcaaaggtgacctgaaagaataaaaattcagagtgtagctcataattttcttatatttgctgtttatgaattttgaaaatcttatgagtgaaatatcgataaagcagtgtactgagctttgtttctttgaacatttaaaatgatttaatttttttcaagagtacaaactgccatgtttccaatcaaaatcaataagaaatcatggcatgtagcttcttatacataaagttctcatcccgaaactgctgtaagccttggaaatgtgtatagaatgccacaggtaagccaaaaattttttagaaagtagtccaatttggaaaacattagtttaaaaagacagacttaaaactgagttttcattgtaccaaaataagtaaggttgaggcttttgtttatttttttgagttggtggtcttacctcaaaaaagagaaattcacagttttgattttaattttatagtgatagatgtaatgtcaaaatttttgaggaatctgattttggtcttattgttactattatgtgaatgatcatatgggtgggttttaattgactttcatattttcatagtaaattacagaaattcttttttttttgttaactgcaaagcaatgtgtgttttttgttttgttttgttttgtctttttttttttttttgagacagagtctcactgtcacccaggctggagtgcagtggtgcaatcctggctcactgcagcctcgaactcctgtactcaagcaatcctcctgcctcagcctcctgagtagctgagattacaggtgcatgccaccatgcctggccaatttattattattattattattattattattattattattatttcttgtaaagacagggtctcaccttgttacctaggctggtctcaaattcttgcattcaagtaatcctctggacttagcctccaaaagtgctgggattacagacattagccactgcacctggcgtgaaatgctttttgatgagtacatatgcatgctcatttgctcattttcaaatctacacatttactcagcaattacagcagccagtttaaaagtactacagactcttattcagacatatcttagaaatgaaaaattaaggcctattccaataattattgtatacactgacaatatatatggaaatatgatcaattaccctcagttcttcctctatacaacagttaatattgaaaaatcttgacttcttatctgtacacagaaaaaaaaactagagagaatgtgttactgagggaaatgtccctggtttcccaggtgccagcaagtggctaaactatccaattgtgaaggtaaaagatgtattatctatgtaaaagaacataaaaggggccaggcacagtagctcacaaaatctcagcactttggaagacctaagcaggaggattgtttgagcccaggagttcaagaccagcctgagcaacatagggagacctcatctctacaaaaattagtttaaaaaatattagttgggcatggtggtgcatgcctttggtaccagatagtcgtgggggccgagtcaagagaatcgcttgaatccaggagttcagggttgcagtgagctatgatcgcaccactgcactctggcctgggcgacagagtgagaccctgtatctaaaagaaaaaagaataaaataaataaaaatatgaaagggaggcttctgtgattaatatgttttgagtcctgataatatgcagtttgttaatctctaagattatacaatttattatgttaatctacaataattaattaccttcatcactgatacccaataacctagactaactgatcagttgtagtacatatttgtaagattaattttatgctgatatgatataatttttcaggaattaaatattccactttgcatctttatctgcaatgtggctcatggtttcaaaggtgtccagtaatatagagcattttgattacataattttatgtattgattccaaattcattgtttggggggaaatgcaatatggggagagggtacttcaagtgttttcattaggaaggatggttaaaatattttatttttctgcatagaaccttggactttaagtatataacctctgtattagcttcagtggaatactaaaaagtcaacatgtatatggtgaaaatgaataaatgaattttaactgccttttggaaatctacagttacagaatgccaaatgtcatccagataatctatcaagtttttcatttcactattgaaatattttgacataacatagacacaacttaattttaaccatatgctttttcttcatgctctatgacaatatctataatagtatttcctaaaagttattataaaaatgcctgattttgtataaaataaaatccatccaacaaactttaacttcttagccatgtttaaaatttaattcattttatttcaccccaccaatgattgcttcatttatttaacctttcagtttttcagtcattaaatatttaagtgtctactaaatggcagggactatgcatgacgcatttacttatattcttcatctggatcaacactgcagtcacacacacacacacacatactatagtaggtagtaggtatataataatcaacaagattacacagtatttgctctgtagaaactaggagtttagcactctgtttagcacagctgcggaacaactgagttataaacacaaatggcttcttgatagggaacaggattcgaatcagattttaaaacagaaaaggacagacgtaacaataggaaaattcttctacaaaacgtttcgttatcttccttataacttctctctttattaggaacagcatacctatggtaaccactgtgccagccctcttccttacactgttctgtctgcattgtgctctatttcctggttcctcagatgagcttaggcagcatgatttagcacaaaggaaggctcattagccttgcctagaaaagtggtgctgctgaacagccttttggtttagaaactattttcaggccttgctgttaaccttatttgcatcatgttgttgattttgctttatctatcttgctcctctttgtgagcaacagctgcagctattcatgaggttttcttggctgtctacataaggctgaagtgcattatttaaactgtagcatccgtgtcactgctggctcactagctggtatcctagagcttttgggacatctgacatggtggctttgagagctgtcttcctgctctggccagccaccataagctcttcacctttagttcatcttaaagggacacgaatgaaaccagaagcattcattttttcaacgaatggtgtgcttctagaatgcgaggtaaaatttataatccagatgtgttgggtgttaatacgtaccaaggacatgcatgctctttgtcacatcttagaaaatgtaagtatagaagtactttctaggggtaagtctttgtagcattgaactgcaatatcagaatataggtggagccagtaaggacagaaccaagaatatgtgagtttagtatgtttggaagacaaataaccatagtacaagcaataggacaggagtctagaaggtctggtcagatgggtaaagaagtcaagtagccattgcagatgctcaacaaataattgttgaatgaattaataagtggttcaatttagggaggtttgtgaaataggaaagttatcaaagtcagagagagtaacagggtctggtctgacattatggagtttgaggcagcaacactatctatcaagaacaatgaaatatattctgctcatgtgaatggagctatttgtcctttggcctattttattcttccagctgtgtatcatcggcagccctgagtcccaggtgagtaattatagctggagaaagtcaggggcctgcaggtgtatcctgcacgtgattggaacaagggcagaggtgctaggattaccaggaggttcttacattagcattgcttatgaacattctcacttccaagcagaattttatgcacaacagtggaatgcgcccaacttgtaagcgaaatgatctcaactacccagggcagtccttcatgtacatctgcttccaggcaatcaagtaatccaaccaaggtttatggaagccttttgcagccagaaaagatgctaaagagtattaaccctttctccttccttcaggcaccatcttaatacaaataaccagaatttcttttgtttcagagtggtgaaggctaaaatcttactaaaattagaacaacataatcctacttcagagatagggaggtctcatctactcctaaaagagggtatctacagcacatcatatgtctatcatttattcctccttcagcatgtagaatgaaatcatggtgtgggttatgctggaagtaaatgagtggctgcttcattttataaattaccttttggtcaggttttagatatgttctaattaggtatgttttaatagaaaatattgatgtgtttgagaaacaaatcctgaaatttttaacagtctttcgcagttattatttgtaagtaactgggtttacgaatagttcacatgagtctgtgctcactacattaacttaaaaaaattttttttaataagggaattttgaaaatctcactataactttttcagtatggatgtggcccatctaaaaccttcagaaactaatacctcaagtagctatgttcattaacattttgcaggaaaaaaaattgtatgcatacatgcacattttctctctggagagactggctctgagccaatacagcaaaaagaggaaaaaatacacttgcaaagcacagttaactccctgactaaatgtgtggagggaaaatctaatttggcaatactggacggatgtatattttgaaacaaaggcttcttttggaagcttgtgtcatattagttggccatgaactgaacaagaataacaggtaacgcacttgtataaaacccagctgctgtctctaatatttggtaatgaactgctttttgtatatgaagatgatgacactaaccaactggaactatggcatgtgctgtgaacagtgtctccaggagcaaggctggattatttcaatcttccacactctagggcccagcccctgttggatcttttgcacatatttgtgcaaacaaggtatagtctgtggccaagtaacagagccaagccaactggaaaataaaggggttaaatccatgactttggtctatttagtcctgcattcaaacacactgagctaatcattcacacatcattgagtattacaaatgcatatagtcactgaaagtcacaaataataattctctcttttattctgttctgactataggtggcccattgcataagtttcaattcatatatgactaggttattttgaaagggattagatttcctataacatggcatgtgacttatttttttccaattattaaagacggtcactaattattgtgctattcctgcctcttagtactcaaagagaacctgttaatagttacaacccttttgttgttctttatgtttaagacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaagtaagtactttcaaattttgtgtttaaaacgttctgtttcttttaggatgttatgtgaaggcttcaaacatcagagccaagtatttagacagttgtttctcacagtagagtttcttaaatccaaatttttcccatatgcctgtgttctgactttctagcacctgaatatttttaaaggcattctcactaatattttgggtatgatttctaaattgtgccataatggtcatttttattatattgccttagtatcctgaaaagcattatgatcttttaaaaaaatctgtaaaagttagttaaagccttttcaatatatttcagttgcaaagctggtcttctgtcactgagggtctacttatacctacaattattgttactaatggctttgaatctatgcctttcaaccttgttattcattatgccttgtcacttatttccagatttatggaaaaatccacttaaaaaggtatatgaggccattgggtacagcactctcactgtgtacttaaattattttcaagacacttgaatgctaggcttgaatgctatttttaagttatgctacacattgaagactatattgaggctttcagaataaattcagtttcaaggcaaaatatgtagttttttcccattaacatccagagtgcatacacatacacagtaaagtataaggggaacacagagaaatctaagacatagtccctgctctcgaagagcttaaaatgccattgaggaaaatataagttctagaacttatttgcatataagtactaatatccttgagaggggaagattgaactggtaactacaaatcataacatgttactttcaacatgtgataataacaaaataaaaagcttatattaccagtacttgacagtgtataaaataatttcacatacattacttcatttcatttttacagtaaccctgtgttgcgagagagtaggtacttatatcctcatgctgaggaagcaaaccccaaaatcgtccaagatcaaacagttggcaaatggttgagctggcagtggaacctagatttatttgactttggttctcactctgctagatcatgctgctcctcaataacatttattcagattaccagcaggctgccttggtcactaagctgacaggagacaaatggaaacaaatgggttttgattgttcatctcttttcttagcgttcatttatgtctgtgtatgttgatgtgtgcacgttagtatgcacacttagaaatgcatggaaaggaacaaagaaggcaatatttactggtttattttttcctgctccacaaatgtaagaattccccaagcttcttatcatggtccttcattcttttctttctgcagttttccccatactatcctatatttattttttccccaaggaacatcctgataccccatttttacgacttgaaatactattctacatttgttgtttctccaaggaacatcctggtacctcagagtcatttttcattcttctgtgtctttctcccaaattcagtgtcccttgcatttttttcattctcatttttccatcctagtgtaggccctaattatctaactccttcaatgttaattatccctctatcttccttatctttcctcccatccattcagccccactaatatcaagtacatctcctcgatcatgtcacttctgtgttcaacaaatgaatcattcactatttactacaggataaaatttataacccttagctaaacacttatacaatcttttgccagcccagatttatctcctaaatttgtctcctaccacttcctctactcatactttccactctagccaaactgtgcctttgatatacattgtatgtccctgtaatgcatttgttcatgttagtcctctatgactttgcaaatcctacttatccttctccatatcattgcctctgtgaaaagtccataataatctctccagctgtagaattcatgatgtataatcacttatttgacagtaaatttgtactcctgtgacattttgcattttaaaataattttactagcttttcatctatttatgtcttttctagccagcaagattataaactccatgaggacagggattatatctcatttatttttgtatccctatagtcatctagcagaagacttgagctcattagatgcttcatagatgtttattgattttgtttgaaaaatgtcgtcaggatgggcagagattttatagtccatagaaaattcttttaatgctttaaaatcagactgagtaggggcttggatcttgggtcctcaatggtgcacaggaagactccttttacaagtaagccatttgggacaactatgcagtttttagatgcaaccactggagggtgtttgattttaatccttccttcctgaacgaggaaattcatgttctctgaattccgatttgcgagtgtaacctgcagaggctcttaaaaaggccctttgacaatttttcttttccatcaacattttagagttagctgagcagtcaccatgtcaggattaacgagtttttccttggcatttttagcatgcattcaggaagtcaatgaagtatatgaataatatacttgatttacacatgaatgacagagtagaacattttggacttggtgtatatgtgctattaaagaagcttctgtggtctgtattttcaaccattggtacagatttaacagcttatattatataaatacagacacattcctgttgggggggaaacctagttacagtattataagctgtgtttgtccctcacatctcatttaaaacatgttgacctaagactactccttcctctgaaaactagcaatgaggcctttgaggactatgaaagcagacttcataaaatcattcttgatccacaacaataattttctatgaatcaaattaatgacatctatgacataaacccattcatatttaatgtcttcacttttgatgtatcttcagtctttttgtactactctcacggtattccaactcaacctcatcaacacacaaacctttccaatgtacacagtttcgaaagtacatgaaaatctctctctctctctctctctctctcatataaccaagaattctcagaaaccttggttacaaagatgtcactttccaaggtgagctgggggtgtctgtaccacccatgccctaccaggaatatgttgtcctttggccattgtgaaccagcagagatggggagatttaatgcaaatatttttcctaaatgctgaaactgagtgttccgatctggacattattttcctggcagtgactacctttccattcttgagcctgtggccaggatcttccttatgttttctcaggttgggtgcctaaatatggcaagaattcttactttccagtaaaagtttggtctgtcttttcccagactagaaacatctgtccctgagaatagcgaaagcaactttgttgccaacaggcatctgaatgtcagaagtgacaggcaaccagaagaaagccagatagaaaacaccctattcaaactgcctagagacacaaacttgagaagtagagatttttctcacccatgcagctgctggtttttgtggtataaactactctacacagagcacattgtgttcatggggcctagaggatccttgaggaatgaacagatgtgctctgaagctgacatgtgaccaacagaacccagctgtgcaattgagatcctgagattggggacatttttggatgagtaccatttatgcttttgggcctatcttatctcagtgtttctgtagagattaaataaaaaccaaaaatgtaaaaagttattgaatcaggctgagggtcactggtcagatggagaaaatagcattctaaaactaaaagtagaaacaacccaatcctgtactctttgtttccctttaaaagtaagaaagtaaggtgctgaaaggtgcatatgcaatatttattaacaattataaattaaaccagttttggatgaagctttagaaaaagctacagatgtctaagtggactttgaagagaaaaaaaatccttggaaggtttttacctcaatttccccttctatttatagaaagactatgaggatccctatgtgagttgttcatgcatgattgcattcaagaaatacactagaaaactaaaaatattatcatgcttatggtttattggccacatctttttaaattatattcatgaatttagcctcatgtgtcgaattatcttttcatttgtctttatgctcaattttccatgaaggaatcctaagactttcagtaatttaagggaaaaagtataatgtctgattacattcttgcatttggtagactttcctcactaatctaatcttcaattctttaatgcttagtactagccatgtgattgtgctgacaatgaaatgacaaatgactagagaatacatctggtgtcagatgatccctagtcacttctgaagtgaggcatgcaaaaaaacatttttgtacatggatctgtaagcattcattgccactagttcctctaatagccgaacagattggacaccatttaattaagttgtctttggggagtaataaaatcgttttccagacaatctgatgtgtgtgacctaaaaagtttgagggaggggtgacatgaacaatcatggaaatttaacatattgtgtgaactttactcacatggaataaaattgaacgtgtccattatccccttcatgttaaagtcaagagagaaaaaaactgtacttcaatatgtccagcaatgtactgaggtcaatagaataatatttctcatcaaagtttgaggtagaggttagagttgattatgtagaatttcattcaggaaatctgctgtttgggtggcacaaagaacaggcatctcaaacaaacaaacaaacaaaaaaacatagtataaaaccaggataagattgtcttaagtactggaggaaacacagaaaagactgtaagtagtaagtggctttgttccatgttcattaaggctgcaccagtgagaattagttacactacaagcttttagggcttcagaagagagaaagaaagaggtggagggtattttgcaggtttgctttctttgctactctccactttatgtttctttcaatcttctctaaatgtgtcccattccctacctctactctctgtgaagaggtgaagagagaagagaaagaagacagaaatgtggacagcattcagagtggattcttcacaccgtcatgcttccccactcacccacaggtgaaatgtgaaagtacaggattcattactagcaatatagcctccaaactcagaactgtaaatacacacaattccctgtagtcatcaggtctcagcaaattcatgttagctgctgagtcaatgattaatcaaaattaattaggaccctcatactatagagaacaaaactcctgcctaagaaatttagctcagctaactgtgaattatcaagccaagaatttggaaggggagagggcaggaaaggtttttgtaggacaagtaatatcacacatatttagaaaggctcccagccaggcacggtggctcacgcctgtaatcccagcactttgggaggccgaggcaggcagatttcctgaggtcaggagttcaagagcagcctggccaatgtggtgaaaccccatctctactaaaaatgcaaaaactaactgggcgtggtggcagatgcctgtaatcccagctacttgggaggctgaggtaggagaattgcttgaacccaggagacgaaggttgcagtgagccaagatcacgccactgcactccagcctgggcaacagagcgagactccgtctcaaaaaaaaaaaaaaaagaaaaagaaaaaaaaactcttcctatacacacacacacacacacacacacacacacacacacacacacggctaacttaacattatgtagcctcagtctccatggcaaacaacagacacagaatcttacatctgtcagagacagaatcaagacctaaaatctttagcaacatcagccaagatagagtcaatgtgtgtaactatgccagtaggttagtatttagaatcattatataaaactcagatagtatttttagtgatataaggtaacccactgtaagcctctagttatagcaaatgtgtgatattttccccaactatgtagtggtgaataatatatttttctttgatatataggaaacatatgtaggcttgattttaggtcttgatatattaacctataggttttataaatattgttgatagctataaattagctaacgttcaccaaaaattaatggagtattatctgttttgatgcatcctgtctcaccctaatggtgtgtctttttaactaataatagctgctgtgcataactgtgaatttaagcatatcaaattactattatatgaatctggaaagtaataaattatgcttttgtttacaggctaagtatctgtcttttaacttcttaaaaaatatatcctatatgctgctgataatgaccttgacattagtggaggtgtcaacacaaaaataatttataaggagctaattgattgattagtttgagaaatcagatggttagtaggcaggagtaagaccacatagaaattcatgaatatagagttttttctcccatgtccttcttgcctacatctgcagtagactcaatggcctgagaattaagaaagtactgaattcttttggaaaagtgtatgtttcccattagaagcaatttcttttgtggctgccattcttcctgcttctatttcctccttcagtttgcctttttccttcgttaatgaatggcataatttgcttttaagtcacttttctagatctaattctatttctcctctaaatgcactagaattttgttttatacaatggcccttgaaagatattttaaaattgaatttgctttgtttttaataaggctttaggtagcaactttctttgctttttacaaatactggtgctactggcatgatgtttttttcatttctctaataagtacatatcccaaggagagtctagtggcaaggcattgtattccagaatattttcctaactctctgtcaactcccagcagagacaaaagaaaaagttttatttcatttgcacttataatgtgaaaaaattaattatatcaatttaagcaccctatcaaaactatgttcaaggagacttttttctttctctaattgttgaagattatgaacaggttaaatgtacttggctttgtttcatgtctgataatctgctgtggtttcgcagactggtctagagaaacagaaggctatcagacacagccccttttggtcttttctgtcatcacaagttacatcaaaccacagcttgcaaagaaatgacttagtgaccttttatttaagggatatcttatatttttatgtggaaaaagtcttttaagggattcttgctactcagttgctaaatttgccggaacaagtcaaggcaagatttagtgagtattcatatgtgctgtggatttagggatttttttttttgaaaaacgtttctttattatctcttcgtggtaacaagcttttaaaaacgttttctgaaggtttctaaaatgtctcccaaaaaaccacaaccctatgagggcaaaccccactgcctgtcagggactactactaactatgggctggcaatgtcttaacttgatacctgtttctgcttagattatttggaacttttccaaacccaaccaccctccttggtctttaattcaggggtggcaaaacttctttgtaaaggtccagatagtaaatattttaggtttcgtagattatatatggtctctgttgcatcatatcttcttattcttctcttttacaactctttaaaaatatataaatcattcttagctcacaagccatacaaaaacaggacatgggcctaatgtatcagtctccagatcacagtcattggatgcagacatacaaccccagggtgaaggggaaactggggcacttgcttgatagaagccagcaacaattccctggctaaagattagcaagtaaaaaatatgaactctacctatttgatttcttcctcatttacttttgttttctgtgatggctaggttcttatattttcccaaagacaacaaaagaaaacttaagaagagaaggaagaaggaagcagagggagataggatagagaggaagaatgggataggtaaaaagaaagagcgagaaagaaaacaagtaaaaagaaaagagaataaaagggcagaaaaagaaagggataaagacagaggtagagagggggaaatgggggagaaaaagagagaaaaacagagagcagccagaatatggaagctagggcacagtctcgccttcttttcctaagagccagtcagctcttagaggcacctccccagctgctttcaaacattgaggttgctgcccagccactgatcatcatcccaagaagtgaaatgtgggcttcacatctgaaaacttccacttggtttttcaccaagtgaaatggaatacgagattcagggcccaagcaaatggctcatgttttctttgggacactggggctgtgtctacccagggaaaattttgatatactgactgactgactctagtgcatatgattaatgtatacatagggcaaaccaggataatttagaccttttttcttctacaggaggttttcagcaggaattatctggatggttgcctcaactctccactaggctttgccagaataagcacagccagtagagtatgcaggagacagggaccactccctctctccaaggttccctttaactcccacaccccgtgtagctaagtatagtgggacctgtactgacaggcattccttctgggggcaaatgtaaattctgtctaataagtctctaagaagccccaagaaccctaaatattgcatactgctttactgtcagatggcaaaatataatagatggatgaaaggggagaaccatacttatggagggaaaatgttaccctgttcctttcctcatcccaaaaagaagctagcaaagccaaagcccatgacatcccagtcaaatgaattactacatgtgcgtacagtttctcttataagtgtggatacctgggttgtaatttcttttctttaagttgatagactcatgtatagatatagctttagtttctaaaagcatagtttaaaagtgcatttgaggctgaggacagaggattgtttaaggccaggagtttgagaccagcctgagcaacatagtgagaccccacctctataaaaaataataataaaaaattagccgagcatggtggctggcacctgtagtcctagctactgaggaggctgaggcaggaggattgcttgagatcaagaggtcgaggttgcagagagctgtgtttgtgccactgcattccagcctaggcaacacagcaagactctatctcaaaaaaataaaaaaataaaataaaagtacatttagactaaaaactaacacataaaaattatgttgttcctagaggtacactttatgtgacagagtgttactgacaaggtttgtacaaggtttaatttttttaaatggaattacaagctgtaattaattagggaacaatactactcaaagtaaccccttggtaaattattttgtgaagaatgattctataaaattaataatgaattcataattcacctggtaaaactgtatcttcattgactcctgcactgatatcatgattctgggtttgggttttgttctgttttggaggaaaggtgaaaagaataatgagaaaaatgcatgatagtttattttactgtatcttacagatccaacttctaatgatgaagcttcccacataacttctttctttttgggagcagaaagaaaggaagaaaatgaagagtcagagctgttgatacattgggaaaatatttttccactctattgaaacttcctacctttccttcccttctgtttcaccagttctctaagtgataattacagagtgataacttctcaattactatttctgtggtgtttttttgtttcattttgtttttgcagatttcactgcttattttttcccctgaatgcataatctctaaaataaaacaatcaaaattcttaaaagttccctctcttcttagacactgccttatcccgacagatacagtcattgtaactactgcatgagaaagatcctgaaatgtattaagtcaaaacccaaagaacagtaacaacaaattgttaaatgggcaattctatgtgtatctcttaaaagtttcttatttatctgtagggtataaagaaagtttgctcattttcacttgtaaaagttttcttgctgccaagtagtgaaaataaaaccttagaaaagagagagcatctgtaaaatatgcatctgtaaagtaagtttctcttttcaaattgcttgtactgagctgtttggtggccccacaatatgtgctgaatgtgactccttgaaagcagtctgtaaccttgggcagatttgtgttgacaaatgttgctatgcttctttctgtaagcactgcttctgctagagggcactgtacattagacaaggccttgtgttctgcttcgtaaagacagctctctggtgtagcacctgtgtctaagtctccatttgttaacacatgtgtgtgtttccctttttggcagataagactttgggaagcatgattccaaagggattatttcatgtgataaataaatccggagttagttgagtgtttctctaccatgtaaaagccatagataacatattcacctcactttcagaattgctccacaaagtagggcaaatactttcttttcagttggtagactccttcactgttcatttcacaccatcccccacctccgactctactcttcactcttccttggaacaaaagcagccagttccaattaaactcatgggcacaaaccacttccctatctctgggtttgaagggcataatggagaacctaagtttgcaaatgacagaaataatcggagaaacaagctatgattctaaaagagattttccaccatctctatatcacagttatctctcaagtagttagtatacatagccccctccttgtttagtagttgaaaactaggggccatacatacagttagtatttgtcaattacaataaataatattaataaaaataaaattaaagaagaaaagcaaacaaaacccataaatacagtaactctgcatttattaaaaggatccatttctcttttcatcggctccttgattagttgttcacttagagtactagcttggaagcctgacttgaattaaatgattacataaataaaaatcactgaaatacacctaagctctgaagaagtcagagtttatgttagccaacaaaacactgtaagtaatggtgagggaaaagaaaataacgattataagcagtttttttttttttcagttttaaggaggggaatgtaccatacaagaaaagaaaatgtgatggactttagtgagagactggatctttgctatactagtgtgcaaacctgatgctttagagactggcaatgtctttgttttactctttctctctttctgtgatttgtagcatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg

SEQ ID NO: 3546 - DNA, 96411 bp, human
ggaggaggggcaagcaaaggggaatgtagataactaaagtgaaatagagctgatgtatccagaggttatgttgctagaggtgagatcagttacctacgtgcaactgaaatttcaaacttctgttcagcagggacgtgagtggacaatggtgactgatagttggaaatatcagcaaacatcttaaattttatactcaaatgaatgagcaatgaaccaggagaataggtccagttttttttggctccttgtaatttttacctttttacttaaaattacagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtaagtaataattgattcacaaagagagttaatgtccgtttatcttagaatggtatttccatctagaactggtctaggatctggcaacaaggttgtaaaataattttactttaaattttcttgcctggcacaacttgtaattactttattattatttaatatttttaattaatttgttccaaagacagtagcaattcatgaagtgattcctattttctttcatgttttcttagcaatataagtttcctcagtgggcattatatcgtgagttgctttttaataaactgtgcctttacctctaaacattaaaaaatttaatttcattattaatttgcacttctcagtttgatttattttctcctgcaaaagggattgtatgttttcaagtttgtgaaactgcaaaacagtttcattatgcttaaataatagcatattataagtgtgtaaaatgttatagaaatgagaacttgactctactgtatgcttgtaagatttgaatctttttgcgggactgatacaaacgaatctgcaaaaacgtgatattacccattgaaaagtgtatggcagaaataggataacactgtaattaacaaagaaaataaagatttcccttagaaatatttactaatggcttcttaagtaaatagaaacttctaatttattaactttttaaaggagttacttctgaaaatcactggtttttatttatttaaaaaaacagtttccaagtaaatagatttttaaaccaatgaagaagtaaacttctgaaccccattttgttcactgtggataggtatgtgtgtttttatcagacttggtctaaaaaaaaaaaggaataatttcaatcaaggcaagcgctgacagtaaatgaatacaaaattttgataattggtgttattgccaaatttggcctctaagaaaattaatgcaaattaaattaaacagattttagaattatgaaaaggagaaaatcaaacttatgttaagaatagtatggtgcttggaatgttccaagttgtacacatacaatatcactgtttggtactaatatttgaaaaccaaactgcttatttcgctaagcatcaaaaaaacaagtaagatgaacttcagcagtacaaaattattgtagatgtaacaaaactccatgtgctaccttttgtgacacatcctggacactgcaagagctcagacattcacattttatattattttctagctaagagcatttcataagcattccctgcctgttcctgtgtttttacgagtgactttcatttttgtagaaagaaactaatgccattttctgataaaacttaggaattaaatctgttctaaggaaccaacttgctatacatttaaacttagagatcctgaatactctgggtttccttttgcatgaacacattctacttattcactctcctgctatttttgaaatacaaacagtatcaaactaaatagtagtcctgttttcaaaactttctttgcaacctgtattagggaccaatatctagtagaatgtaggtaccctgccagtaaatttgaaatatttaccaaagatcactcacagtaaatctctccaaaagaaacatgtgcataatcatttgaatatgtgactctgaacagagttttaaaaaggaggcagttagacttatcattcaatatatacctccaatataaccaaagacacatgatcaaaaatattttaaagctacagtattgcacctattttaaaataaacacattgaaaaagatagcataatgatcataactgtgatagttaacatttactggcatttactatatttcaggcactgttatagtgtgtttatttaatgaacattgttttttaacatatgatgatatcaaccccaaagaattaaaactaaatttggaattttgcccttttaagacctgccaaatagtgtgccattggattttttccttcctagaaatttcctttatataaaaactattcagtgatgcagctgacaaacataaggaatcaagtgtggatatgaaaactagatgaccagacactagatcattaaagactgtcattattttatgccaacattttgtttgttgttgctgtcttttcactcgtgttttgttttgttttgacacagaggatgggggaaatcctcctacaataaagctcacgatttcaccttctgtcatctcatcttgtattaccccctaaaaaccaccttttcagaaaatcacactgtagccccctcaggcccttgtactcttctactcttctctggctccccctacctcttcattccttcagtcccattatcctgtactaggtcttactaagcacttccacaatgttgtgtctctctgcttctttctaatgtcagtgctctccagccaaagaccgctagcaacagacctgtagtttaaaaaggtagatttattacttgttgcagcaattggaagagcacacaccatggaaaaccacagggcatcctactaagagggtgttaaaaaggacttgcaggatttgggcttgcttatgtgttttgggggagagttgaaggaagatgactgttaaccaaccattctagtttgcttgagattgaaggtttcttgggatatgggactcttaatgttaaaccaggaaattcctgggaaaattgtgacaagttggccaccctagctggctttgttctgaacttggaggctgccagtaagttgtaattctgtgtttaggtttctaaataaaccttttttgtaagtggggaagactagcccatggctaaagctgtaattggtaaagaagcaatagttacccttattagccagaatagagagatatttggtagttacccttattagccagaatagagaaatatttggtagtttttgtggcgaggacactgtccatattttgtctgtgttcagacctgattatggagtggtcttttttgtttgtttgttttgatccatcatagtcacagattgaccttctctaatgttgatgttctgtgagatggtttatattcaacaagaaaatgtcaaggcttaattgagagtgccaggctaggtcctaaatatcaggggcaacttgtctctttctcactgaaaatctacttcacccaccctcgtactgttgtgcaaatatattctcttcccccatgtcctttcacatttctgtgcctccgcatcccttataggttgccttcaagggacctgataagtctaagggatgcttccacactccttgcctcacatggtttcatgatttaaatacagaatgtccttactcttgagtccagtctatttacagcctccctactaagagtgttatttttctgaaggggataatttcagtttgagaatagcttccactgaggaagaatagtgtatagcctaataattggaggtaaacttctaactcagtttcccattgtgctgtgtccagtatcagtttcctaatttgctcttggagttctcctttgggttatattctgcattggtgagtatatctctatctatctacacacaaacatatatgtatatatacatatattttcatattctagcttaccagaaggaataatgggattttgactcggcattttgatgaggtgggaaataaaaggatatgtttaccatgttcttaagtaagtatgtaacttcctaacaatcttttccgagcactgcagacatggcctttcagttctattctagagatgcaagaaaattcaggactcctgagttattcaagcagaagacgcgtaacatgttaagtacttgcttgctgagcagacagctttggaagttaaatatgttatttttaggtaaaatgtcttaagaaatgcttagatttggatgtagtttatatcagcaaggtcagtaatttgggagggataaaatggtttttacgttttatcatttcagctgtgtccaacgaagtggattagagtcaagtgtgcggcattcagaatctccaaaactcaaccaattccagagtagtgaagtgcatgaaaaggaagggtttaattatagcagcaaactcacatgctttataaaaatgtttttctagaagtaaaaggggaaataaaagcatggtatataaatgaagtgagaagatgacaaaaaacttcggtaaaactaactcagatatgtacataaagaagagcttaattcaagaaaactaatcagttgcatttcaaatgagcctcaaatctgtctaattctgtgcatctccaagacaccactcactctatcttagacctctacaacagctttccagttgatttccctgccactcttttccccttccaagcccaatctccagactgtaagccaaagtggctttttagagaaaataaatctcattctgtttaaaatccttccgtggcttcccatgacactcagggtaaattcaaacttctttccaagactttatccagctctgaatcatctggcctactgctgtgacctcatttcctctcactccctcctcttctactcactgaactcttgccacacgggactcctttcagtgcctcaattccactaaacatttccttgccagacagcctgaaagtaacccctgatgccttcctcatcctcgctcccacatctcattaaacataaagttctcttgatcctacctccaagcatttcttaagtccattcactttttcacctctgctgcctccatccaagcccaggccaaaatcatctctcacctggaccactgcaatagcttcttaagtgttctctcttgctattctcgcccctctgtagcacatagcagccagagtgatcctgtggaaaatgtaattccaccccagttagaataaaatccaggccttgagcctaggcctacaaggtttgatgctaatcatgtacaatcagaccttatcctatgcccttctgccctgcattaccatgcctcagcgactctggttttctctctgttttttaacaaagagaaataagcgcaagcttttgtacttgctgcctcctctgcctgagtcacttctccttcatttttttttcacataacactgcctccaaaatataaccatgtctatctactaccactagtctagtacaggctaccgccagctctcgcactgactactgcaaatagcctccaaactgggctccctgcttctactcaacctaccccatatattctctacacagaagccagagtgatcaaaacatataggtcgatcacatcactcctcttctcagaactccccagtgactttccattgttcttcaaataaagtctaaattttatcaggcctaaaaggagttgcatgatctggcctctgcctatctctccaacctaacagtctactctttccctctccctcacaatgcttcaaccactctgatcttcggacattttctccaacacgtgaagcttttcctgcgtgggacactttttacttgctttgctctctctcaccaccatcgttatcacacataacaggtactccatataccagtttaaatgtttcttctaacgggtctcccttgaccttatacatattattttctatcaaaaccttcaggtcgttcttgttaaaatttattttaatgtatattttcttttttaatttattttttaaatttatttatttaattttttttttttgatacgggtcttgctgtgtcacccaggctggagtgcagtgacacaaacaaagttcactgaagtctcgaactccctgggctcaagcaatcctcctgtctcagcctcccaagtagctgggaccacaggcctgtgttatcacaccaggcaattttattttatttttttagagacaggggtctcactgtgttgcccaggctgatcttgaactcctagtctcaagtaatccttctgcctcgacatcccaaagtgctgggattatagtcgtgagccgtcgcacttggcctaattattttcttacttgtttattatttgtttctcccactagattgtaagttccaggaagacagagaccacgtctgtcatgtttgccattgtatccattgtacagagcatagtgcatggtcttcactatttgctcaatgaataaaagtttaagaagctacaaaacaattctcttttatatgtgaaaagatggacaagttgaaatgaagtttggtaaatttggcaaactattgtattttttaaattgtttttatttttactgatacaagtaataaatgagtagtttctcctataaaaaacactaacaatataactaaagtctccccttgactaccacccccaattccagcaccttttcaagagataactattgctattcattcagtatgtaacctttcagactttttctattcatttttgcatatatacgtacagaaaacacgtagtcaatttgtgttttatttttaatattaacaaagttattctgtagcttgctttagctactcaacaataggaactggagttatgttcatgtcagtaaatttgtatttaaatcaaattcattcttttaactattgcattatattaatattgcacacacacacataatttatttaaccagtcccctagcaatggacatttgggttgttttcagtgctgctcttttacaaacaatacttcagttaacataattattgctgatacataagaaagctattgatattgatcttgtatcactattgttgaccttgcatctgaccaccttgttgaactcctattaattttattaattcatccattgattctcttgaattttcaagataagtgatcattttctctagaaagttttgcttcttcttttattttaattctacctcttaatttttccaatggtcttattccattgtctagggctacaatagtgataacagtatacatccttgacttgttcttgactttactaaaaagtgctcccaccgttctatcattgagtatgttatttgatagaagcttctgggagatagtctttatcaaggttcaggacttcagtaagattttttaattttgttattcttatggcttaactagaatatgaatatatatgtatatatgcatatatgtttgtgtgtcgatagatacagatagagtcaccatgtaggatatgcccaaaagggaaatccaatagtttactgttagcttgggagaaataataaggtggtatacagaaacaatagatgatctccataaattaggtatggaaagaagaaacaataggtaaaagggacaattttgggttattttccaaatacaattttattagtgccctggataaaacaattgaaaaagaaatttcattgtgactccgagttgagtgtcaagttgtaagacacaaacaaacagtaaaagcatcttgacaagttaggaaaattatttattaaaaacaagatgaagtaccatggtgaatagtaaagaataataaatgtagagacagatataaaatagaaatatatgggcaaaaaagacaggtttctaagcaaaatatttgacaactacattgtaccacaagtcaactaaagaatgacacagttatttaaaaaattgacatgattatgggatgtattagtaagtatataacatgttacgcctggaaaataactcagctatgcttggaattcatgaatctctgaaacatcataagcttttttttttacctgacttacaataacaaattattttagtacctcttttatgctttcacacaaatgcccaggtgcccccctcccctgggtacaggcacatacaaacataattgcataaaaatgtatgtttataaggaaatcaagatatagtacctctgggcaccagtttccggataaaaacaaaatgagtaaatttactgtgagccctttcaagtacatttcatctcccttttctccattttaaaatcaaagaacattttgaaagcatctaaacatgtgccatttgttcattaacatatcctttgcttaactcttggcctcttcctcctaaatttttaatgtttcatttattatgttatgatttgctgctcagacatagatttcccccagaattacttgcaattattagaaaagagtgtgtgtgtaaatacacacagaacaatgcctgagcctatataaagtaggctacttcctcttaagtactctctgtcgctctcatttcagcagtcctcagttcataagtgctcttaccccagctacctctcttccttcattcgaagagtacattccctaggcagcaaggacatcatataaacaaattatatctgtttctgtctaaacttgcaagttttatgtgctacttatttagaaaattgttcgatattcaggtgctattttgataaagttgggggaaagatttacttgttgcacctagaaacaacatgccttaaaagaaaaacaaaacagatttcttactggtgatatcaggacctttgacagaacagtggaagagtgaattccaggagatgatgtttcagagtgtccctcatcacatcatgcaagcaacaacctgttccacctatgctcaggacatgctttgagcacacaaatattcaacagtatagtaatgttaatagtcatgtaaatatttaacaatatagtaatgttaactgtaactttttagagttttagatgtatatcatatttttgcctaaatttttaatgacatatattctcagcatgacctagctaatgacctcaatatgcaatgatagtaacacaatgtagttaagtgaattcgtctctagcaataatcaatacattgacatctcccccgtggaaagaacaaagagaaatgaaaatttccttaataattcacttgctttccatttatattttaaatgactgtctcagcatcatttctcatgataaattggaactctttatttctttcagtaatgtacctgttaaagtatctgtttttccttcccctttatgaaggcagttgttaattgtaagtactctgttaactatgtgccgagcattcttctcagtgtaatcatcccaacaactgctatgaggtacatagtgtcagtatctccattttatatataagaaaactgagacacagagagattggttaaattcgccatggtcatacagctagtacgtttcaaagctgagatttgaaacctaatatcctaataattaagagtctgtgctcttaatcagtacacaatactacctctccagtgagcatatactatggaaggcactgtaaaaaatggtacaaaaatatcatcattgccctcaaggagggaaatgtagtcaggggactaatatttacgcaagtcataaaaggcagactagaaatgttaaggttattagaactgaagcaattaagaaattgtaaaggtcagagtgttggaagggtcatcaacatagaaggtgatagcagagaagtcaaagaccagtaccgggaatatgaaagtgagagagttataggataaccagtcagaaagtgggatatttctgttaggattttggaggtttagcagattaggatgctgataatatacagagtatggccatggcagtggggtcaataaagtggaatggcaacaaaaattcctgaagttaaaccacactgaggacagaatgttgggtgatggaaagatttgagggtgaaaaggatggctgtgatccaaatgataatgtcttcgataaatgtgtgaaaattactgggaggttggtccatggccaagcagagaggaaggtaatagaggttattaaaaccaaatgctgttgagtctccaagaagcagattttgattcataagagtgggggagtaggccgggcgcggtggctcacgcctgtaatcccagcactttggggggccaagaagggcagatcacgaggtcaggagatcaaaaccatcctagctaatacggtgaaaccccgtctctactaaaaaatacaaaaaagccaggcgtggtggctggcgcctgtagtcccagctactcgggaggctgaggtaggagaatggcgtgaacccgggaggcggagcttgcagtgagctgagatcgcgccacgcactccagcctgggcgacagagcgagactctgtctcagaaaaaaaaaaaaaaaaaaaaagagctggggagtagtctggaaacaacaatgtgggagtgaagagactcctattccttgaaatatgtggggcacgaacagatgagctgccttactgaaaatatctgaaggagaagtcgtgtcctcatgataagacgggttttggttgagtcaggaagcacagggaacccacagtgaagagaagatgaggaaagtatacaagttaaacatctgtcatgtaaccagagatctagaagacacatggaaacttttaggagaggagaagtagaagaaagtaatgagtagtacagagagaggagcacagaagtgaatagtaaacaaattagcttccatttgggaaactagctaaggatggaatgaatgtgataccaggtggcaataatgtaaagattagaaacaaaattctggagtaaatttgtctcaggcaagtatggtacttggtttatcaatgtaaagggctggcattgtatatgaaatgtaagagcattattcacaagggagcagccactcttgaaggagctggcaagggcagagctgaacagattagaggtgaaaatgtgaataaatttaaatcacaagggtttgttcctagagctatgattgtagatcacagggatggagaagcatgtcaatgtttgggcagggaggtagggtacggtggagggtaacaagtgctaaatgacctgaatataaaactaacccgccctaggtttccaaatggaactgctttatagtcttaatccaggtacaagttggtccttgacttgagtgtcacctgggtatctggaggatgttgcataaaaataggaaatcattataagaaacaagcacatgaaaaattatttggggctcttttaataaatcaaatggctggaaaatgatctgtttgttatgactaatgctaattacctatctgcattgaggagattaggattttagtaaaaactggtagaaacttagtcaaggccttaggatgtcaaaattgcaatcattaaatgcccggataccctgcattccagaattgaattaaatccaatcaacatttacttatgtatatttttagcttttaaatggaattgtaaattgagttcttttcctcaaagcagtcaattcagcagaggaagagaagtgtacaatcagtcaaataggatgtttgatattgttttagctctaaaaatgtcagcatggaccgaataaccatttttcagaaataatttttcaactgatttttttagcctcatataggatgcagccagcatctaaatgctcagttaacttatgtatagcaagattagctgcagttggaggccacagtagttacatctgagaaatgtagtaccatttcaaccatacacacaggcaaatgctcttagaaaattagttttctcaaaaagccaggatatgcaaaatgaccatatttaccaaagggctttgtgaggactccttggagcagaactcagagagaggtgggtaaatcacatgttggttagaagaaggagtgtgatttgattgtttcacaaggaatacatctttctcacctgaaagctgctgttcattacctcaataagggcagcttaaaggcttaaagaaggcctacagagaaatactaggcctctaacctgatgcattaccacatgatacctccacgacatgggagaccaagggatgaagagaaaccctagggtatgaacccctgggttgctattaattcttgtttacttgtccatagccttggccaagggtagctttgcagtgtggctaggaggaaatctcttagggagagcaagttctggctgacaattggattttccaaattgggaataaaagaaggcaaaactgtgatttttgtaaatctaaaaaacaatgtggatttgtttatacacattttatttgtatcatttcatgttaaacctcaaataaatgcttccttatgtgaaaaaaaaacaaaaaaaaacaagggtttacttattcactcaacaaatgtttactgagagccaaatatttgtcctcccaagttttacatttcatagttctatctctgaaacttcaagcatgcatggcttctaccagaagcagtgagatgtagtagtgattcaaagcatgggctttgtagggggatagacctgggtttgaatcccagatctactgtttgttttctagctgtgtgatcttggtctagttacttaaacactctgaatttcagtcttcttatctcagtcatctcatctgtaaaatgggaatactagcaatactactttaaacggcgaaagatgtataggatctgaaaagaaataagagtatgtggtactactttatatagggtggttgtaaggattaaattacataatgcatataaagaaggcactttgcacaatgtctattctatagtagacagtaaaaactacggtagtagcaagatgatgctcatgaagtcatccttgttttcagttcactctccctcttcttcacctgtctgtgtctctttcccactttaaactcttgggcaaaaatgtttgtcctacaagaagtcttttttggctaacagtttatcctgatatttcctttacttggcacctattcaaaatttacatacatagttcgggtcatgctaattttgcctttttgcctatttttatgtattcttatgtattcatttgtataattcctgaattcctaactattatagactaatagattcatagcttaaacattaaaaaatacataatttccatgtacttcagaaatcccttaaactaaaaccctgtccagtggtcattcacttactacttgagcactgtcagggacagagagttcatcatctcacaaggcatttcagttcattgctgaacagctcaagtttttagaaagttattgttcaaactatgccaaaatgtgccttcctctaactttcacacatttttccttgttgtgctttcctgagcaatataggacatattttaagttgtcttctatttactttatatcatccagtcaattaccaatcagtggtattgacatgttggctttttttcttaactaatgttagaatttcaatgtttttaccactaaaataattataaataaattattttttaaattttcttttggtgggatgggatatactccatctactttttgaggatgactttacttttgtgtcttggagaaggatttgggggccagtcacctgtgtgatgtgcggttttttgtgtctcaggagtccccctccccaacaatattctcctccctattagcatgctgtctaaaatttcatccttcattaaaacagcattctttcaggttttaaaagctgtagggtctttgagtccttgttaaaaaggcaaatggtcccaggaaaaaaaaaacaccaactgaaaagtactactgataacttagcagggattaattcattgatggcaacctgagtgtaaaacagcagattgattgaggtatgatctggaagcagtacaacactgacggagatccagggactttgtttcattcatctcagtatagcacagtgactgattcatatcaggccctcattgatgaatgaataaatgagtgtatgaaaatgaatgaatgaggctggaaaagtgagcatctatccccccagtcaaatatttcctacttcataatcttatctagaaccatttaagtgtgataacaccagaaagattggggttcctcggcttgatgacaccatgctgactcttaacagagtgttcttttaatctctgtctgctctccccacagctatttgatgtctcatctttagctggcagttggagacatgacttctttgtaggctgtttctatataaagctctggcagtaggaactgcctaggttaccaacagtgattcacacagctacataaagtgcttacacccacacagggttatggagtgaaggaaacagattccagttcagatcttgtttcactgcacgatattgtggaattagttaacattactctccacttatctacataagctattgtagatgtagtgatctccatcataccatgtgaatttgagtagagtattaaaaacctcattaattctcaccagtgtttaatctaagtttaaaatgtggggttagcacttagaggagtgaggagattattaagtgctttcagagaaagaaactcttttaagtagtatatagaagcaactgttttctgcaaacaatctttgcctattcaataaagcagatccagcagtgcttctttttggcatcattttagtagcaattcatttgtgttattatattacttgaaaataatagggctgcattttatatttttaaaaaactttaagaggaaggcctacctgacagaagttttcttaacaatggaaggatatatttaaaaatacataaaatgcctgttttaaggctatatagtaatgtaatcaaagctaatgaaatatagaaatctgcttcaaagaataatgtgatttgaattaatacttcagttgcttttatgcaaatgaatacttcctaaagcactagaaaaattgtggggtctttttttgtacaaggttcctagtgcagaacttatatacagtatgaattttctttatcatggaatgagtgctaaccattctccaaaataataaaatattactatattctataactccaattatagaacttgcctacttcaagcaagttttattagtatagtttcactctatttgcaaaataatttcataatgaaagtaggcttctatttcctttattttgtatgctcaggctgtacttctgacaatgaaaaaagttatatctaaaagaatatccccattgctcatttgtggatattgttcaaattattggatatcctattaatacttctctgaagaaatagatgtccacagcccattaatccttactctataaatacataaaatgttagcaaactgataaatattgataaaacttgtctcattcaagcaataatacgttatgaatcttctactttaggctttcatttcactgaactgtgccatttaaatgtaattatactttcataatatgaagctgtggtggttttgtgttgttttatatttacttggaacatttttaactgttataacttcttttttttttttagatggagtttcgctcttgttgcccaggctggagtgcaacagcccaatctgggctcaccgcaacctctgcctcccgggttcaagaaattctcctgcctcagcctcccgagtagctgggattacaggcagatgccaccatgcccaactaatttcgtatttttaatagagacggggtttctccatgttggtcaggctgatctcgaactctcgacctcaggtgatcccaccacctcggcctcccaaagtgctgggattacaggtgtgagccactgtgcccagcctgttttaacttcttatgggaatatttttatttccctacggtaagatcttggagatagtctatatttttttgaaaggcttcctcaatcacatatcctatttgtactttagggaaagaaaatattactcagaagagaagggtaatttaagacttttaccttcagccaaacaaaatggcaaaaatgaacaaacactccaatgttctaaatttactttcatataaattttaaatactgcataaattgtgttctgattcctgagaagctaaacagtaaagtaccatgttctactgaactatgaaaaaaatagataatctcaattcctttaatatggttgttttcctgaccctgagtcagtttcacccttgtctttgatataccactagaatttgttttgaacagaaggaaagcagtgaagatatacacaacaaaaggcaaatttctagtcctccaagcactacttttgcacctgttatatattctgttaaaatggtataagcaattatggataatacattaggaaactcagagaactacagtttattgaggatattgacttaaatgagtcagaagaattttcaatttgacaaaattaaaaccttttggagtttcagggatacgaaaagctgatctggctgggcactgtgaatcacgcctgtaatcccagcactttgggaggctgaggcgggcagatcacttgaggtcaggggtttgagaccagcctagccaacaaggtgaaaccctgtctctactaaaatacaaaaattagcagggcatggtggcaggcgcctgtaatcccgtctactggggaggctgaggcaggagaattgcttgaacccaggaggcagaggttgcagtgagccaaggtggtgccactgcactccagcctggacgaaagtctgtcaaaaaaaaaaaaaaaaaaaaaaaaagctgatctgggtgccttagggagaaattcacaaagaaaatagccaactatattctggccaatttaatttagaaataatagtctctctaggtttagtctagcttcatgatttgcctcttctgaagctataagcagaaatatgtggtcaactaaaatgtgatttatatgtggacaacatatgcagctgaactgtgcacaaccccatttgactgtgaaggaagttggtgggaaaatacttgttgaatatttgctactttaccacacaggatgttgaaaaatattttgatccacagcaaatataaaaataatttttgctaaaaaaaatcactgaatctaattcctcattttcaaaacacccacttaatttataggaagatgtgcttatttataggagccagcctctctccccacctactcaccgcctagccccatgggagtggagggttggagtggaaatgcacttttgcaaaccctgcaaaaatctgaaattagtatccaccccttcacagatatcctcttgtggatggtagaattatttagttggtttacatatttatggagcaatcaccagacagtaagatcattttgtttcataaaacacaggaaagttcctaagcacataacaaagttttcatttatttggatctcgacggttttttaaatcttccttttgaaactagctaagtgagccagacttatccataccagaaaaacctgtgaatatgtatttaggatttatttattgcatatcatagttagagtgcaattccttttttcaacccactatacaacagatgacacagcatttttttgttccaaccttataaaagaaaggcccaacagacagcatgttgaacatttttatggctaattcaaacacttcagtacttgtctcaagcacattttattttggtttatttttccatattttttaaattttattttattttaagttccgggatacatgtgcaggacatgcacgtttgggtaacttgttatactgacatctgaaatcaaatttccaatgtcttctgacaccatatggcaactgcttcaattatgagaacaccaagacactcagccaaggtcagccaaattgatttgaataaaacaaaaatcaatctaattgattattttaaaactaagcatcttgaagatgggaataaattcccagaatgaataagatcagtaagttcatagaatctctttagtggctacatgctcatgggagtaaggtgacatacagaatacaaatatgctaagttttgccattaatttaattacctgcatgtggctagcccaccggtggtggttaaatctcaggctaactttctttgatcactcaacatacttcagagtcacgtctttatatgtctgaagagaatgcctgcataaaacagaatatgaaaatgtgctgaaaaatgcatttcaaagccaacttcgagtgtctttttattatctgctcctttgtatcatctgcatcactgcttcccatctactggtgtctgtaactgactcaattcccttctaaggactaataagcagcaactctgagaaaactatacattgctttaggtagaaaatgaaattcaattcaaaaaagaaaaaagttaattttaagatctcaagaagaaagccagtaaagcaaggttattgttaatgctttaagcgtataattcttctaagagaaagatcattagagctttgataaatcactaacactttgagcatgagcaccttctaatcctaaatatctgacaaactacaatgaaccagaatgctactttttgcaagacagaagttcccttatgcattctccacgtttttttctgcctacacatctaaaatgttactcaactcagctatttttcccatcatagtatttaaaattttgctcttccctcttaactgagttaaaagttaagtaaaagggttattttaataaccctttgccacagttagtatcatatatgtttactaaaataaaagatatactatttgaacaaagtcactgaacattccacttttagccagttgttttggtgttatgtaaataagcctgactcttgactacctcctaatattcttgaagttatgagtagataaagttactttttttttttttttgagatggagtctcactctgcggcccgggctggaagtgcagtggcgctatctgggctcactgcaacctctgcctcctgggttcaaacgattctcccgcctcagccaccccagtagctgggactgcaggtatccgccgcttcgcccatctaatttttgtatttttattagagatgggatttcaccatgttggccaggctggtctcgaactccagagctcaagtcgtcccccaccccccgccttgggcacccaaagtgctgggattacaggtgtgagccgctgtccccagcccgatgaagttaattaaaaaaaaaaaatacaagcaaatctcagccgggtgcggtggctcacacctgtaatcccagcactttgggaagccaaggcgggtggattgcttgagcttaggagttggagaccaacccggccaacagggcgaaaccccgtctctactaaaaatacaaaaattagtagggctggtggcgcagcctgtagtcccagctactcgggagactgaggtgggaggatcgcttgagcccatgaggtggaggttgtagtgagccgagatcaaccactgcactccagcctgggcaacagagtgagactcagtctcaaaaaattaattaaaagcaaatcttattctgaatgttctagagaaatgctgtccaacagaacattttacaactatacaaaattctatttctgtgttgaatatgtagccacgagccatctgtggctactgagtgcttgaaatatagttaatgcaactgaaaaactgaatttttcatataaaaaatgtaaataaccacatgagcctattggctaccatattgaacagtatatgaacatgaacatggggtcgttggataactttcataaggtccatacaactccttgaaattgtgcacaaaattgtgtgtgttgatttattttgtacctaggtttcatcaaattttcagaggtaactctgacctcagaaaggttaagaactactatagcaaggccgggcgcggtggctcacgcctgtaatcccagcactttgggaggctgaggcaggcagatcaagaggtcaggagatcgagaccatcctggctaacatggtgaaaccccgtctctactaaaaatacaaaaaaattagtcgggtggtggcaggcactccccagtagtcccagctactggggaggctgaggcgggagaatggcgtgaacccaggaggcggagcttgcagtgagccgagatggcatcactgcactccagcctgggcgacagagtgagactccgtctcaaaaaaaaaaaaaaaagaactaccatagcaggagtactatgggctttatgtttcctgacacaaagttaaaactagaaacacggtgatttttttttatgttttaagaaaatatgcaaattcttcaacaaaaataatttcctaaagttgaattcaaataatgcattatacaattctacaatcaacatgtattcctcttttttaaaaaagaaaaactttttattttttaaaaatgtagatttacatgcagttgtaagaaatagatctgtgtacccttcatccctttacccagtttcccccagtagtatcacctcgtataacgatagtacaatatcacaaccaggaaattggagttgatacaatccacccaccttactcgaatttcactagttttacatgcaattatatgcatgttctgcacaattttatcacatgtgtaggttcatgtgactatcaccacagttaagattcagaacgattccattgcaacagagctccttcgtattgtccctttatagccaaaaggacctccgccccgtaaccccttattaactctgggcaaccactaatctgctattagtataattttatcacctcaaaaaatgttgtataaattgaatctcattgtatgtaaactttttgggattggcttttttcattcagtataattctcgggagattcatccagattgttgcacatattaatagctcctttctttctattgctaagtgatattccatggtatagatgtaccacagtttgttttaccattcactcactgaaggatatttaggttgtttccaagatttggcaattatgagtgaagttgctatgaaaatttgtgaatggctttctgtgaatgtaatttttcatttttctgagataaaggtccatgactgaaattggtgagttggatgttagttttataagaaactgccagactgttttccagattggctgtgccatttcacattcccaccaaaaaaaaatgtacgtatgatccagcttctccacatccttaacaacatttggtgtagacacattattttttttaattttagccattctggtaggtatgcagtgatatcacactgtgattttaatttgcatttccctaatggctaatgacatttaacatcttttcgcgtgcttattttccatctgtatttcctctttggtgaaatgtttattcatgtcttttataatcagacacaagcatccaaaataggaaaaagttctttttacataggaattcaaataatcagtggataatatggttttacaaaagaaagaaatgctgttcaatggggattttttttaattggctatctgctaagacagatgccctaacattaactcttaccccagtgaagatgtttttgtggaggactaggaaaataggacccaggaacaaaacttgcctttctgataccttgactgtagacagaattgagagaatacaactggagataaaagagagcttttagcaggtatcagattcaataatttcatgaatgcattttctagcaagtatctgtagtgcagatattttatgtccttggtatgctttggatatatttagatgtagtttgttgccttgttttaggagtccaagttgtatacctacctggacagagagctgtctactacagttcaggcagggcaacagaattacctgcaggctaaactactcttctcctcataaaagagattgaataaaaagcctacaatgacagtccactgcccagtgaatcaagaccaactccaaaatatgttattcaaggtcaacaaagccctaacctaccttttctgcccaatctcccactactcctcctctgtactctagccaaatgaaaatactgtttcccaaatctgctctgctctgtcctgactctgagcttttgttactgctatatcctctactgaaataccttccctcaccatttgtgtccatcaaaaatcccacctatccctcaaggtcctgcagttatccatgaaacagcccctacttccttgagtcagaggcaaacattcctgcctctattctagcacaggactttgtactccctcacagcacttatctctctgaccactcttttgtttaaataccacaccaacgcaataacatggatgaatctcaactgcattttgctaagtgaaagaagtcagacacaaaaagctacatgtatatgacaatccagaaaaggcaaaaaccatagggaaagaaaacaactgagtagttaccagggattaaaagtgggaaggggttttgactataaaggcatagcatgagggagtttttgtggtaatgaaaccattctatatcttgactgtgatggtagtggttaaatgactgtatatatttgtaaaaacttatataaccatatactaaaaagggtgaattttactctatgtaaattatacctcaacaaaaacgttaggaaaaaatcataccagctaggcagcaaactagatagcctgccctcaaattcttgccaatcatttacttgcacttcaagtgatgtgccagagcaagatctgtggctacaaaaaagatacatggtcccttctctcaagaaactgtctctaatgaaggagataggcatgtaagtaaataaatgcaatatagtatgaaagatgccatatatattatgtgtaaaatacagtgaagaggtaaaggaggaagtggtcagattgacttagattgttgaaggcctagaattccaggttaagaaatttatatattgccggtcacggtggctcatgcttgtaatcccagcactttgggaggccgaggcgggcagatcacgaggtcgggagatcgagaccatcctggctagcacggtgaaaccccgtctctactaaaaatatataaaaattagcctggcgtggtggcgggcgcctgtagtcccagctactcaggaggctgaggcaggagaatggcgtggacccgggaggcggagctcgcagtgagccgagatcgcctcactgcactcaagcctgggcgacagagcgagactccgtctcaaaaaaaaaaaaagaaagaaagaaatttatattgtattcaatatgcaatgaaaagtgacataatcatagctaggttttagaaagtataatctggctgtaatatgaaggatgatttggaatagggaagagactaaaatcaattagaaggctatttacaataatctaaaaaaaattaatatcacttctcttttctagtagtagacaattgagatcagactgtgctttcaattaaagcttatattgctgataatctagatatgtgaaagtaaaaacaaagagaggacccacagatcttttcttgataccgttaatagggttaactcttaatttaacttgtcgcattcatgtttttatcttccccagcaaatttgtaggactttgtagacagcagaagctctaagaatgtttattctaatgaatagagcagatgaattttattttaaatcactgaaactccaaaatagaaaattataatacctctatgcccaatgatagttactgcttacaattttatgttagaaatcccagagggttaaggttgataaaaatgttttgttccttaatttgtatacttaatgtaaagattaagtgggattcgtctagcacatttttccctagcaatactgtttcattgaaagtcttctattctttacttattcactgctacctattacaacttgcaatgagtgacaagggtaagattctgttgcaaactggacaatagcaggcagtataaatctactctttagtagactactcttaagcaattgattattgcctctgtcttagaacttggaaacctctgcctaaaatgccatacatggggcatattgaaagcactgacacatgttagcctgcttactggaatgtgtgtactgaagagtttttattctgttttaaatctaaccaatagaaggccctaaaaccaggagggagctatgccctaaacaccgtatagaggccaaacatatgctctcatcaggtctctaaatacctccatcatcacctaagaaaactaagacatttaatgaactagtgggatcattgaagataaacttaatgagcctcttcttcaaacaaacaagagcttcagggtttcaatttctgccctctttttccccctctcgaaaatcaaacattgctgagccacttccttgcctctgataaaagactttctgtggctctagagttggcagcatccagaatgttcaacagtcacagatttctgtgtctgaactagtttactatgaagaagataaaatattttgatgttaactgcacccaaagctacacagagacagcttagaaaaaatgtacctccccccaccccccagctaattggaagattgtcagctaagggagatgtgattttatagatgccagggtgtgctctgattcaatgcatctgggcttttttttccttttgatgttcccgttagtattttccccattaaagttcttgtactttatactgcatgatttgtggtgaagtcaaaaccgaagtcatttttgtagctataaaataccttattgttgaaggcctgcttgttccttgcctgtttcctgctaccaacataaccgtaacacttgtctaattctggtgtgacagaacttaattattctgtgaatcatgagtggcaaggcagccaatttcagttgtcccaactacgtgctagcacctggtcacttattgccagatacttgtttactccgagttattgatcaagtttgagtcctgtgcagctgccactaatcctaatgcatatagttggcagctgtgaatttgtgactttgcccccttggaatacaaaggcagcctttgcccacactcatgaaggctttaacttctaaagggtaagtcttagcttaataggtgattgtgattacatactacagtagaaggacgtttattcataaattattttttcaggagccccagccttattagaaattatccagttaggtttctatcagaaaagaatcccattgcctgtagattaaaaaaaaaaattactgcccatgggcatttttttttttttgaaacagagtctctgttgccctggctggagtgcagtggcatgatctcaactcacttcaacctcccccaccctgggttcaagtgattctcctgtctcagcctctcgagtacctgggattacaggtgtgctccaccacactcagctaatttttgtacttttagtagaaatggggtttcgccatgttggccaggctggtctcaaactcctgatctcaggtgatccacctgccttagcctcccaaagtgctgggattacaggggtgagccactgcacctgaccatgggcacttttaataacttaatttctccctaatttactaaactgattttatccatgcctgacaggtccacttccttctacagctcttctctcatttgtcctaggcaatggcaagatcatagatatttattttagatatactatctgatttgttaggctttcatctaatggaatattaagtgattcaaaatatatctgttcaattttttaccagtagtattactattttagttgagaaagaagaaacagagactccctcaatgtcacataaccagtcaacagcagagttaaaaataagaacagagactaaaataggggggattctgtggatctagtatactgagtgtcatactggatctgatgaatggattggaaatgaacctcaaatacgtggtcatatttgcagggcatagttcattaaaaacattttcctatcccactttccccaaatagttgtttttctttctttaataagatatacagaaattctcttgtggtcacaggtttaattcttttggaatcttcaccttactggaaacctgaaaaggaaagataggagactgcatgagacaagatgtttccgaggtaggtttgcccaataccagagtggggagtaaagaccactcatctccatagttccttccagcacctcccttgctcaacttacccccatgccttgggcctttccccactctttatccctctccttctcagcaatctgtgatcctctcaatcacctccctaaactcaagatagctaatttgatctcccagtagcaatcaagtgcatacaatttagctcaagttttctgcaatgacctccaccaacacaatttctttctttcttatttaaaaatatatattttttatgttttgtagagacaggatctcgctatgttgcccaggctggtctcaaactcctgggctcaagcaactctcctgcctcagcctctcaaaatgctgggattacaggcatgagccaccacacccggcctcataatctctgttatctaggatttctgggctgctcagcaggattctggtgagggggttcttagcatggtaaaatgtgtggctgaagaacacccattttttccaccttgtaataatgttctccctatgtatgtgtagaggtagtatagcagaatgaaaacagcatggaatttggagtcatacatacccctgtgtgaattccaaccccaccacctaccagctgtgtgaccttcagcaagatacttcatttttctgagtctcattttcctcatctgaaaaaatgtaaattataataggatatcattacctgttgtgaaaatcaaatgataacattaatatatgtaaagtacctggcccatagtaggctctcaatggtagttattaaagttatggatatgaaaagattgttcttagttttagatacagcgtatctactgtttgtaaagccactctctgtaattctgtcctttctttgggtgcatgaaagttttgctttaaaaaaagaatccctgtttcctaatggttgtatactaacttgagctgaccgaggtttaatcttcatttgcaagtgacattatgttatttggaagtatgctgttggcatcatgctttggcttttcattttgttttgttgactgcttcttctctccacacacccaccattttcttcttgctatctacatagagcagctgcctggagtggagatttattgtcatcccttgtctacacattctctatacctatgttgtcgagctgtgtatccagcatcacttagatgccaggataccgtttgtcccaagttgtgctttgccattcatttaatggtgagaagccagatacagtgtctcattccttgcaaacatattaaaagctgaacactatcatccatctcaacatctctatagagtcggtgtgatgggaaactaaatctgccacaatggttccctgctgttgctcctgcagaatgctgctctgtttatcagttcatcattaaatagtgaagtgctcagggcagctttcagtttagtattgctgatacaaatatttagcagggtaggcctttgtggtaggatttgaagaattcaaaaaggctcctggcccatatatatcctggcccatatatatctccctcaatggtcacagtgcctgaaatgcatacaagagatatttcacttgaactttctctttttggtataaagcaacatccaaatgcgaatggcactctccagagggaaaatagttaagtcattatcagctattaatacttaagagtcagaacggcattggaatccttcttctgttcctagctatatggattttggcaggttgctgtaattctctctgggccagttttcccttctgtaaaactgtggttaataatagatacttgtgaggattaaatgagataatgcatgtaaaacatatagtaaatgctcaatgaacagtagctgttattagtcttagggagagtaggactccgagggaatatatttgggactagtaaatttgatttgtcagatataaggtgaagtctggtacagggggactgctcagagcaaaggtcctggtggagtagtgatatggccagggagtagcatggaaactctgggggcctgggtttggaagaggagggtggaaggaagaagaaggactgaaacagggtgaaactatacttaaattaacttcccaacaagaaaagtgtagtcttactcaggatgggatgcttggtgaggtagtgagctctgacactgggagtgttcaagcagatgctggatgctagctacctgtcaggaatactctagtctaccctagggctcctcaaacatatatacatgcagatcccctggggatcatgttaaaagacaggttccaagtcagttggtctgggtggaacctgtgattctgcatttctaaccagctccctgatgatgctgatgctcctgatcaacagacctcactcttggtagcaaggctctgttgtagttagaaaataactcacagtgaaatagaggaatacggttgggtaaaaccagtgggttacccaggcaagtctccatagagtggaagtactttgttgcagtcatgatctacaatctggttcttagctttgtaagcctcgaaatttgattggtagtataaccagagactgggtttctggggactgactcacacttaaccaaattcacgagagaccaatatataagccagaatgccagttgattaatttataatgagaagtacaacttccaagtggaccagatactagtgtttgctaatcagtacattatctccctgtaggcatatttacatgaggagctaactgataataagtagggttgctcggtgaggatgaactcagagcaaggggggttcataggatgattttaatgactcacgttatcaagctatggtagtctgatacctccattccacaagtgtctagacctccagaatagttctggagatattggcctcctcactagtctctttttcatcagtcttgtcctcatacaatccatatgatctctttaagttcaaatctggtcataccattcattcgctccattgacttcaatataaattcacaattttaaactcattattacaaaatgtttaaaatactgtataagaaaagtaggaaaaaaagtacaatgagcacccatacacccaccatctagatttatcacttgttgtcattttgccatatttgctttatgtatgtgtatacacatgtgcatgcatattgagtccgtacgctttaatataattttctggcctggcgcggtggctcacgcctgtaatcccagcactttgggaggccgaggtgggcagatcatgaggtcaggagttcgagaccagcctggccaacatggtgaaaccccgtctctactaaaaatacaaaaattagccgggcatggtggcacgcgcctgtaattccagctacttgggaggctgaggcaggagaatcgcttaaacctgggaggcagaggttgcagtgagccaagatcatgccattgcactacagcctgggcaacaagagcaaaactctgtctaaaatatatatatatatatgtatgtatgtataattttctaaacttttcatgttctggcacaagttatttgactagcttcacttcccttggctccacctttgcaactttatatcccaaccataccgaactactgaatgctagttccctgaatgttctttggagttctcatataatatactcttgcctgtgcctgaaaatccttactctctttgcttgggtcactccatttgtacttaaagactcagtcacacttgtcttgccctagcgccttatacttttctcagtcataacatgtattacactgtactgttattgatagtttatctctctgattgtctcactagaccatgagctcattgaaggcaagggctgtttcttttgtctctctacacccctgtctctcccatgctttgcacttagtaggtgttcagtgatcggaaactcaactgcctatcacacagttctacctggttacatcataggcacctcaaaatcgacatatctaaagtgaactcatctctccttctacccattctatacatttaaaaccctcctcctgtattccctgattgaatgtcatctagtcttccaagtcaaaaacctcagagtaatttctaactcctccttctctttcatcccccaaaccaagtcctgttgattctaccaccaaagaacattcccattctgcccacttctcttcatgtccactacctgtctatccaagccatcttcatctctcacctgtagcactgccaaccatcttctgtatgggctccctgctgctattctcattccctccaatctattatccacagagaaggatctctaaacttcagatctgattctattactccctgattaaaccctgattatattactcctcgtttttggataaagtctaaactccctagctttacccaaaggactctcaagaactggcccccatgtacctctccaacatgatctgttaccaccctccctctgttactttaggttccaaccattttgcatttactgggcctgtagtaattgtagcttcctaacatttctttttcatatttcaatgcctttccttgtgttgttttctgcctagaaaagtttactgtctcaaactcagcccaggtctaacctcctctgggaagcttttccttacttctcagtctgggttaggtgcttctctgttatccactactaccctgtcatatctccatcatagtgcttacactatatacatatatcactctatactgcactttccattttacttgtccttctcatcaaaactaatttatgagcttcttgataggagagttgatgtcttatttgattttgcaccacaatgctcagcccatggcttatggcagatgtacaacaaatatttaagaaaataatgaatggaaaaacattaataaatgtctctctgaacttcatttttgtagctataaaataccttctttcttctgaacacattgtttcttcaaagtacaatatagttggctgtcattcaggtaatatcaattgaattttgaatgctcttcaccagcaaaatcagacaatttctggaattgtaccatttctcagaggtggttggtcctacccatttttcccctaggtaatttttatctcagagattaccatcagtatttgggggtaccatgctattggtctcatatacccactttgacctctaaagtccttttcaatacctaagagtatatgtttcacaaaattgcacatttatttatgttctaggtgttgtttggtatatgatgttaattttcctctaggtttctctcaagccataagagtatcaagtacagaattggtccatgcttaatctttgtaaataacattgattaagtaaatgctgggccagggattgaggggagtaattgatcagaaatttaacaaatgttgagctgcataaagtagactgtatttatttgaactgaaaaagtggctaagactgaacatcttgaacatcattttctctgatattacctcaaattaaaactttaatattattttagaattgtgtctctgaacctgtttaataattttaacatgttttttatattgctaagcattgttctaagtgctttattacatgtattaactcatttaatcatctgaaaactctgtgaggtaggtgcaattattatcccccttttacagatgatgaggaaactgagccacagggaagttccccaaggtcaaaagttattcataactatcagacagcaggtatattaattcagcttaattcaaggctcatttgttaaccatctagtaaatataatagttgacagggtagacaaaaattgaatacttaagcaaggataaatcgtaatgtaataatgccatgagtgaatcgcctaggcgagtcaggctcctttcagttagtgggaaatggagaaagattatgtagttaaggtcatgaatagcgcaggaacatccgctagggtaagtcaggtttgtgaaaaatgcagaagaaaggcttggttctgaggtgtgtgaaaacagtcattcttttgtgaggactaaaattagttttagaagaggcatctgatgcggtacatgaaacctagggtaacggtgaggaaatacacatgtatgaggcttcttaggagcagggaaagagaaaggtgccatttgaagtcagtaagaaagggtaacagcgcgcttttcctgcccttcccccctctagagaatcagtaaatagcctgattctactcaaattccttccctacccaaattcccttgactacaactcagaccctttggatctgcgctttttagaagtactgtacttcacattctggcaccgtaagcccgaaatgtcctttaggcaaatgttaggagggaaaaatgtattcttgcaattcaaaaccgactcgaatcctgccagaaagctttatgtttgcggactttatcgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgcagctactagattgcacccctccagacctctgccatggccagtttctcttattttcctcattgccctcctcgtcctatccccttgctccgaaggaaagtgggtgctctttctgtccccacggagtggggcagggtcctccccgagattcaccaggcctgggtgttgggcaaaaaaaaatccttcatttgcctctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtcttagagtctgggttctctcatcagtcaaatgagaatgaataataagaaaacttatccacaagtttgccttcaggataaaatgaaataatgccttaaagagtttagtgcagtaaagcacatcatccactctcagtaagggttagctgataggattagccttctgggagtcactggaaggaagaagctgcttatttgactactggaggttttctgtttttcttaaaaccttatgactgaacctgcctagagagcacttgtattgagtggctggatggcgtaatggaaagaacactgaattggaactcaggagatttgagttcttttagccccttctttgcctctaccgactttgtaaccttgtacaagttactcacatgtcaaatgattgtataggcagtggaggccaagttagaagcgtgtactgaaacaaaacaaaagtagatgaactctaagatccctttcagatctaaaatgctatgatttttagtttttatattgattaaaggagaaactgtatctctcttggccgataattcattgattagaatgaatcagtagcttttagaagttactgaaaatcaagaataaagacctaataaagtttatagtctttatatttcagttgactgtctaatagcaagggtttgactttgtcttctaatgagattcatttgcatgaatgatttgtaattgaagagtatttaattacagagtcctacttagaccattttccttttacttctgttaagggtatttatctgatagttttaggagacaataaaattaacttttgcttggctcccactatatgccaggcactctacatacatattacttatactttattgagaggcaatatggtgtactaagaaaaacacaggcattttagtcaagattgggaataaaattctggatttaccacacaatagctttgtgtccttggtaggattatttaactttactgagccttggataccccatctgtaagatggagataatatttatgttgctgtgattattaaggattatatatatatatactacccagctgataatagtcactgaatgttataataggttaatgctaacaggatgcaaaaaaataatgtacaaatgtatgattgtgcaactgtcgatttgaagacatgaatacactgagaatctaactatgggtgttgtgtttcaggataccatataggaataaagccctaaatattgatcactaaattacactacattcagaaaagcattttgatactttaaaaacaatattatctgagataaaggctataccaaagtttgccatcaagctaactagataaaaccagcaaattacttgaggtaaggaatcacatttctccttgaactcctggaaaaactatttttcaatatagggggaaaatcactgcatattatccacatgtgttattgaatatttgtttgcaaagtgttatattgtttgctttactcattcctcagagtaagcctagggtttccttttaacctctggtcaaaaacttatcttggatcatagtggcagagagataggactgagatttaagtatggattagttcattatatattgctgtgaattacgaaggggccaccaaatgtggaaaagccttctgtatcttctttgtttacaaaatctctcttcactcactctcataggggcctgcacttgaattgtttgcccttggttagagtttgtgctgagtgtctatattcccacctaactaatttagaacagttgctttaaaatttttgtttaggagaaagaaactccactatataagagcaatcaattaggaaaatgagacttttatgtataccaaaatttttcaaaagttaattgtagcctaacatcaactcatgcagtttatttctgtattttgtttgcagagtattcagaaaattctgattcacacagataaataattgcaaatgacagatgcttattggcagtttggcttgcaatctctggatatatttcaatcaaatcagtgcagaaacctgaaaggaaattaggagaaaatttttattccaaagtgtaattactattcaaatttcttatcttaaaaatgaaagtcagataagtggccaaatcttaaagtaagcattaaaaccatctaaaatgtaagattgtcacgagacacgttaagcatgttctcactattgcacaacaaactgttctgcttacgccaggcagatgggcctgagctttgcctggtgtctaattgagcacaacccacaggttgaagagatatgtatacttgcttgtacaattttccttgagtcaacattgtaggcatgaatttattgaaagactggtgcagaactacaaccttcataattcatgaaacatttacaacgttatgcataaaacatatgcaaagggatgtcaggagaagcattattcctgagggctgtaaaaaaaaaaagtgaatgaaccaagcagtttaattaatgatttgggggtctccaatgggatacagtttgatatataacacagttgcttgtgtacattgttgaaagatagtggaacagattagttaagaggttgtgctctgccaattagtattttttaaatcttaggccagttattttacttctctaagtctcagttttctcctatgtaaggtaggcataataataaacttgcctcctaaggttgctgggattcaatgagataatgcagataaagcgtttagcacagtgtctgacatataggaagctactattatgttttaatcacagttaaatatattttagaaaatgaaagttgaatcctgtgtttgtagaacataattggaaatgaacagtctagagtacttcaaagtccacattacctgaaattctaatttgatccctttaggtacggagggtagactgaattttaacaggaaaaagatcttttggtcctcctatgtttgttgtacttttctcaaataactgcttctccctcctgctaccaatctttttccgttcacagaggaccttggaatagtatgtttgtactacttaatcaccacccaatcccttctcaaccattttatatttaagttttattctactttttctagaatgttgactttgaaaataaatctttttttaatagagaagttcaaaagggattggccagtgatgattaaccaatgtaaaatactattcccaaagccattttcagatgtagccttcttggtacctctgcaggactgtatttgacactgttgactgcctctttaaaactatcccaagtagtgtcttccttccttgcctctcttttgtttcattactattttattaattcatgcatctgacacttctcacttgcatcccagactcctagcactcctcctccagtaaatagatgccacatcctgttgattctggcactttaaacattctcacatatgtctccttcttccttgctttcaataccctgctttcagttcctgtgtcttctcatgggaaaaaatacttagcctcttgattggtctccttgcctccagtagtttttttcctagtatgcagttcttcctccatgccatcagaacacagctctgatcacatatatgctattacttataaattttggactacatttatcagcatggcatataaaactcctagtaatctgatcccaaactacattcaaagctttatatgtctcttctttcatgttggtccctaaacattctctattcttttccactaacattcctttgcttctgctattgccaacagacctgtttttcttagctctgctagtcaaaaatttacacatccttcaaaatgcaacacaaatgcctcctcatctttgaagcctttcttaattctttcttttcctcttcccagcacagcccacacccaaaacaaagtatagtaatctctttttgttccaatagcacttcctctcttatagtacgttctgcattttgctggtaattatttgtttacatattttaccttctactggattataatcattttaatgttttgttaatctttgtaatctctatagaaacctttgtactatacatgctctagaaatgcttgctgaattgccttaaacactcaagaactctaatgccagaagggtcacaagattcactagaaaagtatctagtggatcggaattcaattcatcgagcatttatcaaaggtctgctgtctgatagatactgtgcttcttgcctgagtatacaaaataattaaggtaaagtccctgccctcttaagcaatgtagagcctggtagaaggaagaagagcatacaggaatagagtgtacacatacttcaagattgctggctaacttctatggtgattagcctggttttatggatttttaatggcaaaatgccctaggtaacaagaaaataatgacaaatgacttttcatattgagttttccctgtgctggggtgttttatttttttgatcttttaaaaactacaccagcattatatttatgtctccaattaaaatgcttccattgaacatgttggtgaatgtgaaatttcataaagtaaaaatcttttttaaaaaaaggaaaatagagtcagccccctatatctatgtccacatctatggattcaaccaactgaggaggaacaatatttgggggaaaagaagcatctgcactgaatatgtacagacctcattttcttgtcattatcccctaaatgatacagtataacaactatttacatagcatttacatcatattaggtattataaataatctagagattatttaaaatatacaggaagatgtgcactggttatatgcacacattgaaccattttatataaggaaattgagcatctgtggattttggtatcattgggaggtcctgaaaccaatcccccatggatactgagggatgactatatagcttgatcagtgaattgttttctaagcacataaataacttttcccccctcagtccctggaagatatgtgttttcaatacagaatgccacattttaactctgttcacactcaaatggacagaaaagaggagagtactaaagacattttctaagtaattttctgattataaaattaactgttatagaaaacttgaaaaatacagaaaagtgtaaaactaaaatacccataattctacaacacagatgacaccattaatattccttcttaccttgatttctgtacataggcataactttgtattctacttttgtaatagttaattttttataaatattaatgtagtaataaaatacagaaaaaaatgaaaaaagatatacaaatctgttttagcattggggggattagtcattttattcttttttatttatttattttttttgagacagagtctcgctttgtcacccaggctggagtaccatggcgtggtctcagctcactgaaacctcctcttcccgggttcaagtgattctcatgcctcagcctctcgagtagctgggattacaggcctgtgctaacacacccggctaattgttatagttttagcagagacagggtttcaccatgttggccaggctggtctctaacgcctgacctcaagttatctgcctgctttagcctcccaaagtgctggaattacaggcgtgagccacagtgcccagcttatcattttattcttttgctctgtatatagatatattatttaaagaattatatactatatatactagttttgtatactgctttctattgtaagaatttctccatgtatctagaaatagaagatggtcctcttgtagttgaaggttgtggtcattgactgagagttggggattgagcctctctttctttagctaccagaaaggaagtgaaaaaatggagatggggagggttgtgaattggggcatttaaataaaaaatatgcttcaccgaggtttacattgaaatatacttactagccttaaacatggtctgatctaacccatatgcattgcctattgtggccttggtatttcttagggtttgatcaccacttgtgcttcagttcattttctcccccaatattcccataggtaatgcctttttatttttctttttttatgtcttcttcacaattgaggtttgcacctggtttccctgttgcttttaagtagcttttctattataatgatggctactgaactataaactattgttggtgtttaccccaaagtttatttgataaggcaccataggtatttcctgggaataaataatttttgtatatgtaagttctatcgaagtataatatacatcccaaaaaggtacataaatcattgatttagctcagcgaaatttcacaattgagcacacctgtgtgaccagcgccctgctcaaggaataaaatagtaccaaactccagaagagcacctcacgctccaatatgaagaatttttgatgtagcacaattatcaattttgtttcctgagggaatgccctcttgcagcatgtggtaggagcccagtcacccacagaaatattctcctcttcactgcactggggttattttatggtggtgatcctcagctacataccgtagggagttattaccaagcacagagtatatgcacctttccaagccagttcagaattgccacactttgctgtacaccaccaccttggagccctatgggcaaagtggaacacaagggctctttgttgtgttatttcctgttctgtccttttctttttcagctgtgtgtatgtccttccatgcaccatagcacgtagttactgcttgaatttaccgatagtcttagtgcaatattgatttatttattaaggaaagtttggtgattcatgctgacctctgggaaactggacttgatgaaggttgttagctccagaatctgctcatgaattacttgcttttaatacttgaatgaccaagttggtacaaatcagtaattctgagttaaccctattcattttgaccttttttgaaagaagatagtccttgagctcaatagttgatatatgtttctctttaaatgttaacttgtcatttcagacaaaatgttgaaatagcttagttaaatactgcctgcaactaaaagcgtcttagcttttaaaaagaaaatgcaccataatgttaatattgttggtgaaattataggagaaagtatttgttctcttcattattatttttctatattttctgactttcttataatgaatgttttacttttataatcagaaaaattcgtagttttaaagaacccaaaatactccaaaattattgatagatcctaaagaaagcattactaatgtgactatagtgacaacaggaacaaagcatatctgctcatagaaatgatttacaaactattatgagaatttaagaattgctttggccttttgaatatagctatctaatccatatgatagttggtgttaccttttattgttaacactggtttcttcatgtgccttgacgactaaaagaattttcaggactgacttttcctattttaatatggaatctttctcttctctttacccattgtatcactagctttttttaccctccccccaacacacacacacataaaaaaatgcacattccatgcctttctttgtatttttgtttttttttcccgtaagaggcctgcttaccctcattagcccccttcagtatccattctactcaatactgttaagattagtgctaatagctcaatatgaagaattcaatatattggtaattttcatccatgagacactgacttcatctaatggtgatagattttgtcattctagaaaataggaggaaattgtattagattaagggcagaagggaatcgtgatattcttattttacactttattaatgatagaacacacaagctcatttaaattgagttacttgtttttaaaatgagcatttcccttgggattttattcagctatataaaattccactagttggtggtttatacaagaaactgtcaagttccaaggttgctttggtaccacttattttcctcttagaatgtattttgtgtcatacttttctaccctcctctgtctttcataacatgattaattttaccttaggtaatcttacacatacatacacacccctcttagagcttctttttccttttcaaaaattttgtgcttccttctatgtgattccacttcttttgatgtagtagtaaacattatagcaaaccagtactctcaaaatctaatgaccttgaaggtgtccataacttactcccataaattctataaaaaccacccattaaccatgtaatcctcctgattaaatacacatttccttcatgtaccagtattcatgataaatttgatgtgcctttgttttactttagatattgcagtgatactgctttctgaaaagttttattacaaatatgggttaaataataatttatatttgctttgcagttttttgtcctcaaagcactttcatatgtaataatctttgagctcatttgagaacccagtgtttagcaacattactgtgggaaaatatgttgtctctacttccaaagaactggtttacaaatgaacttttaaaacataacctactagtgtttctattgtggctgttcattatgatagccccatcgagtatggattattatattattcccaaccatgctggtttagggagttttaattcagtttctgtgtcatgttgaccaaagttctgtctcaccttttccatgtacttcaccttaaagactacattttgttttcttaatctttgaggatctcagatgttggcttatcttaagagcatttgtaatgtccctaaaagtcttaagaatgtatcttaacttgatttgtggcttagttagtcatcagtagattttctttttttattattattattataatactttaagttttagggtacatgtgcacaatatgcaggttagttacatatgtatacatgtgccatgctggtgtgctgctagattttcaagtacagttgtccattggtgtctgtggaggattggttccatgacctcccgcatatactaaaatccacagatgctcaagtccctgatataaaatggcatagtatttgtatataatatatgcatctcctcctatgtgctttaaatcatctctaaaatacttataatacctaatacaatgtaaatgctatgtaaatagttgttaatagcattgtttagggaataatgacaagagaagaaagtctgtacatgttcagtacaggcactttttttcccaaacatttttgatccttggttagttgactccatggatgcagaactcatggatatggagggctgactatacatctcttatcttcgaagatttcaacagtcacttggatgaaagctagaaaaaatgtgattatactgagtgagggtttcattcatagaaccatgggcaatctatattgaacacaattccaaaatactttcataggtgtgtttcaatcaaattctttcatcaccagttcattttggcaaaagggcaggatatgtaagaaagactgaaactggatggtgtgaaatcaccaattacctcccttggcacaaaccataactgccattatttttgctgctcctctatggctgatgctttttggttgaactggctagtaagacaaaagaattgacttactttgagtaatgtaattaaaggccaacagatcatcatttgatggtaaggaaagctatttgattgctctgtttttatttcaacctattgtaccaaggtgaatgtgttccatttgaaattgggggacagcatattgcaatggaagcaggtgtccttgagtcagacagcttgatttgaattccagctctaccaattaataaatatgtgatcttgggcaagttgttaacctagaccttatttatcttgttcatcaaaagggggataataatacctacattttccatgatattataaatcaagtgtttggcaggtagtgagcatttagtaaatgctagttctcttgaacctttgctaataatttcattactactaaacataatacttctccattggttattatagatatttactaccacactttgaaatatgtaattgtttcatatgtagaagcagaaaaaacggaacatccatattgcaatttttctgggcagttcctgaaaaatgcaggaagaaatcacataatcaagaaactgaaacgactatattatcttccttctccctggtgtatttccattttaagcaaaagcaaaaccttaaaatcaagatattaagctctaacaatggaaatggctatgacccttttgctggcacagtggttaagaagaggggacttaggaatcaaatggatttggtatgagtcccaactctatcatgtaaaactttgtgaccttaaccaaattaatctaagactcagtttcttctcccatagaatgggtaatataattgtctctatgtcatagggttattgtgaggtgtaaattaaataatatatgtacagtgctcagtgcacatcctggtttattaaaggatagcttgaccatctccttaccctcatctatagcccagctttggagattggcagtgtatatcactgcagggcttcttagagcctctaatatgcaaaagaaaccctgtttgactttgttcaatgcattattttctgaatttatctgcagagtcctttttgtctttccaaatacttaacatccgaaatacgatttgggtagcactgattatcagacacttaacaatttctctcttctattctcttctcttctcttccttccttccttttttccttccttccttccttccttctttctttctgactttttttttgagacgcagtcttgctctgtcacccaggctggagtgcagtggtgcaatatgggctcacttcaacctctacatcccgggttcaagcgattctcctgcctcagcctcctgagtagctgggattataggagtgtgctaccatgtccagctaatttttggattttagtagaggcggggtttcaccatgttggccaggctggtctcaaactcctgacctcaagtaatccgcccaccatggcctcccaaagtggtgggattacaggcatgagcaaccatgcccggccctcatattttaactgtgtcaaagctttgtcaatgtcagagactaaccaataaagttaacctcagtatgataggaacagaatatattcaatgtgatgacaaatattctttttttgtactaatatggtagcttttatatcaggtttatgtggctttaaagtggttctacatgctaggtttattctctttactgactttcagaaacaatttatagtgaaaagataaggacataagtgagacagattcatgtttggttttataattcatgtgtggaccttaatgtagaagctagcttttgtaatatgtcatacaggaggaaatttaatatactcaggtactagaatgttcttttttatagattttttggtacctatatgataccaaaagtcatgcagaggcatcccaaattctccttttctctaatttgagtacataatggaataataactaattggactactggaactcttgcacccttggattttgtggccaggtcaaaatgaatacctaatctctcaacataatattcttcctaactttaatgacaaatgcaatttccaacccaatccccatattaaaaactatacctgaagagaatgcacataagaagaagcaccaatttcaataaaagtttgaatgcccctttatgaccagcattatgctgaatgttgtagtaggagaaggggagtgtgtaagcagcatgctcaaaacaatgatagtgttttttccttccagggacctcacatttttagcctctgttgttgttgttgttgttgttttgtttgtttgttttgcctaataatattttagtctggcacttaaatgtcaatttaggtagggctttcagatctacacaaaaaaattgcattgactagagtttggcaacatttaaggtacagagtacaggtacctttcatgcattgttttactagttccacctggtctgaaaggttcaggataaagtggtgaaggtcatgtcccagtttcattgtaagtctaggctatgacctatgcctgtacccatatgtttgctcctaaataaacaattgaataaacagtggaattctcctttacaagggctcacattataggaaaatacaaccaacaaataatttttactttttatttttagagacagggtcttgccctgtcatccaggctggagtgcagtggtgcaatcatagttcactgcagccttgaactcctgggctcaagcattcctcccgtctcagcttctcaaagtgctgggattacagacatgagcaaccacacctggctagaaccaaaaaataaaggacaaaaggaacaccgtaatttctaatgatcatttgtataaattttctctctctaaaacctcaaagtctcctgtttgctcctttttttaaactgcccgacaaataatctaattatttttaaccacttgtgtatatcttgttagtcatagttgtttcaccttttcttatcaaatagtcctatcagattctgaacagctttttgtatttcatagtttatgggattgaaaatgttgatggtatagagtttactgactagcattcctctagaaaacataaataaatagcaactgcaaatgttaaatctggcttctagaaaccttaccaccccaaaacagaaacaatgacaatagaaaacattggcataaaaattttaatataattacagaataccctatttatcaatataataacatatacactataatttctgcctggccttgcaatagcatatcttatttttttcctcagtatcagcagaaatttaaggttttatagagactcaacctgttctggatgcttcaatgcttctcttttatgccctctgaaattcctcataaccatccaagccatcagcctactagtgaaccaggatgactgtgttttaacttgagctttgggctaaaatggcatgtgtaccagcatctgaatggaagtttgaaactgaggtataccaaagccccatgttggaaggggattatttgtcaccattaatgcagctctggaagtatggtaatttcaacagaatcagcactgtggcaataagcattccactaaacccaaggtctataggatagaattagtatttaattttttatctgtttttgtgataggtctttgctgtaggcagacatgtcttgtctagatatgccatctttatatagagagaggacgcacaccttagactgttaaccacagttatctttaaaagatgaatttgttttcagattaaatcaaaattcaaattatcactaaatatattatacttaaaattgcattcatcagaaatttatttgacatgtgttatgtggtaggcactctgctagttgctatagatacagtgatgaaagacctagtccctaacatgaagttcatagtttatgaaggacaaataaaccagataactttaagggaagtctgtagtagatagtgtaaaagcaggacatctaacgcagtcaggtcagaatcttataaaaggaggttcaattttattccgtaggtgaaatggagctctttaagggtcttttgaaaaagaataatgtactttttccttttagaaatgtttcattagtagccatgaggagaatgaattagaagtctaagactggtggcttggagaccagctaaggggttgttaatggtgatttaagtgaaagataatggtgacaatggagatataatataacaggaaaggaatgggactatttctgatatagcaaatttttaaaattctatgtgaagtacattacatactgaggaaaacaaaataattctattggcagagtttttctctgcatggtaaaggattggcattgatctggacagagggaatagactgctatcttgaaactctttgaccttaatgtttgaaaagctataaacaaactccaatccagtatttctcaatgtattttccacagaccacatgcagcaaaataacccacagaacttgttaaacctgcagattcccaagccccaccccagacatactgaatgaaggaatggggcccagagagctcagtgttttaacaagttttccaggtgattcttctgcctattaacgtttgaggatcatcgatccagcacaatggttctgaaattatgatctggggactactagtctctgagattctttcaggggtccatgagatcaaaactatttttataataatacttacacattgtttgccttattcactgtgttaatatttacacagatgatataaaagcaatggtgggtaaaactgctgtcaccttaacacaaattaagactgtggcaccaaactgtattaattgtattctctacctccatgcacttcaggaaacagaaagtgctagtttcacttaagaatgcccttgatgaatcaaaaagaataattaattttattaaatctctaccctgcacaactatgtatatagtgtgtgtacatattgatatacatatatgtatatgcacatatatatacatgtgtatatatacacatatatatgtatttctgtgtcatgaaatgggaagtgggcataaagcacttcaacagcataccaaagtatgatggttatctgaaggaaaagcacttgtatgactgagtcatgagatgaaatagccacttcaaacaactctttaacttgaagatccactgacaaacaacagttattcagacttcagtcctatttggaagatattttctctaaagttaactgggtgagcctgtcatttcaggaaaacaaatgacaatatttgttgccaatgataagatttaagtttttaagcaaaaatcagaattttgaaaaacttttatctactatgtaagcataacttcccaatacttagacttttctaatgggatcaatggtgatattaacaactgacttttttgttattgttttatcttgaaatgagtcaccatataactgcataactcagtgaatctgcataactgagtctgcctaactgggatctatgtaacacagtgagccaatattttccaaatgaccaatgcatgatattgcaaaaccccatataaataaaagatccattcaatgtgtgagatagaccaatggattttcatttaaccaagtagaaagaattcattgatattgtttcaaattctaccttgcacatagtatttaagaaactaccatttgttgagttttggtgtagtatcaaaggataatatctacagttatctgaaaatgctattgagacatccatcagttttccaattgcatatctgaatatagtttcccttcttgtgcttatttgacccagccatcccattactgggtatatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatggaatactatgcagccataaaacatgatgagttcatgtcctttgtagggacatggatgaagctggaaaccatcattctcagcaaactatcacaaggacaaaaaaccaaacatcgcatgttctcactcataggtgggaattgaacaatgagaacacttggacacaggaagggggacatcacacactggggcctgttgggtgggggaaggggggagggatagcattaggagatatacctaatgtaaatgacgagttagtgggtgcagcacaccaacatggcacatgtatacatatgtaacaaacctgcacgttgtgcacatgtaccctagaacttaaagtataataaaaaaaagatttccttcttgtgctttaaccaaaacaacatatcactatagatctcatgcagaaacagctatgaagattcagccatcttttattacatctgatattacaggttggcacaaatgaaaaacaatgccactcttccttgttacattttgttgggaaatatagttatttttaatacaattaggttaattactttaacatgaacttatgattattttaaatgaatatatatatatattgagatggagtctcactctgtcacccaggctggagtgcagccactgcaacctctgcctcccaggttcaagtgattctcctgtctcagcctcccaagtagctaggacaacaggcacgtgccaccatgcccagctaatttcttgtatttttagtagagacggggtttcaccgtgttaaccaggatggtctctatctcctgacctcgtgatccacccacctcggcctcccaaagtgctaggattacaggcgtgagccaccaagcccagccgaataaataaataaatattttttaaattcctccgtgttaatttctaatgtggtaaatatcaatagaaataatctactaaacaaaagttatttggagttctcaataactttaaagagtgtaaaggggtcctgagaccaaaaaattggagaattgctgatctagcccttaggttctatgtgatacgttaaacataaccactagtggaagtcagaatagttcaagcaggatcaggtgttttatataatatttctaagaattgtttacctatgagtgtgacatgtcatccacaaattattcatctgtgaccttttgaacagtgtcatttctaattccctaatgtctttaatatactgtttcctgaggactccatctaccagagaatttttgtgctatatcaagtatgtgacccatttcctaatgtattattgccttcaaaaactacagcaaaattatctagaggtgcagggcagaaaggcaacttgctgtactctacattagctatgtgcctttgttgattttaaaaaatggtaataaaggtgatttgggtcacattccctgcgatacaccctccctccaaaagatgatctgtgataatccagaatattaagaaccattgctttaatcaacagctaatctgtactaatgcctattctgcaacagactagattttaacaaaaggctagataggaggtgtctaagttcatttgtgtggctataaagaaatacgtgaggccaggtaaagaaagaaaagaaatttgggggccaaataaaccatattcaaaccatagcaggaggataatcactttatacaagggtatgcactactgattttgtctggttcctagtgaaacaccgatatataatccagatacttttaagaaatcacttgtgtatttgtttctttgatgaggtacactgatagtaaatacatatatatattgcaagaactgctatgaaggaatcaagaaacgcaaatttggttcatctgtgactgagaccaatcaaaaggaaacaaaaaaagttgccactaaacaggactttgaagaaagagaggctagtttggcttaaaagtttagattttttttttctgttttgaaaaatcactacttaggattcttggtctgatgaagtttggtatcaccctttgaaataattgtccttccccagttgtctgaagagtttgggatataggaggaaaagccaagcctttgaaaagctactgtggacaaaatgaatatttagaagtccacttgaattggttccagattttataatggaggaaatgtttgttacgttggaactctttacacctagatcttgttcattctggatatcagcaaattcagaagtgctgaccctattgtattatcaggatgtttggacagtattgaatgtagttttataagaagaactactttgcccttcagttgcccttattattctcattgtgaataacctctattttctaatatgttaatattagaaaatgttagttgaaagagatactagaacagcttccttcaccttgtattttgtatttcaatgccaaggtgctgtaagtatgttatcactatgctagaatatttaatatattgtaaaaatattttagaatttattttacattttaacacgttaatattaaatgtggggaaaaaaaggtccagaggcacagaacttattacatagttggtgcttaataaatatttgttcagtgaatttgtgtttacaaataagattagacaaaaaccataatatcattagctttttgaaggaaatgaaagaagttggccaccagcaggatcctacagtggatttctatacgttgtgaataataatttttccccaataatgcccaagatagacattctttgtattaacattttaattgaatgatattcaacagcaataggtaagagttgctacagcttatttcattacctttgttcccaagataggtaaatgccaaaaccttttttcactgttaaacatttgaaattgaatctctatttcttcttctacttaattgctacctatttctaatctgtcccttctcctaagatactttagatagcagaatgaaaatgcatgaaactctagccatgtctcgttattattaatgactattaagcttgagaatttctcctagaattggaatctgtaactactatatacatttgttgtatcaagataagtgtgctttaagttataatggactcaggaatctatatttaagtaataagggtccagattaactactcttgatgactaaattgtcaaatacaaagtggtataaatacactggaattataaaaatgacagctttttctgctattcaactctgaaaatgtaattattagatataagatttatgagtaaatccttgattgatctctacaaatcagataggcatttaacaaataaattttatagtttgtgttaatgatttttgcctaacagtccatgaaagaaaagggtgtgaatgatctcacaattacctttgaaacaaagtacagatttagaaagattgaaatcttgaaaagacagctgttctgtgattggggtttagactatctgttgtccaattatcagtttttctcatcagatacttttagcaaattaaggacttttttcttttctttgggatgagcgctatgtttgtttagaaaaataggatgaaattaataaatgatttggagagattctataaggatagaagaaatgtagtgatcttcctttgccagacttgattatagaaccttagaaacctagcacagcctgacctccttcatgcagaagatgcaacccaatcttctgatcccatttgagttactttggctacattatactgtttctctctcccaaactgtagactgtttcaggttaccagtttttaaataaagaacactatcaagttgagaaatatcaaaaccaatacaaaacaatttgttattttacaaatcattggacattgaaggaaaataaattttcctttttattctacttgtatcagtttgaaatgtgatttgggaattattattttctactactggccataatagtagatatatacaattcatttcactggcttggatcatattcttcctagtgatgaatatctaacatacggaagatatttgcaagtgtgtagagggcagggactgcactttattactctctatagccccacaggctagcatagtgccaggcatgtgtgtagatattcagtaaaacacttaatgaatgaaattaagagtactgtctgtcttctgtataaccggtccacaagaaagttaatggaaccatagctttgatcttattagtgctacgttttaatcaactgagctatgtaacccatttttggcttcttaagcctggtactttccaaaggaaatagttgttacagtgaaattttggacagaaaagtggaaaactctagaacttgtacaggaatctatgtattagcatatcaacattggttttaaagatcagctctcaacattttgagaaaaaaacataattttacagactgtggtaaaactgattccatttgtataatatggtgttgttttattatgagagaataacaaaatttgctgataagcaaaactcagcaacataaacaacatagattcagtgatatggtttctgttcattggacttgtgttcttgagggcctgaactcttgttttcaaagatcaatttttatgagcacttaaagaaatgctttgatattgcagcactatttacaatagccaagatatggaatcagtcatcaaaagatgaatggataaagaaaatgtggtatgtgtacacaatggaatactatacagccttaaaaaatgaaatcctgtcatttgtagcaacatggatgaaactagaggatattgtgtcaaatgaaataagcaaggcacagaaagacaaatgtcacatgttctcactcatgtgggagctaaaaaagtgaatctcatgaagatagagagtagattggtggttatcggaggccaggaaggggagggatgaagagaagttgtataaggggcacaaaaatacagttagacagaagaaataagctctagtatacaataatacagtagtgaataacttacagctaaaagaattgtaatcttctcaacacaaagaaaaataaatatttgagatgacaaatatcctgattaccctgatttaatcattacatattatatacagttatcaaaatatcacatttatcacaaaaatatgtacaactatgatacatcaatttttaaaaaaggaagtgaatttttttctcaggcaaaagatgatattttaatctatctttgaaaaaaatgccatccttcacattttccaaaatcttgtttaatatgagaaaagcttctggtcctgtgtatgttttaaatattcccttcactttctattccctaacacactgaaaatcgggagattaaatatctatgataaattctgaacatgaccacatctatattgcttataataaatggctaactttacatctgaatgttttgtggtcctttagaaagataacttacaaagtcactaattttaatttgaaaggtttggaattcgctggcgcattataagagaccctttccaatattttaaggatagaaaaaagctaaagggaaaaagaggctcaacaaggcctgctgtagcaacagaaacacacaacaccacacaaaaaagcacacacactaaaagggtttctttcttgttccacaaaggaagtttgattgttcttccttggagtttcagggtacatattttgtggttttcaacagagtaacaagtagaaacacttaatttgggaatgtgcatgggttttcactagtttttaaacataagtatgaggccagccatggtagttcacacctgtaatcccagctctttaggaggccatggtgggaggatagcttgaagccagaagtttgaagccagcctgggcaacatagtgagacccctgtttctacaaaataaaaaaattacccgggtgtggtggtgtacacctgtattcccaactactcaggaagctgaggtgggagtatcacttgatcctgggaggtggagactgcagtgagccgtgatcgtgccactgcactccagcctgggcaacagagcgagaccttgtttcaaaaaaaaaaaaaaggaaattaggtatgcacaagtgaaaagaatagcaaagtaaaatagttacagattttgaattgtatttagttgtagttaagcttttttaagactaggtaagttcagtagtgagaagtggggaaagagtagaataagcagttcaatctgtaactgagtgaataatcaattgtacttaagttttgaatctgtaatgtccagtggtgagcttgttcagtcagttgtacacatttcatcccaattccacattcacgtggctatggtgggagtatttacaccatggaaactggcacacactacacattagggctttctccaaccctgagagcagatttctaaacatttactactgcacccatgaatgtgcctatttaattttcacttttacagttaaataacagctttaggtttcattgaagataactagtgtagaatggtgaagagcagagataccagagccaaactatctgggtacaaataccatttcttcacttactagcttgtgttaccctaggcagttagtcaaacttatcattaatggggatagtagcaatgcctaccttatagggttgacgtgaggattaaatatgttaagggtctgttttatagataaatcttatctggcaacctcagaaatccagtgcatagccaggattcaggaaataaacaaaaacatcactgagccaccaatgtaaatgtcagacagagggtacttgccctgaagcccccaagctttctctagaagctaattttactctttctgtagaaccaagcttgattgtcttttctgagccaaagggatattagaagcatgacatcacacaaaaaaaaagagagagaggagagatgctgctagaagcaacaactgaagtgagaaccttcctccctcaaagaaaattatccaatgtgagaactcaaaaatgagtcagactgcttgattgctaagatctgttccatttccaaaaatttatgacaagagtgaaaaattgcaacagtttagaaacaaataatcttactactatgttaaataatggcatacaaagataatccactgtcaataataaatcataatcagtatctattagttaagaaaataggacagggagcaagatggccaaataaaacccaccagtgatcatcccctccataggaacaccaaattgaacaactccccacacaagaaagcatctttgtaagaatcaaaaatcaggtgagcagtaacagtgccttgttttaacatcatattaaggaaagaggcactggataggataggaaagatagtcattaatttcttacaccacccctccctcatcccctggtggtgcagcttggcacagagagaaaatctgtgtgtttaggggaaggagagcacagtgattgtgggactttgcatcagaactcagtgctaccctgtcacagaggaaaacaacatggggcataattgtgcccatacccatggagggagcatttagaccagccctagccggaggagaattgtccatccctctggcaagcctcaccactgtgagctaaagtgccctggggtcctaaataaatacgaaaggcagtctagaccaaaaggactgcaattttgaggcaagtcctggtggttctgtgctgggctcagaaccagaggacttgcggtgcatatggccaagaaagcgtttgcatcacccctcccccaactccaggcagtacagctcacagctctgggaggagaggaaagattaaagtggactttgtcttaacatttggataccagctcagccacagtaaaataaagcaccaagcagagtcctgaagcccacactccaggccctagatcctggatgacatttctagacacaccctgggccagaagggaacccaccaatttgaaggaaaggacccagttctggaaggattcatcacctgctgactacagagcccttggaccttgaataaacattattagtagctaagcagtactcaccatgagccttgggcaaggcttcaggtgtgacccagcacattcccagctgtagtggccaaggggagagactccttttctctgcttgaggaaaggagagtgaaaagtaaaaaggacttcaccttgcaatttgggtaccagttcagccacagtaaaataaagcaccgaatagattcctaaagttcctgactccagaccctacctcccagacagcatttctagacccaccctgggccagaagggacaccaccaccctgaagggaaagacacaagcctggctggattcaccacctgctgattaaagaacccttgggccttgaacaaacagcaatactcaccataagccttgggcaaaacccagaactatgctggtttctggtctaatgcagctcagtcccagcagtggtggccacaggggtgcttgcatcacctctcctccaactccaggcagcacagcatggtgagagagattccttttgtttgagagaaagtaagggaagagaacaacacattctgcctggtaatccagggaattctcctagatattacccaagaccaccaaaacagtacctctactagtctgcaagagccacagcgttactgggcttggggtgccccctaatgcatatatggctaaagtgaccaaaaacttagatcacaacactcaattccctttgaatgcttgaaaagcattctcaagaaggacaggtataaacaagcccagactgtgaatattataatacctatctcttcagtgcacaagcaccaagaaatatccacaagcatccagatcatccaggataacattacctcagaaaatgaaataaagaaggaaccagtgaccaatcccagagtaacagaggtatgtgaccttttagacagaattcaaaatagctgttctgaggaagctcagtgaaattccagataacacagagaaggaattcagaattctatcagataaattgaacaaagagattgaaatactttaaaaaaatcaagcataaattctggagctgaaaaatgcaattgatataccgaagaatgcatcagagtctttcaacagcagaactgatcaagcagaagaaaaaagtattgagcttgaagaggggctgtttgaaaatacacagtcagaggagacaaaaaaagaataaaatagaatgaagcacacctacaacatctagaaaatagcttcaaaagtacagatctaagagttatttgccttaaagaggtggtagagagatcgagatagaaagcatattcaaaggaataatattataacactgtagttgtggtgtgtgaactactcataccttgagtaggaagactaagagatgaacctatcaaaaataataactgcaagttttgaagacatagacagtataataagatatgaatagaaacaataaaaatgtaaaaagccatggaggggataaagttaaagtatagagtttcaattagttttctctttgtttgtttgtttgttttagcaatcactgttgtcatcagtttgaaataatgcaatataagatgttatctataacattcatggtagcctcaaatcaatgaacctagaacagatacaccaaaaaataaaaagcaagaaattaaaacataccaccagagacaatcaccttcacaaaaagaagacagagagggaacaaaggaagagatcacaaaacaaccagaaaacaaataataaaatgggaagggagtaagaacttatcaataataacattgaatttaaatagaataaacttttcaatcaaaaaacatagaatggctgaatgcattaaaaagccccaactagctgccatccttaagaaacacacttcacctataaggacacacatagactgaatataaaaggatggaaaaagatattccatgcaaatagaaaacaacaaagaggagtagctatacttatatcacacaatatagatttcaagacaaaaactataaaaagagataaagaaggtcattatataatgataagaggatcaattcagcaagaagatagaacaagtgtatatatgcacccaaagctggagcacccaggtgtataaagcaaatattatacaaactagaaggtgggatatagaccctgatataataatagctggagacttcaacaccctactttcagcattggacagatcatccggacagaaaatccacaaagaaatatcacacttaatgtgcagtagagaacaaatggacctaatagatatttacagaacatttcatccaacagctacagaagacacaattgtctctttggcacgtggatcattctcaaggataaaccatatgttaagtcataaaacaaataatttttttcttttttcttttttttcagacaagttctcactctgttgcccaggctggagtgtagtggcatgatttcggctcactgcagcctaaacctaccagacttgaagggaaccttccacctcagccttccaagtagctgggactacagtgggactacaggcacatgccaccacacctggcaatgttttctttctctttttttttttttttttttttttttttttttgtagcgacagggtctcaccatattgcccaagctgttctcaaactccttggctcaaatgatctgccaccttggcctcccaaagtgctgggattacaggtgtgagccagcatgcccagccaaaattttttttaaattgaaatatcaagcatcttctctaaccacaatggaataaaactaagtcaataataacagaaactttggaaactatacaaatacatggagataaacagtatgctcctgaatgaccagtgggttaatgtagaaattaagaagaaaattttaaaatttcttgaaacaagtggaaatgaaaacaaaatgtaacaaaacctatgagatatagcaaaaacagtactaataggaaagtttataaaaatgagtgcctacatcaaaaatgtagaaaaccttcaaattaacaacctaataatagaactagaaaagcaagagcaaaccaaatggaaaattagtagaagaaaagaattaataaagatcagagcagaaataaattgaaataaaaaaacacaaaacatcaatgacatgaaaagttgttttctttaaaaaataaataaaatcaacaaacctttagccagaataaagaaaaagagaaaacccaaatagataaagatgaaaaatgggacatacaaccaataccacagaaattcaaagaatccctggagactactgggagcagctatacgccaataaattggaaaacgttgaagaaatggataaattcctagacacacagaaccttccatgattggatcaggaagaaaaccaaaacctgaatagaccaataacaagtaatgagaagaaagccatgacaaatagtcccccagtaaagaaaaacctggaacccaatgacttcactgctgatttttgccaaacgtttaaagaagaactaatgccaaccctactgaaactattctgaaaaaacggagcaggaagaaatacttccagactcattctatgaggccagtattaccctgataccaaaaccagacaaagacatatcgaaaaaaaaaaggaaactactacaggcaagtctctctgatgaacatcaatgcaaaacctcaaccaaatattaacaaaccaaattcagcaacacattaatagggtaattgatcatgatcaagtgggatttatcctagggatgcaaggatagttatacataaatcaatcaatgtcctacatcctatcaacacaatgaaggacagaaagcatataattccaattgatgctgaaaatcatttgataaagttcaacatcctttcacgattaaaaaccctaaaaaagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttaatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaagaaataaaagaggatacaaacaaatggaagaacattccatactcatgggtaggaagaatcaatatcttgaaaatggccatactgcccaaggtaatttacagattcaatgccatccccatcaagctaccaatgcctttcttcacagaattggaaaaaactactttaaagttcatatggaatcaaaaaagagcccgcatcaccaagtcaatcctaaaccaaaagaacaaagcgggaggcatcacactacctgacttcaaactatactacaaggctacagtaaccaaaacagcatggtactggtaccaaaacagagatatagatcaatggaacagaacagagccctcagaaataatgctgcatacctacaactatctgatctttgacaaacctgacaaaaacaagcaatggggaaaggattccctatttaataaatggtgctgggaaaactggctagccatatgtagaaagctgaaaccggatcccttccttacaccttatacaaaaatcaattcaagatggattaaagatttaaacgttagacctaaaaccataaaaaccctagaagaaaacctaggcattaccattcaggacataggcatgggaaaggacttcatgtccaaaacaccaaaagcaatggcaacaaaagaaaaaattgacaaatgggatctaattaaaataaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaccccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctagggactgtggtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaataaatttaaaaaaaaccctaaaaaatctgtgtatgcaaggaacatacctcattgcaataaaagctatatgtgacagatccacagctcagtatcatattgaatagggaaaaactgaaagcctttcctttaatacctggaacaggacagatatatccacttttaccactgttatgcaacgtagtactggaggtcctagctagagacatcagacaagagaaagaagggcaacaaaattggaaaggaaaaagtcaaattatccttgtttgcagataatatgatcttatagtttgaaaaacctaaaggccccacaacaaactattagaactgataaattcagtaaagctgcagaatgcaaaatcaacatatataaatcagtagtatttctagatgccaatggcacacaatctgaaaaagaaatcaagtaagtattcccatttacaataacaacaaataaaataaagtactaggaggaaacctaaccaaagaagagagctctacaatgaaaactgtaaaacaatgatataagaaattgaagatggcacaaaaagatggaaagatattccatgttcatggattggaagtttcaattttattaaaaggttcatactacccaatgcaatctacagatttaatgcaatccctattaagatataataccaatgacatcattcacataaatagaaaaaataattatagaatttatatgaaaccacagaagacccagaatagccaaagccatcctgagcaaaaagaacaaaactagaggaaacatattacctgactttaaattatactacacagttatagtaaccaaagaagcatggtactggcataaatacagacatatagaccaaagaaaaataatagagaattcagaaataaatctatacattcacagtgagcttattttcaacaaagtgccaagaacatacattggggaaaagataggctctccgattaatgctgctggcaaaactgcatatccatgtgcagaagaatgaaactagacccgtatctcctgccatatacaaaaatcaaatcaaaatggaatgaagacttaaatctaagacctcaaaatatgaaactactaaaagaaaacactggggaaactctccaggacattggactgagcacagattacctgagcaataccccaccacaagtacaggtaaccaaagcaaacatgaagaaaggagatcacatcaagctaaaaagcttctaccagcaaagaaaacaatcagcaagtagaagagactacccatagaatgggagaaaatatttgcaaactattcatctgacaagggattaataaccagaatacttaaggagctgaaatcactaaataggaaaatatctaataatccgattaaaaatggacaaaagatctgaatagacatttctcaaaagaagacatacaaaaggcaaacaggtatatgaaaagatgctcaacataattgatcatcagaaatgcaaataaaaactacaatgagatattatctcatcccagttaaaatggcttttattcaaaagtcaggcaataatgaatgctggcgaggatgtagaggaaagggaacccttgtacactgttggttggaatgtaaattactacagccactatgtagaacaatatggaggttcctcagaaaactaaaaatagaattaccgtataatccagcaatcccactgctaggtatatacccaaaagaaaggaaatcaggatatcaaagagatgtctacacccccgtgtttattgcagcactattctacaataaccatgatttggaagcaacctaagtgtccatcaagagacaaatggataaagaaaatgtggtacttacacacaatggagtactattcagccataaagaaaaatgagttcctgtcatttgcaacaacacatatggaactggagaattattatgttaagtgaaataagccaggcacagaaagacaaactttgcatgttttccactcatttatgagagctaaaattttaaacagttggagatagatatcagaaggatggttaccagaggctgggaagggtagaggtgggtagaaagaaattggggattattactgggcacaaaaatatagttagatagaatgagtaagacctagcattttatagcacaaaagggtgactgtagtcaacaataacttaatgtacattttaaaataactaaaagcataactggaatgtttgtaacacaaagaaaataaaaatgcttgaagtgatggataccccatttaccctgatgtgattattacagattgtatgtctgtatcaaaatatctcatgtaacctagaaatatatacacctgacatgcacccataaaaactaaaaattttataaaaagaataaaaaatttaggaaaatatagattactttttcgagtgttcattcaaaattgttaaaactaagtatttgtgtaaaaccttttgttacctataaattttacttttatggaacatctaattcctaaaaatagcagataaaggcattactgtcattaagagactgttaactcaaacaattaaatagcaaaacaacaaataatctgattttacaatgggcaaaagacctgaatagacagttctcaaaagaagcatacaaatagccaacagttacatgaaaaaatattcaacgtcaccaatcatcaggaaaatgcaaatcaaaactgcaatgtgatatcacttcactccagttaggatggctattataaaagagacaaaaaacaaacaaatactggcaaggatgtggagaaaagggaactcttatatacttactgttggtgggaatgtaaattagtccagccatattggaaaacagtatggagagtttttaaaaatgttagaaatacaattaccatataatctggcaattcaattactgggtatctatccaaaggaatggaagtcagtttgtccaagagatatctgccctcccatgtttattttagcactattcacaacagcaaagatatggaatcaagctaagtatccatcaatggatgaatggatatagaaaaagtcacacgtgtatacaatggaatactattcagcatttaaaaagcagcaaatcgtgtcatttgcagcagtgtggatgaacctggaggaaattaagtgccaaaagcaattgcaacaaaagcaaaaacaaaaacaaaagttggcaaatgcaacctaattaaattaaaaagcttttgcatagcaaaagaaactatcaacagagtaaacagacaacctacagaatgggagaaaatatttgcaaactatgcatccaacaaaggtctgatatccgaaatctttaaggaacttaaattaacaagcaaaaatccaacaaccccattaaaaactggacaaagaacatgaatagacacttttcaaaagaagacatacatgcagccaacaaatgaaacatatgaaaaattactgaacatcactaatcagattactagagaaataccaatccaaatcacaatgcaataccatctcccaccagtcagtatggctattattaaaaagtcaaaaaataacagatgttaacaaggttttagagaaaagggagcgcttatacactgctcgtgggaatgtaaattagttcagccattgtggaaagcagtttgctgatttctcaaaaaactcaaagcagaattgcaatttgacacagcaatcccattattgggtatatacccaaaggaatataaatcattctaccataaagacacatgcacatgtatgttcatcacagcactatttacaatagcaaagtcatggaatccacctaaatgcccatcaatggtggactgaataaagaaaatgtggtgcaaatacaccatggaatattatacagccataaaaaaagaatgagatcatgtatgatctcatgagtactcagatacagccacataggactattgtcattcacttttcttaactgttcattctgatctttctgcctaaaatacccatatttgctctgacactccctgtcctctgcttatctatgtattacttaagtcccagctcaaatgatgcttctatacaggttccccaagctccaagtgagagaataaatgtttcctctttggtcccctgtcacttggtttctaacctctatctagtatttcattttactttgcatctcaattggcatgcctctctaaattaagaacttttttattttgggcagacactgtctttttttttttaaagacccttaatttaaaaatttataattgacacataattgtatatatttatggggtacaatgtgattgtaaatgtaagtatactatgtagtataatgatcaaatgggggcaattaccatatccatcacatggaacatttttcatttgtttgtggtaacatcattcaaaatcttttcttctagttatcttaaaacatacactacattgctgtttgctatagtcaccctactgtgtaaaaaaacaccaaacttattcttcctgcctaactgtaagtttgtacacattggccaacctctctccatccttccctaccctgtaccctccccagcccctggtaatcactattccattctccacttttgatttttttttttttttgagatggagttttgctcttgttgcccaggctggagtgcagtggcaccatctcagctcaccacaacctctgcctcgggttcaagcgattctcctgcctcagcctcccgagtagctgggattacaggcatgcactgccacgcctggctaattttgtacttttagtagagacagggtttttccatgttggtcaagctggtcttgaactcctgacctcaggtgatccgccccccatcggcctcccaaagtgctgggattacaggtgtgagccaccaagcccagtcttgaaattttttaaacttttattttaggctcaaggacacatgtgttggtttgttgtataggcaaattgtgtgtcacaggggtttgtgtacagattatgttctttgcagcaacatggatggagctggaggccattatcctgagtgaacaaacacagcaacagaaaaccaaataccacatgttcttatgtataagtgggagctaaactttgagtacacatggacacaaagaagggaacaacggacaccggggcctacttgagggtggaggaagggaggaggatgaatacctattgggcactatgcttattacatggatgatgaaataatctgtacacaaacccctgtgacacacagtttgcctatataacataccaacacatgtgcaagatcagttgagatcagatcatatatggctttacatgttaggctaaggagtcagattgtaatgagtaattaggagccactaaagactcctgggcagaaaaagaggcatgattcaaccatgttatggcaaaagtcaagcagaaaggtcaactctaatgaaactttaagggagggactggatataggatgaccagctaggaggttactgtaatagtttcagtaccctatttcaaagaaattatgagggtctatattaagacagcagaaatagaaagatctgataatggagacaccaagaaagtaaatagcatctccatgactgactaggtgagcagtgaggattcaaacatgattctgaggttactaaactaggtgaccagaggggttgttacactgttaactgcaattgagaacagtggagggggagcagtttacagatattttcaagtgcatgggaagtatcaaaatgcttagaaataggtcttttacatgattaggaagccaattcagggttttttgttttcgttgagacggagtctcgctctgtcgtccaggctggagtgcactggcacgatcttggctcactgcaagctccgcctcccgggttcacgccattctcctgcctcagcctcccgagtagctgggactacaggcgcccgccaccacgcccggctaattttttgtatttttagtagagatggggtttcaccgtgttagccaggatggtctcgatctcctgatctcatgatccgcccgcctcctcggcctcccaaagtgctggaattaaaggcgtgggccaccacgcccggccaattcaggttttttaatagttggactgtatatagcacgtatgaatatagattgtgaggactgaagcacagcattgttgctaagatgtatacaatgtacatttcttgcctatccttgttttttggtttggtttggtttggtttggtttggtttggtttttgtttttgttttttgagatggagtctcgctctgtcgcccaggctggagtgcagtggcacgatatcagctcactgcaagctccacctcccgggttcacgccattctcctgcctcagcctccccagtagctggggctacaggtgcccgccaccacgcccgactaatttttttttgtatttttagaagagacggggtttcaccatgttagccaggatagtcttgatctcctgacctcgtgatccacccacctcagcctcccaaagtgctggaattacaggcgtgagccaccacgcccggccttgttttgtttttcaaccttcatctgaccacaatggcccatgtgttcctgagtatccacccctgccacctaccccatatgttctaaaagaacaaaacatttctattagttaaaaacttatggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtaaggagcgaaactccgtctcaaaaaaaacaaaacaacaacaacaacaacaaaaaccaacttattagcagtacacatctgtgattcaaaagaaatatttaaaaatatattccaaagcctaacttttagaattctctatgctttcaaagattatacagtttataatatcggaaatgaatgctacattatataattaatcacaactttattactatacattttcctgagagatggctcttagagaaaagacaaataatgtctgtgattttagtgccatagctaaaaatttaaagcccctaaataaatagaaaaaaagggccactgtttggtaaaattatctccagatccataagggatatttgggtcatatactgatattggaagaaaatataacagagggtctctacatttcagactccttcactccccattgtttttgagattttccttttgtaaatgagaacaaggtgagtcattaatctctatcaaactgaatgatcacacatgactcagtagagttttaaaaagggcttaactaaatggctatcatgtaaaaatagtgtcttttggaatgttaaggatctataataaaatgctttgaataaaatgtttaaattaataacttcaaataaagagagaatcttagcatactatgagatatttctttttggccccatcttttgaaaactttggctactgaggaccataaatttaagggattgcttgattaacaattttactgtgtacattgccatttaaggtttatacccttaatttgaaaattaaaactgtgaatactattttaatattttactgagaaatggcttttagagaaaagacaaataatgtctgtgattttagtgccatagctaaaaacttaatgtccccaaataaatagaaaaaaggggcactctctggcaaaattacctccagacccataagggatatttggataatacactcatattggaagaagatacaacagagggtgtctacatttcagacattcagtatttttgtatttaaattctagtctaaaagtcctttcattttatttttattttatattttgttggtttttttattattatactttaagttctaggctacatgtgcacaacatgcaggtttgtcacatatgtttacatgtgccatgttggtgtgctgcacccattaactaactcgtcatttatattaggtttatctcctaatgctatcccccccagccccccaccccacgacaggctccagtgtgtgatgttccccaccctgtgtccaagtgttctcattgttcaattcccacctatgagtgagaacatgcggtgtttggttttctgtcttggtgatagtttgctcagaatgatggtttctagcttcatccatgtccctacaaagacatgaactcatctttttatggctgcatagtattccatggtatatatgtgccaaattttcttaatccagtctattattgaaggacatttgggttggttccaagtctatgctattgtgaatagtgccgaaataaacatacgtgtgcatgtgtctttatagcagcatgatttataatcctttgggtatatgcccagtaatgggatggctagatcaaatggtatttctagttctagatccttgaggaatcgccacactgtcttccacaatggttgaactagtttacactcccaccaacagttaaaggagttcctatttctccacatcctctccagtacctgttgtttcctgactttttaatgatcaccattctaagtcgtgtgagatggtatctcattgtagtttggtttgcatttctctgatggtcagtgatgatgaacattttttcatgtgtcttttggctgcataaatgtcttcttttgagaagtgtctgttcatatcctttgcccactttttgatagggttgtttgattttttcttgtaaatttgttcaagttcattgtagattctggatattagccctttgtcagatgggtaaattgtaaaacttttctcccattctgtaggttgcctgttcactctgacggtagtttcttttgctgtgcagaagctctttagtttaattagatcccatttgtcaattttggcttttgttgccattgcttttggtgttttggtcatgaagtccttgcccatgcctatggcctgaatggtatttgcctaggttttcttctaggatttttatggttttaggtctaatatttaggtctttaatccatcttgagttaatttttgtataaggtgtaaggaagggatccagtttcagctttctatatatggctagccagttttcccagcaccatttattaaatagggaatcctttccccatttcttgtttttgtcaggtttgtcaaagatcggatggttgtagatgtgtggtattatttctgagggctctattctgttccattgatctatatctctgttttggtaccagtaccatgctattttggttactgtagccttgtagtatagtttgaagtcaggtagggtgatgcctccagctttgttcttttgacttaggattgtcttggcgatgcgggctctttgggttccatatgaactttaaagtagttttttccaattctatgaagaaagtcattggcagcttgatggggatggcattgaatctataaattaccttgggcagaatggccattttcacaatattgattcttcctatccatgaacacggaatgttcttccatttgtttgtgtcctcttttatttcgttgagcagtggtttgtagttctccttgaggaggtccttcacatcctttttaagttagattcctaggtattttattctctttgaagcaattgtgaatgggagttcgctcgtgatttggctttctgtttgtctgttattggtgtataagaatgcttgtgatttttgcacattgattttgtatcctgagactttgctgaagttgcttatcagcctgaggagaatttgggctgagacgatggggttttctagatatataatcatgtcatctgcaaatagggacaatttgacttcctcttttcctaattgaatactctttatttccttctcttgcctgattgccctggctagaacttccaacactatgttgaataggagtggtgagaaagggcatccctgtcttgtgccagttttcaaagggaatgcttccagtttttgcccattctgtataatattggctgtgggtttgtcatagatagctcttattattttgagatacgtcccatcaatacctagtttattgagagtttttagcatgaagcgctgttgaattttgtcaaaggccttttctgcatctactgagataatcatgtggtttttatctttggttctgtttatatgatggattacatttattgatttgcttatgttgaaccagccttgcatcccagggatgaagccaacttgattgtggtggataagctttttgatgtgctgctggattcggcttgccagtatcttattgaggatttttgcatcattgttcatcagggattttcgtctaaaattttctttttttattttctctctgccaggctttggtatcaggatgatgctggcctcataaaatgagttaggaaggattccctctttttctattgattggaatagtttcagaaggaatggtaccagcttctctttgtacctctggtagacctcggctgtgaatccatctggtcctggactttttttggttggtaggctattatttattgccacaatttcagaggctgttattggtctattcagagattcaacttcttcctggtttagtcttgggagggtgtatgtgtcgaggaatttatccatttcttctagattttctagtttatttgcgtagaggggtttatagtattctctgatggtagtttgtatttctgtgggattggtggtgatatcccctttatcattttttattgcatccatttgattcttctctcttttcttctttatttgtcttgctagtggtctatcaattttgttgatcttttcaaaaaaccagctcctggattcattgattttttgaagggttttttgtgtctctatctccttctcttctgctctgatcttagttatttcttgccttctgccagcttttgaatgtgtttgctcttgcctctctagttcttttaattgtgatattagggtgtcaattttagatctttcctgctttctcttgtgggcatttagtgctgtaaattttcctctatacactgctttgaatgtgtcccagagattctggtatgttgtgtctttgttctcattggtttcaaagaacatctttatttctgccttcattttgttatgtacccattagtcattcaggagcaggttgttcagtttccatgtggttgtgtggttttgagtgagtttcttaatcctgagttctagtttcattgcactgtgatctgagacagtttgttataatttctgttcttttacatttgctgaggagtgttttacttccaactatgtcgtccattttggaatatgtgttatgtggtgctgagaagaatgtatattctgttgatttggggtggagagttctgtagatgtctattaggtctgcttggtgcagcgctaagttcagttcctggatatccttgttaacttactgtctcgttgatctgtctaatgttgacagtggggttttaaagtctcccattattattgtgtgcgtgtctaagtctctttgtaggtctctaaggacttgctttataaatctgggtgctcctgtattgggtgcatatatatttaggatagtcagctcttcttgttgaattgatccctttgccattatgtaatgaccttctttgtctcttttgatctttgttggtttaaagtctgtttgatcagagactaggattgctacacctgctttgttttttttttttttttttgctttccatttgcttggtatatcttcctccatccctttattttgagcctatgtgtgtctctgcatgtgagatgggtctcctgaatacagcacactgatgggtcttgattctttatccaatttgccagtctgtgtctttttcttttcagtctatgtcttttaattggagcatttagcccatttacatttaaagttaatattattatgtgtgaatttgatcctgtcattatgatgttagctggttattttgctcgttagttgatgcattttcttcctagcatcgatggtctttacaatttcgcatgcttttgcagtggctggtaccagttgttcctttccatgtttagtgcttccttcaggagctcttgtaaggcaggcctggtggtgacaaaatctctcagcatttgtttgtctgtaaagaattttatttctccttcacttttgaagcttagtttggctggatatgaaattgtgggttgaaaattctttaagaatgttgaatattggccccgactctcttctgatttgtagagtttctgccgagagatccgctgttagtctgatgggcttccctttgtgggtaacccgacctttctctctggctgcccttaacattttttccttcttttcaactttggtgaatctgacaattatgtgtcttggagttgctcttctcaaggagtatctttgtggcattctctgtacttcctgaatttgaatgttggcctgccttgctagattggggaagttctcctggataatctcctgaagagtattttccgacgtggttccattctccccgtcactttcaggtacaccaatcagacgtagatttggtcttttcacatggtcccatatttcttggaggctttgttcatttctttttactcttttttttcctctaaacttctcttcttgcttcatttcattcatttgatcttcaatcactgataccctttcttccacttgatcaaatcggctactgaagcttgtgcatgcaccacgtagtcctcatgccatggttttcagctccatccggtcatttaaggacttctctacactgtttattctagttagccattcgtctaatcttttttcaaggtttttacttctttgcgatgggttcgaacatcctcctttagttcagagaagtttgttattaccgatcatctgaagccttcttctctcaacccatcaaagtcattttccatccagctttgttctgttgctggcgaggagctgcattcctttggaggagaagaggcgctctgatttttagaattttcagcttttctgctctggtttctccccatttttgtggttttatctacctctggtctttgatgatggtgacgtactgacagggttttggtgtggatgtcctttctgtttattagttttccttctaacagtcaggaccctcagctgcaggtctgttggagtttgctggaggtctactccagaccctgtttgcctgggtatcaccagcggaggctgcagaacagcaaatattgcagaacagcagatgtggctgcctgatccttcctctggaagcttcgtctcagaggggcaccccactgtatgaggtgtcagtcggccccttctgggaagtgtctcctagttaggctactgaggggtcagggacccacttgaggaggcagtctgtccgttctcagatctcaaactccgtgctgggagaaccactactcttcaaagctgtcagacagggatgtttaagtctgcagaagtttctgctgccttttgttcacctatgccctacccccagaggtggagtctacagagtcaggcaggcctccttgagctgtggtgggctccacccagtttgagcttgcccgccactttgtttacctactcaagcctcagcaatggcgtacgcccctcccccagccccactgctgccttgcagtttgatctcagactgctgtgttagcagtgagcgaggctccatgggcatgggaccctctgagccaggcgcgggttataatctcctggtgtgccatttgctaaggctgttggaaaagtgcagtattagagtgggagtgtcccgattttccaggtacggtctgtcacggcttccctttgctaggaaagggaattccctgaccccttgcacttcctgggtgaggcgatggcctgccctgctccgtgggctgtacccacttgtctggcaagccccagtgagatgaacccagtacctcagttggaaatgcagaaatcacccgtcttctgcatcactcacactgggagctacagactggagctgttcctattcggccatcttggaacctcctctaaaagtccttttagagttgcatgtgtgtatttgtatttattccagattggagttggatcattaacccagattagcaccttaacttaatatcagtgggaggtttctctagttggttataccttaacattcaataagtgctcttcttttgcttaagattattggtctcaggtcatataaactagagggaatataaaccttgataagcattggaatggcatgagcaatctgacattcttttaacattgggaaagataatgtttgtactttatttttttccacaaaacttatataattggtggtagagaggtaagtattttagataattagacctttagtaataagattagtcttagtttaggcttgtctttaataggtagtgaatagaaatgtgcatttctatatgttatcttcattgctaacctgatcacgtctgtgtaaaaccttagaacaccttgagcaaattttatattgcttttgaggatatagaaaaatggtacatcatggacatatgtagtttgtacatttgggtttgtaaacattgtttggctcaaattactatcccaatatgtaaatccttatacatgctagtagtgagctcttgagataatttatcatcttataaattgggaaatatttctgtattccccaaatcttagattccttatcatataagccctattttctacaatttgggggactatttgtctttaagcaagccttcatataagatgcaaattgggtctcaaaggcaatactgttgaattatagatagttaatctgaggagggggaggtgtttgttgtatataatagcttccttactaagttatgagttccctaaaatcggtaaccaaatctcatgcgtgtttatataacctacaactttcatatagatagtaggtgctcaaaaatgttaattgaatgaatgggtatccttcctttgtctcattgagacccatttaaaatcattttagcaattgggttattatactaagaatgtttcaccaaactaaaactgaatttgttttattttacaggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcaggtttgtaatggtcctttcttccactattaaaaaaaatttactgttctaattgtagtttcagggtcctgcattttaatacattgtacttgctagacaatgatctccccatatgttttacaaaatctggtagtttttaaaagtatgtcagctcttctcaaaggtttattttctatatttgtcaaagaacttaatcctacctgattaaattttctaacacctcattagagaacacatccagcatttaattacatataggtgtaaatacatatgttcttttaaataaacatttttttctaaattacaaaaacatttcatactcaatatagaaaacttagaaattagaaagtacacgggaaaaaaactcacctaaaacctgatatagcaatataactatagtcatcgcccaaaggtaaccactattattttatatgtacgtctgtatttgcatgtggggatggggctgagaagagggactaggctgagaaggcagggtagaagatctgattgtgcatgatatattgttaggcttcaagtggagtcaaatattaatagtttctaccatattataacagtgtataaaaaggtacaaggtacacaaacaacagagcaaaaataccaaagcattactgaacagtaaagtacctatggttgtatggcattgttcctgccaccattaaattgtccccctcagccccctgatatgctcacatttctccttacccagcttaaattccatggttactcccatgcatacatcttcagttcccgtggcccttctttctctttgttatagttgctggaaaaacaaatccaaccctggttaaatttacttcccacctactctatgtcttcaccttgcacaactgaagtatcagaaaggcatttacagctgtactgactgatctcactttaaatttgtgaccgtaaaatcagagtgggcccttaatgctacccaggaatcacactatgttttcttggccatttactctcctactgttggataaccatatgtgttcctttccctttctccaacacctcctccaactttactctcaatttgtattttattttactgagaaaattgaagcaatcaataatacttccacatcttctcatctatcttcatctgcgtctatcctattcccctgctttgtcttctgtttttatggatgaactgttcctttgcaaaggctaactctttcactcaggtataagattatttttgtcttttgtatactcaaggacatcactccagaaattttcctctctcactctcctactttaacaatttctccctctcctcctcatcttttccaccaacatgcaaacatagtattattgctcccattttcaaaagattttctcttggccccaggccaaaaaccttgaagttgttctttattcctttttttctgtcacctcccatgtaaactatcagcaaatcctattatttctaccttcattatatatccagaatttgattatttcttattaccttcattgcttctgccccagtcaaagccaccataatttcttacctcctcctcccttcaggtattctcagtataacagcggaatggtgtgccacttctttagaaagctcagtagggatttaatgctttcagatgaaaatacatttttatatgtactgagcagtttctctaaaggcgatcgatttctggtcacttcatgtactcttcctccaataagtgaaaaggaactcaatttatttagggggcggaaggagcagtgaggatttttatatagcaagaaagttaatttaatttaggaatagatgagaaattgaaattttattataaaaacttcataaagattagataccagcatatggtaataagtgatggttatctcagtgtttaaagttaattggcttctatccttctccttagagaagcagcttatcacattggtggcaggttcagcctgatactagctgcagtcaaaaagatgtttaaaattcctgtaccaggccactcagtagtttcacactgtgttaatatttgacatttgtatattgtgcggttttttatctgcgaggctggaaggaaattggtgtccagtgtgactaactattcaaaggttatagttacaatgacaagagtgtttggtttgcatatgttcatggtggggtatgtgtttcagtattctcagtgctataataaatttattgacatggcattaaaccccatcagaaaataataaggtttataaagaactttgtctggtgttacagagcttcattggacatttagctctggtctacgcatttaattttcatagtttataatacatcttatgataattaacctctgtagaaatggtcaagaatagcattaaaacttctcatctatttggagaaggcttttgaaggggcttttaaaaattacttaatggactatatctgtttatcctttgaggactaaaagattaaatatatggctgataatcctttttgcttataaatatttgagagtgctagaatgtcatttatatatttaattttcatgacagtattaatttttaaaaggtagagcttaatgcatatgctgattataattatcactaaacatttaactatattatctccattttactggtagaaatgatgatgaagctgagttatggaaatttggcttcattagaatgttaggcaaatttaatatattcaagaatttcttccttctgaaggttatgatacatggtatataatgtcaggaaactgataactgtaaccataaattctgatgactgaatgctcagatgagcccccagacagaatagcctcatatgttgtagtgtgatgtgtaagaacacatatcatccctgttttttagatacaaagcttttaaacagaacaaaaaagtatcaatggattataaatgaaaataacatattaggccttataagttagtttcatgtcccttccgggaacaaccctaacttgagacaagaaagattatgggaaaccttatggcatacacaaattaaactacattcaggagtgaccactatacacttgactctagcatggagtaccaaacattttcgggtaccgtaaatgtatcctaactgtattcaagcagttaatactcaatagccacaatgcatgtgttggattaaacattggcaagtgaaacaaaagagggctgtaggtgaaataggagctggcctagatataatgtgaaaagctgaatttacttttaatgaagagtggctttcagaagaaaaggatttactaactaaaatagacagattagaaggaaatcatcttccaagaggagggaaaagaatgggaatccacttgcaaaggtcataaagctttgataaactgatcacacagacccaacacataatgctagagaatgctaggaatcaatattgggaaagagaatatactctaacacaacagaatctattaactattttacttaaaagtgatccccaagtagccatgggggtaatgaccttccatttttagctgtagaagctcaggcagagaatctttgagacacatgcagatcctcaaatttatggaatttttttttgtaaaattgcaacttgcactgctgatctctgactgatctggaccaaaggatgggccaaaataaggctagtaggaatagaactaatactgaatgatacccatgtactcccatgggagggaaatggccttgctgtacaaagttaacaggaacctataacttgataataatataagttgagacaaatgattggctttgtccccagctaacatggaacctagaaatgacagaatgattgcaactggtgacagcatttgttcctcatcatatctggcatatgggcaaaggctaattcttctaggaaggtttaataaatatttctgtgacatttccggattttttttgtaaccaaaccaaactgtatcataaccatgctctgatatggtgtaatactggtattgttagtaaaattcaactatcttatataaataaatcatatggtaatcaaatatatttgagacattgaactaaaaactcctcacagtgtgataccaagggagagtgactggcatgaagaagaagtagaatgatttagttcattactatattaaattgctctgtgcaagtctatcacaaagttcaagtggccatagatcaagggaataaatggataattaaattggtataataatgtaaagatgtttgtgatggtcttataaactggatgaattgttcctttgaacctgtttccactccttgttggcttctgcaagtattagatagacttgtgttgttcttatggcaccttatataaaaatactgtgctaactgaacagtatatacagttgacccttaaacaacttgggtttcaaccacacgaatccacttttacacggatattcttccacttctgccacaccggaggcagcaaggccaatatatccttttcctcctccccagtctagtgaatgtgaagaaagaaggatggaggccttcatgataatccacggcctcttaattaagataaaatttattttctctcacacctgtcgtaccagcactttgggaggccgaggcgggtggatcgcttgagcccaggagttccagaccaacctgtgcaacatggcaaaaccctgtccctgcaaataatagaaaaattagccaggcatggtggcatgtgcctgtagtcccagctacttgggaggctgaggtgggagaatcacttgagcccgggaggcagaggttgcagtgagccgagatcatgccactgctctccagcctgggtgacagtgagaccctgtctttaaatatatattcttttcttccttatgattttcttaataacattttcttttctctaatttactttattgtacaaacacagtatataatttatataacatacaacataggtgtttattaactgtttatgttatcagtaaggcttccagtcaacagtagactattagtagttaagttttgggggtgtcaaaagctatatgtggagtcttggctgtgtgagggtcagtgcctataactgccatgttgttcaagggtcaactgtatactgtatgtagtacactgtttataaatattatgctaactgtatagtaactatactgactactgtaccaactgaagtgataatatataaatactgtacaaacagttactgtactgaaagttttattataaaaaggctttgaccaacaggatggattgtgaggaaaaaggtaacacaacagatgcagttgcttactccttccatgtccccaagggaaccatgattggcccctggccaaccctgggaatgtggctctcaaactggtctttatgttagtgattgataattttgttatatacacctggaaaaatggaccatgttgtaccagcctgtcagagttgcttttcacaacaatcaagattgatgatatcctagtttcattgttggggtcctcagtttccggcaacatggccagttgctagcaggatgcacctagtaagcagtcccttcatctgagtcttggaccccaacacttaaattggttccctgggcagagatatgccacacatttctgtagtttgctgccagacagaaagagcactcctgtgtgctctcagatgaggaaggactaggctacattaatattttaaaatctgtccttcaacttaaagcattactaaaaattatctaaactatttctggttacattaagtttttttctactccactagtacacgaaattatctggaagattcattaagtacctgcacactgtaccactattaacatatatacatttgcagttggtgtgttcacatgtatgtatctatttctgcctacatttgagagtagttcagggtcttttacagaaaccatgagaattttgactcttgtataagaagaacagattaaatccttgtctaagtaagacttagttttacaatatttcttctgactttctcactgaacaaaagaaagctcttataatgggtctcaggatttttatatattcacttactctaattttaaatttataccactaattctttttccagctttattgaagtatgattgacaaataaaatttgtatatattcaaggtgtacaacattatgatttgatatacatataaattgtaaaatgattgacataaattaatacatctatccctacacagttacgtgtgtgtgtgtgtgtgtgtgtgtgtgtgtgtgtgtgtgtgttgaggatacttaagatctactttcttagcaaatttcaagtaaaccatgctgtaaataagatcctcaggatttattcatctaaaaaatttgaactcatagatgcagagaacagagaagtggttgccagggggattggggaaatggggagatgttagtcaaacgatacaaacttgcagttataccacaaattctaaagggtgttaatcacatttctttgaaaaaaatgctgtaatctgagctataacctatctactgagtcaaattcaccctttcttcactgttcttccttatagtgtatttccttacactgctcacagttatgttcttcatgagagtggtctgcactcttgtttatcccctcatctgtagttccatagatttataggaagctgttttatagcctgcacctcctcttacctgtaggaatattttcactcaaatattgtggataggtttttattgaataaaatggatttctttcagttctcagatacctaaacagctacatggctcagacttttattttgtcctaggaatatatctgaggaaaagaatcctcttactataattcttgattttaaatatcttgtgttaaaactcttagccaaatttttaggaaaatgtttatttttaaaatatggtgacttaagtacagaaaaatctagtttgcttatatctctctcctttcttgctttttgcacaccctgtcctccatcaagtaattaggtttgactacatacttaatactattcatgtgggtttcagttaagctaaaagctgaacgccctgggaccaaaaatcaggctgaaaaatcaccagactgaaacatatactttacctaattggatataaagacaccagtgaactaggtagaatatctttgctttcaccataatttcaaaattgaacattgtaataaagaatgatcattggtttgacattttatcatcaaccccaatatattcccattcagaatcaagaaaaaaaaccatgtagtggagattcttcactaactagagcgaatgcagcttttgattagtcagaatagtcacattaagcttctgttaagaaaattggccaacaaccagcttctttgaatcagtcttcagttctactgccaaatattcttagaccaggtatctcttaggattagagaggaggaggggaaaggcaaaaggcgtttgacatcatatacttgctttttaaaattccccaaatcacagtaaatagccagtttgggaagaattttaagattggataattgctggctttaaaggggtttttaaatttccttcgtttgtcttcttcacaagaaatgtgaagcctcttaaaggcttctttgccattacacaatggaggcagtgtacaatagtggagagatcatgggctttaaagccagatagaacctgggcttgaattgaatcacagctctgaagcttaccagctgtctggactttagtcaagcttctgaaccttacttttcttgtctataaaacttggatattaaaatagctatttcacaatgttgttaatgattaaacaagatgacacatgtaaaaagcttacaacctgacacatggtaaaggttcaattaatttgtaaacctttctttccccaaacttaatggagtagagacttttaataattgaaatgagaagtgtcttgcatgagaaaatcaagaaagtctgtttatattttctaaattcagaaaataatttttgagcaaactctagccactggggaatttttttctaagtgactaaggcccagtcctccagctactcaagagagaaaggcacattaataatacaattactgaacaagataagaggtggaaataatgtgttactggaatttatagactaaggaaattctgatctggtagcaaggcattggaaaagtatctcatgtaatttgtataatgtagatatgttcttgaaattctgttttttaaggagtaaggtacaaattacagttcacatggggcatattgtctttaaatgttgaggtatatttgggcactgtaaagttgacataatgttgttcaaacacgtgttgaatataatctactgggccctaatggtgttctcatatttcagtttttttaagagggaggcttgcatcttggaactcttgctatcagtgtcacagtgaaatatcttgagtactatcttgaatatcgtgaggcagtttttttgtgagtgactttcctttaagctctaaaaatagtttgtgctttttattaaatcacttgtcttgcatccatatttaaagaaaatagcttttctttatatcagcccagtaggagctattgaaaatactcaaattttcttttaaacacatttttattctaaggctgctttgttaaacattagtttatgctatgctgcaaatcttttagagatcctttataatcaaatctcttgtctagtgtcttctggcattttggatttggccctgtttttttattttttgtattctcccccaccatcattttctagcatcgcccttaatgcaagttctactgttctcctgggcatagactcagacattacatacaaagtttccctttgatcccacacttcaaattaatttgcattatagtcttggctataattaagaaagttatatatttggcattaatgcctaataaattgataagcactatcactggagattcagacatttatattgtattgaatcaaatattttgcaatgagaaatcagactgtatagactgaatcaagtaaataccctagagaggtatcaattccttatgagagctttccccaactgtgtgatacagcttgttgcctaaacctaaattagaattgctttaagcacaaagagcaaaacgattgtgaaagacatcatcaactacattacattttttcccctttcttcttgctggctctatttttttatcatttgcatttttctcatctcgatgtccaactgactcatgatctatgtggaaagaaagtagtgaagtgtaggtgtgtgggccagggccaggaccctgtaggcatacaggtggaaggattgccacagtttgacagaccctagaatccaggagctagaaaaacatcaaaagacagatgagttatggatggttgtattgtaatggactcttggaatatgaagagcagagttccagtaccagctttattatttagatgctgcattcccttttgaataagttattttactttttcaaccctccacttgagcatctctaaaatgaggatattaccttcttctgggggttgttgtgaggattaaatgaggtaatggatataaaaaatatattttaaactgtataacaactgtatattgtaaggaaatggtaggagtagcttcctactccatgctacagtcaaaacagatagctactttgatataactctggacttcagtggggctgacactagctctgatatttcaagcaagacattcttcctctttgagcatcagttttcttctctgtctgattagatgtcgggctcggtaatctaaagatcctaggtgtacctttgttcactgtcactctattattatcttacaagtaacaaaatagaagggaagatatttgtgctgaaattaagtcccatcatagaatttttttagttcacaattatgtcccaaaatgggagtgaaagtgccttgattatcacctcttttcctttttagggtctaggccttcctattcactgtttctgttagacttatttgctggtcaggtaataatctgagaggtttctgcttttcctgtgacagcaaagaaatactttggctaatattctccttggcattaagctaaatatcttccacaaaatgatatcttatataggagacaggtttgggcatcaatgagattcctcacctactgatacttatagattcttaccttccaaaatatatttgctacaaatatttgtagcatttgtagcaaatatatattggcaagtacctgttatgcttattgatgaatggtagtttacattttgtgtaataaacattttattgagtatctgctatatgccagacattatactaaatacttacattatctctaattttcatgtaacataaatgtcagctggggacgggggtacatataggagggaagctgcttacattctcccaaaggtctgggggcctactttttgccgaatttctaagtttgttcattttacagttcaaaatagaaagatcacttatcttgccatgctgcacatgctaccattatattccacacatgtattagtcgggtttgtgttgctgtaaaggaatacctgaggctgggtaattcataaagaaaagaggttgatttacctcatggttctgcaggctatacaagaagcttggcgccaacctccgcttctggtgaaagcttcaggaatctacctatcatggcagaaaggaaaggggaagcacgcgtgtcacagggagagagagggagcaggcgccaggctcttttaaacaaccagcgggaactgagaactcactcattaccataaggatggcactaagcccttcatgagggatcctcctccatgacccaaatacctcccaccacgccccacctccaacattgggggtcacacttcaatgagatttggaggggacaaatattcaccatttcaacacagcatctaccaagtgtcatacttagcctctacttcaattcatatgtatattatattcactacttcaattcatatgtatattatattcacttgaggcattcctgtctgtagtagaccttagtgaaggggaatgaagtatttgcagcatcaccagtaacttcaaattgacaaatatcttaacaaatatcacctgggattttttcctctggctagttcaccatacatagagggacaatgtgttattgaactgtatagactctctttatagtctttccctcacctggtagattcttcccacaccccaacttcacttctgactcaattatgcataatgttttagtttttattccataaatgagcctgtggcttgcttttgcatatccagacacatctagatatatgctcagtgaaacaataaaaggcgaccactctcagaatcaatcttcttcattaagcaatcgtggttataagcaccaatatttttcttaataccaaacagtgtaaaggttggtactaccctcattttatagataagtaaacaagctcaaagaattaaatgactcgtgcagggttattcattgagtaagtgataaagtcagattttgaaccattggaatccaaatcctatgcactttccaccaaacaagacacgattcaaaaaggaaattggaaaaaaaatgcatattaatgtcctctgagcttgcaaataggaagattgctttgaaaattcatagtatttgaatccattaggggtgggggaaatgtatttttaccattatggtcccaacagtattgtttaagaaagtagggaaacataagttaagtaaaaagtctcagtaacttggaaaatcctgccttatatcaggtaaatgggacatttattatggctaattaagttttatcttttaaaattgatttgtacattgacttttacctgataaatatttattgatcctctctatctttttcatcatacttcttttaaaaaatagtttttctaatacctgctgtttttttttttacagaggcaattaaaggcagatgctaaaaaagctattggaaggcttcaactacgcacactgaaacaaggagacaaggtacattcatgacttttaaatgctatttattttaaagcagtgctaccaagccattgttcaggctaaatgttcttcctaagtatgcttttattggcatttatgaaccttattgactttatatgcatttgattctagaggttggctgaataatggcctcccaaagatatctaagataactattcccttgaacctgtgcatattaccttatatggcaaaaaggactttgcagatatgattaagttaagggtcatgagatggggagattatcctggattatccagatagattcaaaatataattgcagtgtccttataagagggagagagagggagatttgaccacagtacagtaagggatgtgacaagggaagcaagagggtggggtgatacaagaaagaggcaaggagctaagggatgcagacagcctctagaagctgggaaagataaggagagggattctcccctggtgcctccagaaggagtgcagtattgccaatgccttggttatagacttcggatttccagaacagtaagagaataaacttgtgttgttttaagccactgaattatgataatttgttacagcagctacaggaaactaatacaatgctttagtgttactttggttgaatacgcattttcagatttaggacagttgaaaactaccattcatgggtaaaacatgtatttcaaaaaatagctatagaacttatggaaataatacaccattttaaatcttaccaaagtcatgaaactgtaaaacactaatgaaagagataaatcaaagaagatctaaataaatggaaacatataccatgttcatgggtcagaagacttgctgttgttaagatgtcggttccccaccaaactaatttatggatttgatgcagtttcaataaaaatcctagtgtaaatcttttatagaaattgacaggctgattctaagcttagatgaaaatgcaaaagaactagaatgaacaaaacaattttgataaagaacaactttggatgattcatgctacctgatttcaagaattattttaaagtcacagcagtcaagatagtgtcgtattggaaaaaggatagatttatagatcaaagaaacagaagagagagtacagaaataaacccatatatatatggtcagttgattttccataaaagtgcaaaagcaattcaatgaagaaaggatagccttttcaggaggatagccctttgttggctatccatatgcagtgattggatatccttaagcaaaaaacaagcaaacagacaaaaaagaacttaaatccattcttcataccctatgtaaacattatttcaatagatcatagaccttaacataaaacctagaactatgaaatttttagaacaaaacgttaaagaaaaatattttcatgacttgggtgacaaatatttcttagatataactccaaaaacaagtccaaaaaagaaaaaagttgatacatttggccttgtcaaaattaagaatttctgttctttgaaaggcactgttaaaagaaggaaaagataaggtacagactgggagaaaatatttgcaaatcatatgtctgttaaagggctgtacccagaatataaagaactcttaaaacttaacagtaagaatacaaacaacctaatagaaaactggcaagcaaaacagacaattcaccaaaaaaatatatatatgaatggcaaataaacacataaaagatgttcaacatcattaataattaaagaaatacaaattaaagccacaatgaaatacaactacgcattcattagaatggctaaaatgcatacaactgaaaataccaagagctgggcgagatttggagcaactggtacactcattcatttgctggtgagaatgcaaaatgtatagccaatttgaaaatgtttggcagttccttatgaagttaaaaatacacttaccatagcacctagcaatctcactactagatatttaccctaaagggagaaaaaatctacgttcacataaaaacacaactgttcatagcagctttattcataattgtcaaatactggaaaaaagccaaatattgttcaactggtgaatggataaactgtggtacatacatatcatggtatactatttagcaataaaagtgtgatgggaatcccattgatacatacagcattatggatgaatctcaaatgcattatactaagtttaaaaagccagactcaaaagctagataatgcatgattccatttatatgacattcggggaaagccaaaactataaaaacagatcagtggttgccaggaggtggggatgagaggaaaggttaactacaaagagtttagaggagtttgttgggagtaatagcactattctatatcttgattgtgataaggattaagtgacgacatatttttcaaaacgtgcagaactgtacactaaaagggtgaattttactgtatgtgaattataccttaattttttaaaaatgagaaaagttatagagcttgcacaaatggtattttatatatcctaaatcaggaaaaataaatcagtgctacatgtttccctttgttctgttccccttttgtttcagtttattcttttacctttttaaagtctggatacttttaaatcacctttgggaactttacagttacataatcattcagtgatataatgctcctccttttataggaatttaggctggttaagtacatgtatgttctgatcttgttctgtagtttaatgtattttttcttatctgtcagagtaacaataactacttgcttgtaggaaattggccctgatggagatagttgtgctgtgtgcattgaattgtataaaccaaatgatttggtacgcatcttaacgtgcaagtaagtttgattttcttctatatcttcaataaaatagctgacccacaaaaatgactgtgatggaagaaaactattttgaatatttccaaattaatgtaaaaaatgtttattttttaacttatcttcatttaaatatagaatggtttatttttatttttattcatttcttaataccactgaaattggtataagtctaattgtaatctgcttcaatttgttctaaactaattccatagaaaactgagaacctagccagcacaattgatatatatgtattatatatatattatatatagtatatatactatataatatgtattaatattatatatactatatataatatatattatatactatatataatatatattatatattatatataatatatattatatataatatataatatataatatatattatatataatattattataattataatatatataatattattataattgtaattatatattataattataattatataattataattataatatatataatatgtattatatattaaatataataatatatttatatattatatagtatatatcttacatagtatattatgtataatacatatactctatattatatatactatataatatagtatataatatataattatatatactatataatatagtatataatatatagttatatataaatatattttatatatagtatattttaaatatagtatataatatacatagtatactatataatatatatactatatataatacatattttatataattatatatactgtatatactataatatataattatatatactacatataatatgtattatatattatatattatataatgtataatatattatatattatacattatatactatatactgagtatatatactatatagtgtatagtatataatatatgtatatgtacatgtacatatatatactatatgtacagtatatatactatatactgagtatatatactatatagtgagataatataccatatattatctattatatagtatacaatagtgtatatatactatatagtatatagtatatatatactatatactatatatactatatactatatagtatatagtgtatatatactacatatatataaattgtgtatatattatacatatatgtaaattgtatatatataatacatatatataaattccaactaaggagtgaacacttccaaatagatgctcataacttgatttcattttattttttcttgatagattagaataaatttaaaattaatccagtactatccttatatttatgtgtatttatattatattatgtatatatgtatattatatatttatgtatatatatgtacattatataatatatatactctacataatatatagtatatattatatacattatacactatataatatagtgtatatattatatacattatacactatatataatatagtgtatatattatatacattatacactatatacattatatataatatatactatataatattataatatgtagtatatatagttacacatgtaaatataaggacagtactggattaatgttaaatttattctaatccatcaagaaaaaaataaaatgaaatcatgcatctgtttgaaagtgttcattccttagttttttaaattatccctctcctgaaggttgttcttaacactacttcttttagctatttaatacaatagtgatgctcttggaacatatcacattgcctaaagcatcagtacagtgttgttgtactcaatactatattggactatattattgagaatgactgtaccatttatcagttagggaattctaactgtttaagatttgaaataatgaacaaagtcttaggtcaggtagtgtcctagccattttcaaatgagtactgaaaatatttttttttggagctagagtaatgaggcttttacatttaaaagtaccgtattatggaatttccaaattttgtttctgtgactccttcattttatgaatagtgtgtttaaaaggaaaggcatccattcaaagactaaataaagttacactaagtaatctgttaatatatattaggtaaagtgttgctactttacaactgataattatgtttttttcctgaattagccatattttccataagacat

SEQ ID NO: 3547 - DNA, 103155 bp, human
tagagctgatgtatccagaggttatgttgctagaggtgagatcagttacctacgtgcaactgaaatttcaaacttctgttcagcagggacgtgagtggacaatggtgactgatagttggaaatatcagcaaacatcttaaattttatactcaaatgaatgagcaatgaaccaggagaataggtccagttttttttggctccttgtaatttttacctttttacttaaaattacagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtaagtaataattgattcacaaagagagttaatgtccgtttatcttagaatggtatttccatctagaactggtctaggatctggcaacaaggttgtaaaataattttactttaaattttcttgcctggcacaacttgtaattactttattattatttaatatttttaattaatttgttccaaagacagtagcaattcatgaagtgattcctattttctttcatgttttcttagcaatataagtttcctcagtgggcattatatcgtgagttgctttttaataaactgtgcctttacctctaaacattaaaaaatttaatttcattattaatttgcacttctcagtttgatttattttctcctgcaaaagggattgtatgttttcaagtttgtgaaactgcaaaacagtttcattatgcttaaataatagcatattataagtgtgtaaaatgttatagaaatgagaacttgactctactgtatgcttgtaagatttgaatctttttgcgggactgatacaaacgaatctgcaaaaacgtgatattacccattgaaaagtgtatggcagaaataggataacactgtaattaacaaagaaaataaagatttcccttagaaatatttactaatggcttcttaagtaaatagaaacttctaatttattaactttttaaaggagttacttctgaaaatcactggtttttatttatttaaaaaaacagtttccaagtaaatagatttttaaaccaatgaagaagtaaacttctgaaccccattttgttcactgtggataggtatgtgtgtttttatcagacttggtctaaaaaaaaaaaggaataatttcaatcaaggcaagcgctgacagtaaatgaatacaaaattttgataattggtgttattgccaaatttggcctctaagaaaattaatgcaaattaaattaaacagattttagaattatgaaaaggagaaaatcaaacttatgttaagaatagtatggtgcttggaatgttccaagttgtacacatacaatatcactgtttggtactaatatttgaaaaccaaactgcttatttcgctaagcatcaaaaaaacaagtaagatgaacttcagcagtacaaaattattgtagatgtaacaaaactccatgtgctaccttttgtgacacatcctggacactgcaagagctcagacattcacattttatattattttctagctaagagcatttcataagcattccctgcctgttcctgtgtttttacgagtgactttcatttttgtagaaagaaactaatgccattttctgataaaacttaggaattaaatctgttctaaggaaccaacttgctatacatttaaacttagagatcctgaatactctgggtttccttttgcatgaacacattctacttattcactctcctgctatttttgaaatacaaacagtatcaaactaaatagtagtcctgttttcaaaactttctttgcaacctgtattagggaccaatatctagtagaatgtaggtaccctgccagtaaatttgaaatatttaccaaagatcactcacagtaaatctctccaaaagaaacatgtgcataatcatttgaatatgtgactctgaacagagttttaaaaaggaggcagttagacttatcattcaatatatacctccaatataaccaaagacacatgatcaaaaatattttaaagctacagtattgcacctattttaaaataaacacattgaaaaagatagcataatgatcataactgtgatagttaacatttactggcatttactatatttcaggcactgttatagtgtgtttatttaatgaacattgttttttaacatatgatgatatcaaccccaaagaattaaaactaaatttggaattttgcccttttaagacctgccaaatagtgtgccattggattttttccttcctagaaatttcctttatataaaaactattcagtgatgcagctgacaaacataaggaatcaagtgtggatatgaaaactagatgaccagacactagatcattaaagactgtcattattttatgccaacattttgtttgttgttgctgtcttttcactcgtgttttgttttgttttgacacagaggatgggggaaatcctcctacaataaagctcacgatttcaccttctgtcatctcatcttgtattaccccctaaaaaccaccttttcagaaaatcacactgtagccccctcaggcccttgtactcttctactcttctctggctccccctacctcttcattccttcagtcccattatcctgtactaggtcttactaagcacttccacaatgttgtgtctctctgcttctttctaatgtcagtgctctccagccaaagaccgctagcaacagacctgtagtttaaaaaggtagatttattacttgttgcagcaattggaagagcacacaccatggaaaaccacagggcatcctactaagagggtgttaaaaaggacttgcaggatttgggcttgcttatgtgttttgggggagagttgaaggaagatgactgttaaccaaccattctagtttgcttgagattgaaggtttcttgggatatgggactcttaatgttaaaccaggaaattcctgggaaaattgtgacaagttggccaccctagctggctttgttctgaacttggaggctgccagtaagttgtaattctgtgtttaggtttctaaataaaccttttttgtaagtggggaagactagcccatggctaaagctgtaattggtaaagaagcaatagttacccttattagccagaatagagagatatttggtagttacccttattagccagaatagagaaatatttggtagtttttgtggcgaggacactgtccatattttgtctgtgttcagacctgattatggagtggtcttttttgtttgtttgttttgatccatcatagtcacagattgaccttctctaatgttgatgttctgtgagatggtttatattcaacaagaaaatgtcaaggcttaattgagagtgccaggctaggtcctaaatatcaggggcaacttgtctctttctcactgaaaatctacttcacccaccctcgtactgttgtgcaaatatattctcttcccccatgtcctttcacatttctgtgcctccgcatcccttataggttgccttcaagggacctgataagtctaagggatgcttccacactccttgcctcacatggtttcatgatttaaatacagaatgtccttactcttgagtccagtctatttacagcctccctactaagagtgttatttttctgaaggggataatttcagtttgagaatagcttccactgaggaagaatagtgtatagcctaataattggaggtaaacttctaactcagtttcccattgtgctgtgtccagtatcagtttcctaatttgctcttggagttctcctttgggttatattctgcattggtgagtatatctctatctatctacacacaaacatatatgtatatatacatatattttcatattctagcttaccagaaggaataatgggattttgactcggcattttgatgaggtgggaaataaaaggatatgtttaccatgttcttaagtaagtatgtaacttcctaacaatcttttccgagcactgcagacatggcctttcagttctattctagagatgcaagaaaattcaggactcctgagttattcaagcagaagacgcgtaacatgttaagtacttgcttgctgagcagacagctttggaagttaaatatgttatttttaggtaaaatgtcttaagaaatgcttagatttggatgtagtttatatcagcaaggtcagtaatttgggagggataaaatggtttttacgttttatcatttcagctgtgtccaacgaagtggattagagtcaagtgtgcggcattcagaatctccaaaactcaaccaattccagagtagtgaagtgcatgaaaaggaagggtttaattatagcagcaaactcacatgctttataaaaatgtttttctagaagtaaaaggggaaataaaagcatggtatataaatgaagtgagaagatgacaaaaaacttcggtaaaactaactcagatatgtacataaagaagagcttaattcaagaaaactaatcagttgcatttcaaatgagcctcaaatctgtctaattctgtgcatctccaagacaccactcactctatcttagacctctacaacagctttccagttgatttccctgccactcttttccccttccaagcccaatctccagactgtaagccaaagtggctttttagagaaaataaatctcattctgtttaaaatccttccgtggcttcccatgacactcagggtaaattcaaacttctttccaagactttatccagctctgaatcatctggcctactgctgtgacctcatttcctctcactccctcctcttctactcactgaactcttgccacacgggactcctttcagtgcctcaattccactaaacatttccttgccagacagcctgaaagtaacccctgatgccttcctcatcctcgctcccacatctcattaaacataaagttctcttgatcctacctccaagcatttcttaagtccattcactttttcacctctgctgcctccatccaagcccaggccaaaatcatctctcacctggaccactgcaatagcttcttaagtgttctctcttgctattctcgcccctctgtagcacatagcagccagagtgatcctgtggaaaatgtaattccaccccagttagaataaaatccaggccttgagcctaggcctacaaggtttgatgctaatcatgtacaatcagaccttatcctatgcccttctgccctgcattaccatgcctcagcgactctggttttctctctgttttttaacaaagagaaataagcgcaagcttttgtacttgctgcctcctctgcctgagtcacttctccttcatttttttttcacataacactgcctccaaaatataaccatgtctatctactaccactagtctagtacaggctaccgccagctctcgcactgactactgcaaatagcctccaaactgggctccctgcttctactcaacctaccccatatattctctacacagaagccagagtgatcaaaacatataggtcgatcacatcactcctcttctcagaactccccagtgactttccattgttcttcaaataaagtctaaattttatcaggcctaaaaggagttgcatgatctggcctctgcctatctctccaacctaacagtctactctttccctctccctcacaatgcttcaaccactctgatcttcggacattttctccaacacgtgaagcttttcctgcgtgggacactttttacttgctttgctctctctcaccaccatcgttatcacacataacaggtactccatataccagtttaaatgtttcttctaacgggtctcccttgaccttatacatattattttctatcaaaaccttcaggtcgttcttgttaaaatttattttaatgtatattttcttttttaatttattttttaaatttatttatttaattttttttttttgatacgggtcttgctgtgtcacccaggctggagtgcagtgacacaaacaaagttcactgaagtctcgaactccctgggctcaagcaatcctcctgtctcagcctcccaagtagctgggaccacaggcctgtgttatcacaccaggcaattttattttatttttttagagacaggggtctcactgtgttgcccaggctgatcttgaactcctagtctcaagtaatccttctgcctcgacatcccaaagtgctgggattatagtcgtgagccgtcgcacttggcctaattattttcttacttgtttattatttgtttctcccactagattgtaagttccaggaagacagagaccacgtctgtcatgtttgccattgtatccattgtacagagcatagtgcatggtcttcactatttgctcaatgaataaaagtttaagaagctacaaaacaattctcttttatatgtgaaaagatggacaagttgaaatgaagtttggtaaatttggcaaactattgtattttttaaattgtttttatttttactgatacaagtaataaatgagtagtttctcctataaaaaacactaacaatataactaaagtctccccttgactaccacccccaattccagcaccttttcaagagataactattgctattcattcagtatgtaacctttcagactttttctattcatttttgcatatatacgtacagaaaacacgtagtcaatttgtgttttatttttaatattaacaaagttattctgtagcttgctttagctactcaacaataggaactggagttatgttcatgtcagtaaatttgtatttaaatcaaattcattcttttaactattgcattatattaatattgcacacacacacataatttatttaaccagtcccctagcaatggacatttgggttgttttcagtgctgctcttttacaaacaatacttcagttaacataattattgctgatacataagaaagctattgatattgatcttgtatcactattgttgaccttgcatctgaccaccttgttgaactcctattaattttattaattcatccattgattctcttgaattttcaagataagtgatcattttctctagaaagttttgcttcttcttttattttaattctacctcttaatttttccaatggtcttattccattgtctagggctacaatagtgataacagtatacatccttgacttgttcttgactttactaaaaagtgctcccaccgttctatcattgagtatgttatttgatagaagcttctgggagatagtctttatcaaggttcaggacttcagtaagattttttaattttgttattcttatggcttaactagaatatgaatatatatgtatatatgcatatatgtttgtgtgtcgatagatacagatagagtcaccatgtaggatatgcccaaaagggaaatccaatagtttactgttagcttgggagaaataataaggtggtatacagaaacaatagatgatctccataaattaggtatggaaagaagaaacaataggtaaaagggacaattttgggttattttccaaatacaattttattagtgccctggataaaacaattgaaaaagaaatttcattgtgactccgagttgagtgtcaagttgtaagacacaaacaaacagtaaaagcatcttgacaagttaggaaaattatttattaaaaacaagatgaagtaccatggtgaatagtaaagaataataaatgtagagacagatataaaatagaaatatatgggcaaaaaagacaggtttctaagcaaaatatttgacaactacattgtaccacaagtcaactaaagaatgacacagttatttaaaaaattgacatgattatgggatgtattagtaagtatataacatgttacgcctggaaaataactcagctatgcttggaattcatgaatctctgaaacatcataagcttttttttttacctgacttacaataacaaattattttagtacctcttttatgctttcacacaaatgcccaggtgcccccctcccctgggtacaggcacatacaaacataattgcataaaaatgtatgtttataaggaaatcaagatatagtacctctgggcaccagtttccggataaaaacaaaatgagtaaatttactgtgagccctttcaagtacatttcatctcccttttctccattttaaaatcaaagaacattttgaaagcatctaaacatgtgccatttgttcattaacatatcctttgcttaactcttggcctcttcctcctaaatttttaatgtttcatttattatgttatgatttgctgctcagacatagatttcccccagaattacttgcaattattagaaaagagtgtgtgtgtaaatacacacagaacaatgcctgagcctatataaagtaggctacttcctcttaagtactctctgtcgctctcatttcagcagtcctcagttcataagtgctcttaccccagctacctctcttccttcattcgaagagtacattccctaggcagcaaggacatcatataaacaaattatatctgtttctgtctaaacttgcaagttttatgtgctacttatttagaaaattgttcgatattcaggtgctattttgataaagttgggggaaagatttacttgttgcacctagaaacaacatgccttaaaagaaaaacaaaacagatttcttactggtgatatcaggacctttgacagaacagtggaagagtgaattccaggagatgatgtttcagagtgtccctcatcacatcatgcaagcaacaacctgttccacctatgctcaggacatgctttgagcacacaaatattcaacagtatagtaatgttaatagtcatgtaaatatttaacaatatagtaatgttaactgtaactttttagagttttagatgtatatcatatttttgcctaaatttttaatgacatatattctcagcatgacctagctaatgacctcaatatgcaatgatagtaacacaatgtagttaagtgaattcgtctctagcaataatcaatacattgacatctcccccgtggaaagaacaaagagaaatgaaaatttccttaataattcacttgctttccatttatattttaaatgactgtctcagcatcatttctcatgataaattggaactctttatttctttcagtaatgtacctgttaaagtatctgtttttccttcccctttatgaaggcagttgttaattgtaagtactctgttaactatgtgccgagcattcttctcagtgtaatcatcccaacaactgctatgaggtacatagtgtcagtatctccattttatatataagaaaactgagacacagagagattggttaaattcgccatggtcatacagctagtacgtttcaaagctgagatttgaaacctaatatcctaataattaagagtctgtgctcttaatcagtacacaatactacctctccagtgagcatatactatggaaggcactgtaaaaaatggtacaaaaatatcatcattgccctcaaggagggaaatgtagtcaggggactaatatttacgcaagtcataaaaggcagactagaaatgttaaggttattagaactgaagcaattaagaaattgtaaaggtcagagtgttggaagggtcatcaacatagaaggtgatagcagagaagtcaaagaccagtaccgggaatatgaaagtgagagagttataggataaccagtcagaaagtgggatatttctgttaggattttggaggtttagcagattaggatgctgataatatacagagtatggccatggcagtggggtcaataaagtggaatggcaacaaaaattcctgaagttaaaccacactgaggacagaatgttgggtgatggaaagatttgagggtgaaaaggatggctgtgatccaaatgataatgtcttcgataaatgtgtgaaaattactgggaggttggtccatggccaagcagagaggaaggtaatagaggttattaaaaccaaatgctgttgagtctccaagaagcagattttgattcataagagtgggggagtaggccgggcgcggtggctcacgcctgtaatcccagcactttggggggccaagaagggcagatcacgaggtcaggagatcaaaaccatcctagctaatacggtgaaaccccgtctctactaaaaaatacaaaaaagccaggcgtggtggctggcgcctgtagtcccagctactcgggaggctgaggtaggagaatggcgtgaacccgggaggcggagcttgcagtgagctgagatcgcgccacgcactccagcctgggcgacagagcgagactctgtctcagaaaaaaaaaaaaaaaaaaaaagagctggggagtagtctggaaacaacaatgtgggagtgaagagactcctattccttgaaatatgtggggcacgaacagatgagctgccttactgaaaatatctgaaggagaagtcgtgtcctcatgataagacgggttttggttgagtcaggaagcacagggaacccacagtgaagagaagatgaggaaagtatacaagttaaacatctgtcatgtaaccagagatctagaagacacatggaaacttttaggagaggagaagtagaagaaagtaatgagtagtacagagagaggagcacagaagtgaatagtaaacaaattagcttccatttgggaaactagctaaggatggaatgaatgtgataccaggtggcaataatgtaaagattagaaacaaaattctggagtaaatttgtctcaggcaagtatggtacttggtttatcaatgtaaagggctggcattgtatatgaaatgtaagagcattattcacaagggagcagccactcttgaaggagctggcaagggcagagctgaacagattagaggtgaaaatgtgaataaatttaaatcacaagggtttgttcctagagctatgattgtagatcacagggatggagaagcatgtcaatgtttgggcagggaggtagggtacggtggagggtaacaagtgctaaatgacctgaatataaaactaacccgccctaggtttccaaatggaactgctttatagtcttaatccaggtacaagttggtccttgacttgagtgtcacctgggtatctggaggatgttgcataaaaataggaaatcattataagaaacaagcacatgaaaaattatttggggctcttttaataaatcaaatggctggaaaatgatctgtttgttatgactaatgctaattacctatctgcattgaggagattaggattttagtaaaaactggtagaaacttagtcaaggccttaggatgtcaaaattgcaatcattaaatgcccggataccctgcattccagaattgaattaaatccaatcaacatttacttatgtatatttttagcttttaaatggaattgtaaattgagttcttttcctcaaagcagtcaattcagcagaggaagagaagtgtacaatcagtcaaataggatgtttgatattgttttagctctaaaaatgtcagcatggaccgaataaccatttttcagaaataatttttcaactgatttttttagcctcatataggatgcagccagcatctaaatgctcagttaacttatgtatagcaagattagctgcagttggaggccacagtagttacatctgagaaatgtagtaccatttcaaccatacacacaggcaaatgctcttagaaaattagttttctcaaaaagccaggatatgcaaaatgaccatatttaccaaagggctttgtgaggactccttggagcagaactcagagagaggtgggtaaatcacatgttggttagaagaaggagtgtgatttgattgtttcacaaggaatacatctttctcacctgaaagctgctgttcattacctcaataagggcagcttaaaggcttaaagaaggcctacagagaaatactaggcctctaacctgatgcattaccacatgatacctccacgacatgggagaccaagggatgaagagaaaccctagggtatgaacccctgggttgctattaattcttgtttacttgtccatagccttggccaagggtagctttgcagtgtggctaggaggaaatctcttagggagagcaagttctggctgacaattggattttccaaattgggaataaaagaaggcaaaactgtgatttttgtaaatctaaaaaacaatgtggatttgtttatacacattttatttgtatcatttcatgttaaacctcaaataaatgcttccttatgtgaaaaaaaaacaaaaaaaaacaagggtttacttattcactcaacaaatgtttactgagagccaaatatttgtcctcccaagttttacatttcatagttctatctctgaaacttcaagcatgcatggcttctaccagaagcagtgagatgtagtagtgattcaaagcatgggctttgtagggggatagacctgggtttgaatcccagatctactgtttgttttctagctgtgtgatcttggtctagttacttaaacactctgaatttcagtcttcttatctcagtcatctcatctgtaaaatgggaatactagcaatactactttaaacggcgaaagatgtataggatctgaaaagaaataagagtatgtggtactactttatatagggtggttgtaaggattaaattacataatgcatataaagaaggcactttgcacaatgtctattctatagtagacagtaaaaactacggtagtagcaagatgatgctcatgaagtcatccttgttttcagttcactctccctcttcttcacctgtctgtgtctctttcccactttaaactcttgggcaaaaatgtttgtcctacaagaagtcttttttggctaacagtttatcctgatatttcctttacttggcacctattcaaaatttacatacatagttcgggtcatgctaattttgcctttttgcctatttttatgtattcttatgtattcatttgtataattcctgaattcctaactattatagactaatagattcatagcttaaacattaaaaaatacataatttccatgtacttcagaaatcccttaaactaaaaccctgtccagtggtcattcacttactacttgagcactgtcagggacagagagttcatcatctcacaaggcatttcagttcattgctgaacagctcaagtttttagaaagttattgttcaaactatgccaaaatgtgccttcctctaactttcacacatttttccttgttgtgctttcctgagcaatataggacatattttaagttgtcttctatttactttatatcatccagtcaattaccaatcagtggtattgacatgttggctttttttcttaactaatgttagaatttcaatgtttttaccactaaaataattataaataaattattttttaaattttcttttggtgggatgggatatactccatctactttttgaggatgactttacttttgtgtcttggagaaggatttgggggccagtcacctgtgtgatgtgcggttttttgtgtctcaggagtccccctccccaacaatattctcctccctattagcatgctgtctaaaatttcatccttcattaaaacagcattctttcaggttttaaaagctgtagggtctttgagtccttgttaaaaaggcaaatggtcccaggaaaaaaaaaacaccaactgaaaagtactactgataacttagcagggattaattcattgatggcaacctgagtgtaaaacagcagattgattgaggtatgatctggaagcagtacaacactgacggagatccagggactttgtttcattcatctcagtatagcacagtgactgattcatatcaggccctcattgatgaatgaataaatgagtgtatgaaaatgaatgaatgaggctggaaaagtgagcatctatccccccagtcaaatatttcctacttcataatcttatctagaaccatttaagtgtgataacaccagaaagattggggttcctcggcttgatgacaccatgctgactcttaacagagtgttcttttaatctctgtctgctctccccacagctatttgatgtctcatctttagctggcagttggagacatgacttctttgtaggctgtttctatataaagctctggcagtaggaactgcctaggttaccaacagtgattcacacagctacataaagtgcttacacccacacagggttatggagtgaaggaaacagattccagttcagatcttgtttcactgcacgatattgtggaattagttaacattactctccacttatctacataagctattgtagatgtagtgatctccatcataccatgtgaatttgagtagagtattaaaaacctcattaattctcaccagtgtttaatctaagtttaaaatgtggggttagcacttagaggagtgaggagattattaagtgctttcagagaaagaaactcttttaagtagtatatagaagcaactgttttctgcaaacaatctttgcctattcaataaagcagatccagcagtgcttctttttggcatcattttagtagcaattcatttgtgttattatattacttgaaaataatagggctgcattttatatttttaaaaaactttaagaggaaggcctacctgacagaagttttcttaacaatggaaggatatatttaaaaatacataaaatgcctgttttaaggctatatagtaatgtaatcaaagctaatgaaatatagaaatctgcttcaaagaataatgtgatttgaattaatacttcagttgcttttatgcaaatgaatacttcctaaagcactagaaaaattgtggggtctttttttgtacaaggttcctagtgcagaacttatatacagtatgaattttctttatcatggaatgagtgctaaccattctccaaaataataaaatattactatattctataactccaattatagaacttgcctacttcaagcaagttttattagtatagtttcactctatttgcaaaataatttcataatgaaagtaggcttctatttcctttattttgtatgctcaggctgtacttctgacaatgaaaaaagttatatctaaaagaatatccccattgctcatttgtggatattgttcaaattattggatatcctattaatacttctctgaagaaatagatgtccacagcccattaatccttactctataaatacataaaatgttagcaaactgataaatattgataaaacttgtctcattcaagcaataatacgttatgaatcttctactttaggctttcatttcactgaactgtgccatttaaatgtaattatactttcataatatgaagctgtggtggttttgtgttgttttatatttacttggaacatttttaactgttataacttcttttttttttttagatggagtttcgctcttgttgcccaggctggagtgcaacagcccaatctgggctcaccgcaacctctgcctcccgggttcaagaaattctcctgcctcagcctcccgagtagctgggattacaggcagatgccaccatgcccaactaatttcgtatttttaatagagacggggtttctccatgttggtcaggctgatctcgaactctcgacctcaggtgatcccaccacctcggcctcccaaagtgctgggattacaggtgtgagccactgtgcccagcctgttttaacttcttatgggaatatttttatttccctacggtaagatcttggagatagtctatatttttttgaaaggcttcctcaatcacatatcctatttgtactttagggaaagaaaatattactcagaagagaagggtaatttaagacttttaccttcagccaaacaaaatggcaaaaatgaacaaacactccaatgttctaaatttactttcatataaattttaaatactgcataaattgtgttctgattcctgagaagctaaacagtaaagtaccatgttctactgaactatgaaaaaaatagataatctcaattcctttaatatggttgttttcctgaccctgagtcagtttcacccttgtctttgatataccactagaatttgttttgaacagaaggaaagcagtgaagatatacacaacaaaaggcaaatttctagtcctccaagcactacttttgcacctgttatatattctgttaaaatggtataagcaattatggataatacattaggaaactcagagaactacagtttattgaggatattgacttaaatgagtcagaagaattttcaatttgacaaaattaaaaccttttggagtttcagggatacgaaaagctgatctggctgggcactgtgaatcacgcctgtaatcccagcactttgggaggctgaggcgggcagatcacttgaggtcaggggtttgagaccagcctagccaacaaggtgaaaccctgtctctactaaaatacaaaaattagcagggcatggtggcaggcgcctgtaatcccgtctactggggaggctgaggcaggagaattgcttgaacccaggaggcagaggttgcagtgagccaaggtggtgccactgcactccagcctggacgaaagtctgtcaaaaaaaaaaaaaaaaaaaaaaaaagctgatctgggtgccttagggagaaattcacaaagaaaatagccaactatattctggccaatttaatttagaaataatagtctctctaggtttagtctagcttcatgatttgcctcttctgaagctataagcagaaatatgtggtcaactaaaatgtgatttatatgtggacaacatatgcagctgaactgtgcacaaccccatttgactgtgaaggaagttggtgggaaaatacttgttgaatatttgctactttaccacacaggatgttgaaaaatattttgatccacagcaaatataaaaataatttttgctaaaaaaaatcactgaatctaattcctcattttcaaaacacccacttaatttataggaagatgtgcttatttataggagccagcctctctccccacctactcaccgcctagccccatgggagtggagggttggagtggaaatgcacttttgcaaaccctgcaaaaatctgaaattagtatccaccccttcacagatatcctcttgtggatggtagaattatttagttggtttacatatttatggagcaatcaccagacagtaagatcattttgtttcataaaacacaggaaagttcctaagcacataacaaagttttcatttatttggatctcgacggttttttaaatcttccttttgaaactagctaagtgagccagacttatccataccagaaaaacctgtgaatatgtatttaggatttatttattgcatatcatagttagagtgcaattccttttttcaacccactatacaacagatgacacagcatttttttgttccaaccttataaaagaaaggcccaacagacagcatgttgaacatttttatggctaattcaaacacttcagtacttgtctcaagcacattttattttggtttatttttccatattttttaaattttattttattttaagttccgggatacatgtgcaggacatgcacgtttgggtaacttgttatactgacatctgaaatcaaatttccaatgtcttctgacaccatatggcaactgcttcaattatgagaacaccaagacactcagccaaggtcagccaaattgatttgaataaaacaaaaatcaatctaattgattattttaaaactaagcatcttgaagatgggaataaattcccagaatgaataagatcagtaagttcatagaatctctttagtggctacatgctcatgggagtaaggtgacatacagaatacaaatatgctaagttttgccattaatttaattacctgcatgtggctagcccaccggtggtggttaaatctcaggctaactttctttgatcactcaacatacttcagagtcacgtctttatatgtctgaagagaatgcctgcataaaacagaatatgaaaatgtgctgaaaaatgcatttcaaagccaacttcgagtgtctttttattatctgctcctttgtatcatctgcatcactgcttcccatctactggtgtctgtaactgactcaattcccttctaaggactaataagcagcaactctgagaaaactatacattgctttaggtagaaaatgaaattcaattcaaaaaagaaaaaagttaattttaagatctcaagaagaaagccagtaaagcaaggttattgttaatgctttaagcgtataattcttctaagagaaagatcattagagctttgataaatcactaacactttgagcatgagcaccttctaatcctaaatatctgacaaactacaatgaaccagaatgctactttttgcaagacagaagttcccttatgcattctccacgtttttttctgcctacacatctaaaatgttactcaactcagctatttttcccatcatagtatttaaaattttgctcttccctcttaactgagttaaaagttaagtaaaagggttattttaataaccctttgccacagttagtatcatatatgtttactaaaataaaagatatactatttgaacaaagtcactgaacattccacttttagccagttgttttggtgttatgtaaataagcctgactcttgactacctcctaatattcttgaagttatgagtagataaagttactttttttttttttttgagatggagtctcactctgcggcccgggctggaagtgcagtggcgctatctgggctcactgcaacctctgcctcctgggttcaaacgattctcccgcctcagccaccccagtagctgggactgcaggtatccgccgcttcgcccatctaatttttgtatttttattagagatgggatttcaccatgttggccaggctggtctcgaactccagagctcaagtcgtcccccaccccccgccttgggcacccaaagtgctgggattacaggtgtgagccgctgtccccagcccgatgaagttaattaaaaaaaaaaaatacaagcaaatctcagccgggtgcggtggctcacacctgtaatcccagcactttgggaagccaaggcgggtggattgcttgagcttaggagttggagaccaacccggccaacagggcgaaaccccgtctctactaaaaatacaaaaattagtagggctggtggcgcagcctgtagtcccagctactcgggagactgaggtgggaggatcgcttgagcccatgaggtggaggttgtagtgagccgagatcaaccactgcactccagcctgggcaacagagtgagactcagtctcaaaaaattaattaaaagcaaatcttattctgaatgttctagagaaatgctgtccaacagaacattttacaactatacaaaattctatttctgtgttgaatatgtagccacgagccatctgtggctactgagtgcttgaaatatagttaatgcaactgaaaaactgaatttttcatataaaaaatgtaaataaccacatgagcctattggctaccatattgaacagtatatgaacatgaacatggggtcgttggataactttcataaggtccatacaactccttgaaattgtgcacaaaattgtgtgtgttgatttattttgtacctaggtttcatcaaattttcagaggtaactctgacctcagaaaggttaagaactactatagcaaggccgggcgcggtggctcacgcctgtaatcccagcactttgggaggctgaggcaggcagatcaagaggtcaggagatcgagaccatcctggctaacatggtgaaaccccgtctctactaaaaatacaaaaaaattagtcgggtggtggcaggcactccccagtagtcccagctactggggaggctgaggcgggagaatggcgtgaacccaggaggcggagcttgcagtgagccgagatggcatcactgcactccagcctgggcgacagagtgagactccgtctcaaaaaaaaaaaaaaaagaactaccatagcaggagtactatgggctttatgtttcctgacacaaagttaaaactagaaacacggtgatttttttttatgttttaagaaaatatgcaaattcttcaacaaaaataatttcctaaagttgaattcaaataatgcattatacaattctacaatcaacatgtattcctcttttttaaaaaagaaaaactttttattttttaaaaatgtagatttacatgcagttgtaagaaatagatctgtgtacccttcatccctttacccagtttcccccagtagtatcacctcgtataacgatagtacaatatcacaaccaggaaattggagttgatacaatccacccaccttactcgaatttcactagttttacatgcaattatatgcatgttctgcacaattttatcacatgtgtaggttcatgtgactatcaccacagttaagattcagaacgattccattgcaacagagctccttcgtattgtccctttatagccaaaaggacctccgccccgtaaccccttattaactctgggcaaccactaatctgctattagtataattttatcacctcaaaaaatgttgtataaattgaatctcattgtatgtaaactttttgggattggcttttttcattcagtataattctcgggagattcatccagattgttgcacatattaatagctcctttctttctattgctaagtgatattccatggtatagatgtaccacagtttgttttaccattcactcactgaaggatatttaggttgtttccaagatttggcaattatgagtgaagttgctatgaaaatttgtgaatggctttctgtgaatgtaatttttcatttttctgagataaaggtccatgactgaaattggtgagttggatgttagttttataagaaactgccagactgttttccagattggctgtgccatttcacattcccaccaaaaaaaaatgtacgtatgatccagcttctccacatccttaacaacatttggtgtagacacattattttttttaattttagccattctggtaggtatgcagtgatatcacactgtgattttaatttgcatttccctaatggctaatgacatttaacatcttttcgcgtgcttattttccatctgtatttcctctttggtgaaatgtttattcatgtcttttataatcagacacaagcatccaaaataggaaaaagttctttttacataggaattcaaataatcagtggataatatggttttacaaaagaaagaaatgctgttcaatggggattttttttaattggctatctgctaagacagatgccctaacattaactcttaccccagtgaagatgtttttgtggaggactaggaaaataggacccaggaacaaaacttgcctttctgataccttgactgtagacagaattgagagaatacaactggagataaaagagagcttttagcaggtatcagattcaataatttcatgaatgcattttctagcaagtatctgtagtgcagatattttatgtccttggtatgctttggatatatttagatgtagtttgttgccttgttttaggagtccaagttgtatacctacctggacagagagctgtctactacagttcaggcagggcaacagaattacctgcaggctaaactactcttctcctcataaaagagattgaataaaaagcctacaatgacagtccactgcccagtgaatcaagaccaactccaaaatatgttattcaaggtcaacaaagccctaacctaccttttctgcccaatctcccactactcctcctctgtactctagccaaatgaaaatactgtttcccaaatctgctctgctctgtcctgactctgagcttttgttactgctatatcctctactgaaataccttccctcaccatttgtgtccatcaaaaatcccacctatccctcaaggtcctgcagttatccatgaaacagcccctacttccttgagtcagaggcaaacattcctgcctctattctagcacaggactttgtactccctcacagcacttatctctctgaccactcttttgtttaaataccacaccaacgcaataacatggatgaatctcaactgcattttgctaagtgaaagaagtcagacacaaaaagctacatgtatatgacaatccagaaaaggcaaaaaccatagggaaagaaaacaactgagtagttaccagggattaaaagtgggaaggggttttgactataaaggcatagcatgagggagtttttgtggtaatgaaaccattctatatcttgactgtgatggtagtggttaaatgactgtatatatttgtaaaaacttatataaccatatactaaaaagggtgaattttactctatgtaaattatacctcaacaaaaacgttaggaaaaaatcataccagctaggcagcaaactagatagcctgccctcaaattcttgccaatcatttacttgcacttcaagtgatgtgccagagcaagatctgtggctacaaaaaagatacatggtcccttctctcaagaaactgtctctaatgaaggagataggcatgtaagtaaataaatgcaatatagtatgaaagatgccatatatattatgtgtaaaatacagtgaagaggtaaaggaggaagtggtcagattgacttagattgttgaaggcctagaattccaggttaagaaatttatatattgccggtcacggtggctcatgcttgtaatcccagcactttgggaggccgaggcgggcagatcacgaggtcgggagatcgagaccatcctggctagcacggtgaaaccccgtctctactaaaaatatataaaaattagcctggcgtggtggcgggcgcctgtagtcccagctactcaggaggctgaggcaggagaatggcgtggacccgggaggcggagctcgcagtgagccgagatcgcctcactgcactcaagcctgggcgacagagcgagactccgtctcaaaaaaaaaaaaagaaagaaagaaatttatattgtattcaatatgcaatgaaaagtgacataatcatagctaggttttagaaagtataatctggctgtaatatgaaggatgatttggaatagggaagagactaaaatcaattagaaggctatttacaataatctaaaaaaaattaatatcacttctcttttctagtagtagacaattgagatcagactgtgctttcaattaaagcttatattgctgataatctagatatgtgaaagtaaaaacaaagagaggacccacagatcttttcttgataccgttaatagggttaactcttaatttaacttgtcgcattcatgtttttatcttccccagcaaatttgtaggactttgtagacagcagaagctctaagaatgtttattctaatgaatagagcagatgaattttattttaaatcactgaaactccaaaatagaaaattataatacctctatgcccaatgatagttactgcttacaattttatgttagaaatcccagagggttaaggttgataaaaatgttttgttccttaatttgtatacttaatgtaaagattaagtgggattcgtctagcacatttttccctagcaatactgtttcattgaaagtcttctattctttacttattcactgctacctattacaacttgcaatgagtgacaagggtaagattctgttgcaaactggacaatagcaggcagtataaatctactctttagtagactactcttaagcaattgattattgcctctgtcttagaacttggaaacctctgcctaaaatgccatacatggggcatattgaaagcactgacacatgttagcctgcttactggaatgtgtgtactgaagagtttttattctgttttaaatctaaccaatagaaggccctaaaaccaggagggagctatgccctaaacaccgtatagaggccaaacatatgctctcatcaggtctctaaatacctccatcatcacctaagaaaactaagacatttaatgaactagtgggatcattgaagataaacttaatgagcctcttcttcaaacaaacaagagcttcagggtttcaatttctgccctctttttccccctctcgaaaatcaaacattgctgagccacttccttgcctctgataaaagactttctgtggctctagagttggcagcatccagaatgttcaacagtcacagatttctgtgtctgaactagtttactatgaagaagataaaatattttgatgttaactgcacccaaagctacacagagacagcttagaaaaaatgtacctccccccaccccccagctaattggaagattgtcagctaagggagatgtgattttatagatgccagggtgtgctctgattcaatgcatctgggcttttttttccttttgatgttcccgttagtattttccccattaaagttcttgtactttatactgcatgatttgtggtgaagtcaaaaccgaagtcatttttgtagctataaaataccttattgttgaaggcctgcttgttccttgcctgtttcctgctaccaacataaccgtaacacttgtctaattctggtgtgacagaacttaattattctgtgaatcatgagtggcaaggcagccaatttcagttgtcccaactacgtgctagcacctggtcacttattgccagatacttgtttactccgagttattgatcaagtttgagtcctgtgcagctgccactaatcctaatgcatatagttggcagctgtgaatttgtgactttgcccccttggaatacaaaggcagcctttgcccacactcatgaaggctttaacttctaaagggtaagtcttagcttaataggtgattgtgattacatactacagtagaaggacgtttattcataaattattttttcaggagccccagccttattagaaattatccagttaggtttctatcagaaaagaatcccattgcctgtagattaaaaaaaaaaattactgcccatgggcatttttttttttttgaaacagagtctctgttgccctggctggagtgcagtggcatgatctcaactcacttcaacctcccccaccctgggttcaagtgattctcctgtctcagcctctcgagtacctgggattacaggtgtgctccaccacactcagctaatttttgtacttttagtagaaatggggtttcgccatgttggccaggctggtctcaaactcctgatctcaggtgatccacctgccttagcctcccaaagtgctgggattacaggggtgagccactgcacctgaccatgggcacttttaataacttaatttctccctaatttactaaactgattttatccatgcctgacaggtccacttccttctacagctcttctctcatttgtcctaggcaatggcaagatcatagatatttattttagatatactatctgatttgttaggctttcatctaatggaatattaagtgattcaaaatatatctgttcaattttttaccagtagtattactattttagttgagaaagaagaaacagagactccctcaatgtcacataaccagtcaacagcagagttaaaaataagaacagagactaaaataggggggattctgtggatctagtatactgagtgtcatactggatctgatgaatggattggaaatgaacctcaaatacgtggtcatatttgcagggcatagttcattaaaaacattttcctatcccactttccccaaatagttgtttttctttctttaataagatatacagaaattctcttgtggtcacaggtttaattcttttggaatcttcaccttactggaaacctgaaaaggaaagataggagactgcatgagacaagatgtttccgaggtaggtttgcccaataccagagtggggagtaaagaccactcatctccatagttccttccagcacctcccttgctcaacttacccccatgccttgggcctttccccactctttatccctctccttctcagcaatctgtgatcctctcaatcacctccctaaactcaagatagctaatttgatctcccagtagcaatcaagtgcatacaatttagctcaagttttctgcaatgacctccaccaacacaatttctttctttcttatttaaaaatatatattttttatgttttgtagagacaggatctcgctatgttgcccaggctggtctcaaactcctgggctcaagcaactctcctgcctcagcctctcaaaatgctgggattacaggcatgagccaccacacccggcctcataatctctgttatctaggatttctgggctgctcagcaggattctggtgagggggttcttagcatggtaaaatgtgtggctgaagaacacccattttttccaccttgtaataatgttctccctatgtatgtgtagaggtagtatagcagaatgaaaacagcatggaatttggagtcatacatacccctgtgtgaattccaaccccaccacctaccagctgtgtgaccttcagcaagatacttcatttttctgagtctcattttcctcatctgaaaaaatgtaaattataataggatatcattacctgttgtgaaaatcaaatgataacattaatatatgtaaagtacctggcccatagtaggctctcaatggtagttattaaagttatggatatgaaaagattgttcttagttttagatacagcgtatctactgtttgtaaagccactctctgtaattctgtcctttctttgggtgcatgaaagttttgctttaaaaaaagaatccctgtttcctaatggttgtatactaacttgagctgaccgaggtttaatcttcatttgcaagtgacattatgttatttggaagtatgctgttggcatcatgctttggcttttcattttgttttgttgactgcttcttctctccacacacccaccattttcttcttgctatctacatagagcagctgcctggagtggagatttattgtcatcccttgtctacacattctctatacctatgttgtcgagctgtgtatccagcatcacttagatgccaggataccgtttgtcccaagttgtgctttgccattcatttaatggtgagaagccagatacagtgtctcattccttgcaaacatattaaaagctgaacactatcatccatctcaacatctctatagagtcggtgtgatgggaaactaaatctgccacaatggttccctgctgttgctcctgcagaatgctgctctgtttatcagttcatcattaaatagtgaagtgctcagggcagctttcagtttagtattgctgatacaaatatttagcagggtaggcctttgtggtaggatttgaagaattcaaaaaggctcctggcccatatatatcctggcccatatatatctccctcaatggtcacagtgcctgaaatgcatacaagagatatttcacttgaactttctctttttggtataaagcaacatccaaatgcgaatggcactctccagagggaaaatagttaagtcattatcagctattaatacttaagagtcagaacggcattggaatccttcttctgttcctagctatatggattttggcaggttgctgtaattctctctgggccagttttcccttctgtaaaactgtggttaataatagatacttgtgaggattaaatgagataatgcatgtaaaacatatagtaaatgctcaatgaacagtagctgttattagtcttagggagagtaggactccgagggaatatatttgggactagtaaatttgatttgtcagatataaggtgaagtctggtacagggggactgctcagagcaaaggtcctggtggagtagtgatatggccagggagtagcatggaaactctgggggcctgggtttggaagaggagggtggaaggaagaagaaggactgaaacagggtgaaactatacttaaattaacttcccaacaagaaaagtgtagtcttactcaggatgggatgcttggtgaggtagtgagctctgacactgggagtgttcaagcagatgctggatgctagctacctgtcaggaatactctagtctaccctagggctcctcaaacatatatacatgcagatcccctggggatcatgttaaaagacaggttccaagtcagttggtctgggtggaacctgtgattctgcatttctaaccagctccctgatgatgctgatgctcctgatcaacagacctcactcttggtagcaaggctctgttgtagttagaaaataactcacagtgaaatagaggaatacggttgggtaaaaccagtgggttacccaggcaagtctccatagagtggaagtactttgttgcagtcatgatctacaatctggttcttagctttgtaagcctcgaaatttgattggtagtataaccagagactgggtttctggggactgactcacacttaaccaaattcacgagagaccaatatataagccagaatgccagttgattaatttataatgagaagtacaacttccaagtggaccagatactagtgtttgctaatcagtacattatctccctgtaggcatatttacatgaggagctaactgataataagtagggttgctcggtgaggatgaactcagagcaaggggggttcataggatgattttaatgactcacgttatcaagctatggtagtctgatacctccattccacaagtgtctagacctccagaatagttctggagatattggcctcctcactagtctctttttcatcagtcttgtcctcatacaatccatatgatctctttaagttcaaatctggtcataccattcattcgctccattgacttcaatataaattcacaattttaaactcattattacaaaatgtttaaaatactgtataagaaaagtaggaaaaaaagtacaatgagcacccatacacccaccatctagatttatcacttgttgtcattttgccatatttgctttatgtatgtgtatacacatgtgcatgcatattgagtccgtacgctttaatataattttctggcctggcgcggtggctcacgcctgtaatcccagcactttgggaggccgaggtgggcagatcatgaggtcaggagttcgagaccagcctggccaacatggtgaaaccccgtctctactaaaaatacaaaaattagccgggcatggtggcacgcgcctgtaattccagctacttgggaggctgaggcaggagaatcgcttaaacctgggaggcagaggttgcagtgagccaagatcatgccattgcactacagcctgggcaacaagagcaaaactctgtctaaaatatatatatatatatgtatgtatgtataattttctaaacttttcatgttctggcacaagttatttgactagcttcacttcccttggctccacctttgcaactttatatcccaaccataccgaactactgaatgctagttccctgaatgttctttggagttctcatataatatactcttgcctgtgcctgaaaatccttactctctttgcttgggtcactccatttgtacttaaagactcagtcacacttgtcttgccctagcgccttatacttttctcagtcataacatgtattacactgtactgttattgatagtttatctctctgattgtctcactagaccatgagctcattgaaggcaagggctgtttcttttgtctctctacacccctgtctctcccatgctttgcacttagtaggtgttcagtgatcggaaactcaactgcctatcacacagttctacctggttacatcataggcacctcaaaatcgacatatctaaagtgaactcatctctccttctacccattctatacatttaaaaccctcctcctgtattccctgattgaatgtcatctagtcttccaagtcaaaaacctcagagtaatttctaactcctccttctctttcatcccccaaaccaagtcctgttgattctaccaccaaagaacattcccattctgcccacttctcttcatgtccactacctgtctatccaagccatcttcatctctcacctgtagcactgccaaccatcttctgtatgggctccctgctgctattctcattccctccaatctattatccacagagaaggatctctaaacttcagatctgattctattactccctgattaaaccctgattatattactcctcgtttttggataaagtctaaactccctagctttacccaaaggactctcaagaactggcccccatgtacctctccaacatgatctgttaccaccctccctctgttactttaggttccaaccattttgcatttactgggcctgtagtaattgtagcttcctaacatttctttttcatatttcaatgcctttccttgtgttgttttctgcctagaaaagtttactgtctcaaactcagcccaggtctaacctcctctgggaagcttttccttacttctcagtctgggttaggtgcttctctgttatccactactaccctgtcatatctccatcatagtgcttacactatatacatatatcactctatactgcactttccattttacttgtccttctcatcaaaactaatttatgagcttcttgataggagagttgatgtcttatttgattttgcaccacaatgctcagcccatggcttatggcagatgtacaacaaatatttaagaaaataatgaatggaaaaacattaataaatgtctctctgaacttcatttttgtagctataaaataccttctttcttctgaacacattgtttcttcaaagtacaatatagttggctgtcattcaggtaatatcaattgaattttgaatgctcttcaccagcaaaatcagacaatttctggaattgtaccatttctcagaggtggttggtcctacccatttttcccctaggtaatttttatctcagagattaccatcagtatttgggggtaccatgctattggtctcatatacccactttgacctctaaagtccttttcaatacctaagagtatatgtttcacaaaattgcacatttatttatgttctaggtgttgtttggtatatgatgttaattttcctctaggtttctctcaagccataagagtatcaagtacagaattggtccatgcttaatctttgtaaataacattgattaagtaaatgctgggccagggattgaggggagtaattgatcagaaatttaacaaatgttgagctgcataaagtagactgtatttatttgaactgaaaaagtggctaagactgaacatcttgaacatcattttctctgatattacctcaaattaaaactttaatattattttagaattgtgtctctgaacctgtttaataattttaacatgttttttatattgctaagcattgttctaagtgctttattacatgtattaactcatttaatcatctgaaaactctgtgaggtaggtgcaattattatcccccttttacagatgatgaggaaactgagccacagggaagttccccaaggtcaaaagttattcataactatcagacagcaggtatattaattcagcttaattcaaggctcatttgttaaccatctagtaaatataatagttgacagggtagacaaaaattgaatacttaagcaaggataaatcgtaatgtaataatgccatgagtgaatcgcctaggcgagtcaggctcctttcagttagtgggaaatggagaaagattatgtagttaaggtcatgaatagcgcaggaacatccgctagggtaagtcaggtttgtgaaaaatgcagaagaaaggcttggttctgaggtgtgtgaaaacagtcattcttttgtgaggactaaaattagttttagaagaggcatctgatgcggtacatgaaacctagggtaacggtgaggaaatacacatgtatgaggcttcttaggagcagggaaagagaaaggtgccatttgaagtcagtaagaaagggtaacagcgcgcttttcctgcccttcccccctctagagaatcagtaaatagcctgattctactcaaattccttccctacccaaattcccttgactacaactcagaccctttggatctgcgctttttagaagtactgtacttcacattctggcaccgtaagcccgaaatgtcctttaggcaaatgttaggagggaaaaatgtattcttgcaattcaaaaccgactcgaatcctgccagaaagctttatgtttgcggactttatcgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgcagctactagattgcacccctccagacctctgccatggccagtttctcttattttcctcattgccctcctcgtcctatccccttgctccgaaggaaagtgggtgctctttctgtccccacggagtggggcagggtcctccccgagattcaccaggcctgggtgttgggcaaaaaaaaatccttcatttgcctctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtcttagagtctgggttctctcatcagtcaaatgagaatgaataataagaaaacttatccacaagtttgccttcaggataaaatgaaataatgccttaaagagtttagtgcagtaaagcacatcatccactctcagtaagggttagctgataggattagccttctgggagtcactggaaggaagaagctgcttatttgactactggaggttttctgtttttcttaaaaccttatgactgaacctgcctagagagcacttgtattgagtggctggatggcgtaatggaaagaacactgaattggaactcaggagatttgagttcttttagccccttctttgcctctaccgactttgtaaccttgtacaagttactcacatgtcaaatgattgtataggcagtggaggccaagttagaagcgtgtactgaaacaaaacaaaagtagatgaactctaagatccctttcagatctaaaatgctatgatttttagtttttatattgattaaaggagaaactgtatctctcttggccgataattcattgattagaatgaatcagtagcttttagaagttactgaaaatcaagaataaagacctaataaagtttatagtctttatatttcagttgactgtctaatagcaagggtttgactttgtcttctaatgagattcatttgcatgaatgatttgtaattgaagagtatttaattacagagtcctacttagaccattttccttttacttctgttaagggtatttatctgatagttttaggagacaataaaattaacttttgcttggctcccactatatgccaggcactctacatacatattacttatactttattgagaggcaatatggtgtactaagaaaaacacaggcattttagtcaagattgggaataaaattctggatttaccacacaatagctttgtgtccttggtaggattatttaactttactgagccttggataccccatctgtaagatggagataatatttatgttgctgtgattattaaggattatatatatatatactacccagctgataatagtcactgaatgttataataggttaatgctaacaggatgcaaaaaaataatgtacaaatgtatgattgtgcaactgtcgatttgaagacatgaatacactgagaatctaactatgggtgttgtgtttcaggataccatataggaataaagccctaaatattgatcactaaattacactacattcagaaaagcattttgatactttaaaaacaatattatctgagataaaggctataccaaagtttgccatcaagctaactagataaaaccagcaaattacttgaggtaaggaatcacatttctccttgaactcctggaaaaactatttttcaatatagggggaaaatcactgcatattatccacatgtgttattgaatatttgtttgcaaagtgttatattgtttgctttactcattcctcagagtaagcctagggtttccttttaacctctggtcaaaaacttatcttggatcatagtggcagagagataggactgagatttaagtatggattagttcattatatattgctgtgaattacgaaggggccaccaaatgtggaaaagccttctgtatcttctttgtttacaaaatctctcttcactcactctcataggggcctgcacttgaattgtttgcccttggttagagtttgtgctgagtgtctatattcccacctaactaatttagaacagttgctttaaaatttttgtttaggagaaagaaactccactatataagagcaatcaattaggaaaatgagacttttatgtataccaaaatttttcaaaagttaattgtagcctaacatcaactcatgcagtttatttctgtattttgtttgcagagtattcagaaaattctgattcacacagataaataattgcaaatgacagatgcttattggcagtttggcttgcaatctctggatatatttcaatcaaatcagtgcagaaacctgaaaggaaattaggagaaaatttttattccaaagtgtaattactattcaaatttcttatcttaaaaatgaaagtcagataagtggccaaatcttaaagtaagcattaaaaccatctaaaatgtaagattgtcacgagacacgttaagcatgttctcactattgcacaacaaactgttctgcttacgccaggcagatgggcctgagctttgcctggtgtctaattgagcacaacccacaggttgaagagatatgtatacttgcttgtacaattttccttgagtcaacattgtaggcatgaatttattgaaagactggtgcagaactacaaccttcataattcatgaaacatttacaacgttatgcataaaacatatgcaaagggatgtcaggagaagcattattcctgagggctgtaaaaaaaaaaagtgaatgaaccaagcagtttaattaatgatttgggggtctccaatgggatacagtttgatatataacacagttgcttgtgtacattgttgaaagatagtggaacagattagttaagaggttgtgctctgccaattagtattttttaaatcttaggccagttattttacttctctaagtctcagttttctcctatgtaaggtaggcataataataaacttgcctcctaaggttgctgggattcaatgagataatgcagataaagcgtttagcacagtgtctgacatataggaagctactattatgttttaatcacagttaaatatattttagaaaatgaaagttgaatcctgtgtttgtagaacataattggaaatgaacagtctagagtacttcaaagtccacattacctgaaattctaatttgatccctttaggtacggagggtagactgaattttaacaggaaaaagatcttttggtcctcctatgtttgttgtacttttctcaaataactgcttctccctcctgctaccaatctttttccgttcacagaggaccttggaatagtatgtttgtactacttaatcaccacccaatcccttctcaaccattttatatttaagttttattctactttttctagaatgttgactttgaaaataaatctttttttaatagagaagttcaaaagggattggccagtgatgattaaccaatgtaaaatactattcccaaagccattttcagatgtagccttcttggtacctctgcaggactgtatttgacactgttgactgcctctttaaaactatcccaagtagtgtcttccttccttgcctctcttttgtttcattactattttattaattcatgcatctgacacttctcacttgcatcccagactcctagcactcctcctccagtaaatagatgccacatcctgttgattctggcactttaaacattctcacatatgtctccttcttccttgctttcaataccctgctttcagttcctgtgtcttctcatgggaaaaaatacttagcctcttgattggtctccttgcctccagtagtttttttcctagtatgcagttcttcctccatgccatcagaacacagctctgatcacatatatgctattacttataaattttggactacatttatcagcatggcatataaaactcctagtaatctgatcccaaactacattcaaagctttatatgtctcttctttcatgttggtccctaaacattctctattcttttccactaacattcctttgcttctgctattgccaacagacctgtttttcttagctctgctagtcaaaaatttacacatccttcaaaatgcaacacaaatgcctcctcatctttgaagcctttcttaattctttcttttcctcttcccagcacagcccacacccaaaacaaagtatagtaatctctttttgttccaatagcacttcctctcttatagtacgttctgcattttgctggtaattatttgtttacatattttaccttctactggattataatcattttaatgttttgttaatctttgtaatctctatagaaacctttgtactatacatgctctagaaatgcttgctgaattgccttaaacactcaagaactctaatgccagaagggtcacaagattcactagaaaagtatctagtggatcggaattcaattcatcgagcatttatcaaaggtctgctgtctgatagatactgtgcttcttgcctgagtatacaaaataattaaggtaaagtccctgccctcttaagcaatgtagagcctggtagaaggaagaagagcatacaggaatagagtgtacacatacttcaagattgctggctaacttctatggtgattagcctggttttatggatttttaatggcaaaatgccctaggtaacaagaaaataatgacaaatgacttttcatattgagttttccctgtgctggggtgttttatttttttgatcttttaaaaactacaccagcattatatttatgtctccaattaaaatgcttccattgaacatgttggtgaatgtgaaatttcataaagtaaaaatcttttttaaaaaaaggaaaatagagtcagccccctatatctatgtccacatctatggattcaaccaactgaggaggaacaatatttgggggaaaagaagcatctgcactgaatatgtacagacctcattttcttgtcattatcccctaaatgatacagtataacaactatttacatagcatttacatcatattaggtattataaataatctagagattatttaaaatatacaggaagatgtgcactggttatatgcacacattgaaccattttatataaggaaattgagcatctgtggattttggtatcattgggaggtcctgaaaccaatcccccatggatactgagggatgactatatagcttgatcagtgaattgttttctaagcacataaataacttttcccccctcagtccctggaagatatgtgttttcaatacagaatgccacattttaactctgttcacactcaaatggacagaaaagaggagagtactaaagacattttctaagtaattttctgattataaaattaactgttatagaaaacttgaaaaatacagaaaagtgtaaaactaaaatacccataattctacaacacagatgacaccattaatattccttcttaccttgatttctgtacataggcataactttgtattctacttttgtaatagttaattttttataaatattaatgtagtaataaaatacagaaaaaaatgaaaaaagatatacaaatctgttttagcattggggggattagtcattttattcttttttatttatttattttttttgagacagagtctcgctttgtcacccaggctggagtaccatggcgtggtctcagctcactgaaacctcctcttcccgggttcaagtgattctcatgcctcagcctctcgagtagctgggattacaggcctgtgctaacacacccggctaattgttatagttttagcagagacagggtttcaccatgttggccaggctggtctctaacgcctgacctcaagttatctgcctgctttagcctcccaaagtgctggaattacaggcgtgagccacagtgcccagcttatcattttattcttttgctctgtatatagatatattatttaaagaattatatactatatatactagttttgtatactgctttctattgtaagaatttctccatgtatctagaaatagaagatggtcctcttgtagttgaaggttgtggtcattgactgagagttggggattgagcctctctttctttagctaccagaaaggaagtgaaaaaatggagatggggagggttgtgaattggggcatttaaataaaaaatatgcttcaccgaggtttacattgaaatatacttactagccttaaacatggtctgatctaacccatatgcattgcctattgtggccttggtatttcttagggtttgatcaccacttgtgcttcagttcattttctcccccaatattcccataggtaatgcctttttatttttctttttttatgtcttcttcacaattgaggtttgcacctggtttccctgttgcttttaagtagcttttctattataatgatggctactgaactataaactattgttggtgtttaccccaaagtttatttgataaggcaccataggtatttcctgggaataaataatttttgtatatgtaagttctatcgaagtataatatacatcccaaaaaggtacataaatcattgatttagctcagcgaaatttcacaattgagcacacctgtgtgaccagcgccctgctcaaggaataaaatagtaccaaactccagaagagcacctcacgctccaatatgaagaatttttgatgtagcacaattatcaattttgtttcctgagggaatgccctcttgcagcatgtggtaggagcccagtcacccacagaaatattctcctcttcactgcactggggttattttatggtggtgatcctcagctacataccgtagggagttattaccaagcacagagtatatgcacctttccaagccagttcagaattgccacactttgctgtacaccaccaccttggagccctatgggcaaagtggaacacaagggctctttgttgtgttatttcctgttctgtccttttctttttcagctgtgtgtatgtccttccatgcaccatagcacgtagttactgcttgaatttaccgatagtcttagtgcaatattgatttatttattaaggaaagtttggtgattcatgctgacctctgggaaactggacttgatgaaggttgttagctccagaatctgctcatgaattacttgcttttaatacttgaatgaccaagttggtacaaatcagtaattctgagttaaccctattcattttgaccttttttgaaagaagatagtccttgagctcaatagttgatatatgtttctctttaaatgttaacttgtcatttcagacaaaatgttgaaatagcttagttaaatactgcctgcaactaaaagcgtcttagcttttaaaaagaaaatgcaccataatgttaatattgttggtgaaattataggagaaagtatttgttctcttcattattatttttctatattttctgactttcttataatgaatgttttacttttataatcagaaaaattcgtagttttaaagaacccaaaatactccaaaattattgatagatcctaaagaaagcattactaatgtgactatagtgacaacaggaacaaagcatatctgctcatagaaatgatttacaaactattatgagaatttaagaattgctttggccttttgaatatagctatctaatccatatgatagttggtgttaccttttattgttaacactggtttcttcatgtgccttgacgactaaaagaattttcaggactgacttttcctattttaatatggaatctttctcttctctttacccattgtatcactagctttttttaccctccccccaacacacacacacataaaaaaatgcacattccatgcctttctttgtatttttgtttttttttcccgtaagaggcctgcttaccctcattagcccccttcagtatccattctactcaatactgttaagattagtgctaatagctcaatatgaagaattcaatatattggtaattttcatccatgagacactgacttcatctaatggtgatagattttgtcattctagaaaataggaggaaattgtattagattaagggcagaagggaatcgtgatattcttattttacactttattaatgatagaacacacaagctcatttaaattgagttacttgtttttaaaatgagcatttcccttgggattttattcagctatataaaattccactagttggtggtttatacaagaaactgtcaagttccaaggttgctttggtaccacttattttcctcttagaatgtattttgtgtcatacttttctaccctcctctgtctttcataacatgattaattttaccttaggtaatcttacacatacatacacacccctcttagagcttctttttccttttcaaaaattttgtgcttccttctatgtgattccacttcttttgatgtagtagtaaacattatagcaaaccagtactctcaaaatctaatgaccttgaaggtgtccataacttactcccataaattctataaaaaccacccattaaccatgtaatcctcctgattaaatacacatttccttcatgtaccagtattcatgataaatttgatgtgcctttgttttactttagatattgcagtgatactgctttctgaaaagttttattacaaatatgggttaaataataatttatatttgctttgcagttttttgtcctcaaagcactttcatatgtaataatctttgagctcatttgagaacccagtgtttagcaacattactgtgggaaaatatgttgtctctacttccaaagaactggtttacaaatgaacttttaaaacataacctactagtgtttctattgtggctgttcattatgatagccccatcgagtatggattattatattattcccaaccatgctggtttagggagttttaattcagtttctgtgtcatgttgaccaaagttctgtctcaccttttccatgtacttcaccttaaagactacattttgttttcttaatctttgaggatctcagatgttggcttatcttaagagcatttgtaatgtccctaaaagtcttaagaatgtatcttaacttgatttgtggcttagttagtcatcagtagattttctttttttattattattattataatactttaagttttagggtacatgtgcacaatatgcaggttagttacatatgtatacatgtgccatgctggtgtgctgctagattttcaagtacagttgtccattggtgtctgtggaggattggttccatgacctcccgcatatactaaaatccacagatgctcaagtccctgatataaaatggcatagtatttgtatataatatatgcatctcctcctatgtgctttaaatcatctctaaaatacttataatacctaatacaatgtaaatgctatgtaaatagttgttaatagcattgtttagggaataatgacaagagaagaaagtctgtacatgttcagtacaggcactttttttcccaaacatttttgatccttggttagttgactccatggatgcagaactcatggatatggagggctgactatacatctcttatcttcgaagatttcaacagtcacttggatgaaagctagaaaaaatgtgattatactgagtgagggtttcattcatagaaccatgggcaatctatattgaacacaattccaaaatactttcataggtgtgtttcaatcaaattctttcatcaccagttcattttggcaaaagggcaggatatgtaagaaagactgaaactggatggtgtgaaatcaccaattacctcccttggcacaaaccataactgccattatttttgctgctcctctatggctgatgctttttggttgaactggctagtaagacaaaagaattgacttactttgagtaatgtaattaaaggccaacagatcatcatttgatggtaaggaaagctatttgattgctctgtttttatttcaacctattgtaccaaggtgaatgtgttccatttgaaattgggggacagcatattgcaatggaagcaggtgtccttgagtcagacagcttgatttgaattccagctctaccaattaataaatatgtgatcttgggcaagttgttaacctagaccttatttatcttgttcatcaaaagggggataataatacctacattttccatgatattataaatcaagtgtttggcaggtagtgagcatttagtaaatgctagttctcttgaacctttgctaataatttcattactactaaacataatacttctccattggttattatagatatttactaccacactttgaaatatgtaattgtttcatatgtagaagcagaaaaaacggaacatccatattgcaatttttctgggcagttcctgaaaaatgcaggaagaaatcacataatcaagaaactgaaacgactatattatcttccttctccctggtgtatttccattttaagcaaaagcaaaaccttaaaatcaagatattaagctctaacaatggaaatggctatgacccttttgctggcacagtggttaagaagaggggacttaggaatcaaatggatttggtatgagtcccaactctatcatgtaaaactttgtgaccttaaccaaattaatctaagactcagtttcttctcccatagaatgggtaatataattgtctctatgtcatagggttattgtgaggtgtaaattaaataatatatgtacagtgctcagtgcacatcctggtttattaaaggatagcttgaccatctccttaccctcatctatagcccagctttggagattggcagtgtatatcactgcagggcttcttagagcctctaatatgcaaaagaaaccctgtttgactttgttcaatgcattattttctgaatttatctgcagagtcctttttgtctttccaaatacttaacatccgaaatacgatttgggtagcactgattatcagacacttaacaatttctctcttctattctcttctcttctcttccttccttccttttttccttccttccttccttccttctttctttctgactttttttttgagacgcagtcttgctctgtcacccaggctggagtgcagtggtgcaatatgggctcacttcaacctctacatcccgggttcaagcgattctcctgcctcagcctcctgagtagctgggattataggagtgtgctaccatgtccagctaatttttggattttagtagaggcggggtttcaccatgttggccaggctggtctcaaactcctgacctcaagtaatccgcccaccatggcctcccaaagtggtgggattacaggcatgagcaaccatgcccggccctcatattttaactgtgtcaaagctttgtcaatgtcagagactaaccaataaagttaacctcagtatgataggaacagaatatattcaatgtgatgacaaatattctttttttgtactaatatggtagcttttatatcaggtttatgtggctttaaagtggttctacatgctaggtttattctctttactgactttcagaaacaatttatagtgaaaagataaggacataagtgagacagattcatgtttggttttataattcatgtgtggaccttaatgtagaagctagcttttgtaatatgtcatacaggaggaaatttaatatactcaggtactagaatgttcttttttatagattttttggtacctatatgataccaaaagtcatgcagaggcatcccaaattctccttttctctaatttgagtacataatggaataataactaattggactactggaactcttgcacccttggattttgtggccaggtcaaaatgaatacctaatctctcaacataatattcttcctaactttaatgacaaatgcaatttccaacccaatccccatattaaaaactatacctgaagagaatgcacataagaagaagcaccaatttcaataaaagtttgaatgcccctttatgaccagcattatgctgaatgttgtagtaggagaaggggagtgtgtaagcagcatgctcaaaacaatgatagtgttttttccttccagggacctcacatttttagcctctgttgttgttgttgttgttgttttgtttgtttgttttgcctaataatattttagtctggcacttaaatgtcaatttaggtagggctttcagatctacacaaaaaaattgcattgactagagtttggcaacatttaaggtacagagtacaggtacctttcatgcattgttttactagttccacctggtctgaaaggttcaggataaagtggtgaaggtcatgtcccagtttcattgtaagtctaggctatgacctatgcctgtacccatatgtttgctcctaaataaacaattgaataaacagtggaattctcctttacaagggctcacattataggaaaatacaaccaacaaataatttttactttttatttttagagacagggtcttgccctgtcatccaggctggagtgcagtggtgcaatcatagttcactgcagccttgaactcctgggctcaagcattcctcccgtctcagcttctcaaagtgctgggattacagacatgagcaaccacacctggctagaaccaaaaaataaaggacaaaaggaacaccgtaatttctaatgatcatttgtataaattttctctctctaaaacctcaaagtctcctgtttgctcctttttttaaactgcccgacaaataatctaattatttttaaccacttgtgtatatcttgttagtcatagttgtttcaccttttcttatcaaatagtcctatcagattctgaacagctttttgtatttcatagtttatgggattgaaaatgttgatggtatagagtttactgactagcattcctctagaaaacataaataaatagcaactgcaaatgttaaatctggcttctagaaaccttaccaccccaaaacagaaacaatgacaatagaaaacattggcataaaaattttaatataattacagaataccctatttatcaatataataacatatacactataatttctgcctggccttgcaatagcatatcttatttttttcctcagtatcagcagaaatttaaggttttatagagactcaacctgttctggatgcttcaatgcttctcttttatgccctctgaaattcctcataaccatccaagccatcagcctactagtgaaccaggatgactgtgttttaacttgagctttgggctaaaatggcatgtgtaccagcatctgaatggaagtttgaaactgaggtataccaaagccccatgttggaaggggattatttgtcaccattaatgcagctctggaagtatggtaatttcaacagaatcagcactgtggcaataagcattccactaaacccaaggtctataggatagaattagtatttaattttttatctgtttttgtgataggtctttgctgtaggcagacatgtcttgtctagatatgccatctttatatagagagaggacgcacaccttagactgttaaccacagttatctttaaaagatgaatttgttttcagattaaatcaaaattcaaattatcactaaatatattatacttaaaattgcattcatcagaaatttatttgacatgtgttatgtggtaggcactctgctagttgctatagatacagtgatgaaagacctagtccctaacatgaagttcatagtttatgaaggacaaataaaccagataactttaagggaagtctgtagtagatagtgtaaaagcaggacatctaacgcagtcaggtcagaatcttataaaaggaggttcaattttattccgtaggtgaaatggagctctttaagggtcttttgaaaaagaataatgtactttttccttttagaaatgtttcattagtagccatgaggagaatgaattagaagtctaagactggtggcttggagaccagctaaggggttgttaatggtgatttaagtgaaagataatggtgacaatggagatataatataacaggaaaggaatgggactatttctgatatagcaaatttttaaaattctatgtgaagtacattacatactgaggaaaacaaaataattctattggcagagtttttctctgcatggtaaaggattggcattgatctggacagagggaatagactgctatcttgaaactctttgaccttaatgtttgaaaagctataaacaaactccaatccagtatttctcaatgtattttccacagaccacatgcagcaaaataacccacagaacttgttaaacctgcagattcccaagccccaccccagacatactgaatgaaggaatggggcccagagagctcagtgttttaacaagttttccaggtgattcttctgcctattaacgtttgaggatcatcgatccagcacaatggttctgaaattatgatctggggactactagtctctgagattctttcaggggtccatgagatcaaaactatttttataataatacttacacattgtttgccttattcactgtgttaatatttacacagatgatataaaagcaatggtgggtaaaactgctgtcaccttaacacaaattaagactgtggcaccaaactgtattaattgtattctctacctccatgcacttcaggaaacagaaagtgctagtttcacttaagaatgcccttgatgaatcaaaaagaataattaattttattaaatctctaccctgcacaactatgtatatagtgtgtgtacatattgatatacatatatgtatatgcacatatatatacatgtgtatatatacacatatatatgtatttctgtgtcatgaaatgggaagtgggcataaagcacttcaacagcataccaaagtatgatggttatctgaaggaaaagcacttgtatgactgagtcatgagatgaaatagccacttcaaacaactctttaacttgaagatccactgacaaacaacagttattcagacttcagtcctatttggaagatattttctctaaagttaactgggtgagcctgtcatttcaggaaaacaaatgacaatatttgttgccaatgataagatttaagtttttaagcaaaaatcagaattttgaaaaacttttatctactatgtaagcataacttcccaatacttagacttttctaatgggatcaatggtgatattaacaactgacttttttgttattgttttatcttgaaatgagtcaccatataactgcataactcagtgaatctgcataactgagtctgcctaactgggatctatgtaacacagtgagccaatattttccaaatgaccaatgcatgatattgcaaaaccccatataaataaaagatccattcaatgtgtgagatagaccaatggattttcatttaaccaagtagaaagaattcattgatattgtttcaaattctaccttgcacatagtatttaagaaactaccatttgttgagttttggtgtagtatcaaaggataatatctacagttatctgaaaatgctattgagacatccatcagttttccaattgcatatctgaatatagtttcccttcttgtgcttatttgacccagccatcccattactgggtatatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatggaatactatgcagccataaaacatgatgagttcatgtcctttgtagggacatggatgaagctggaaaccatcattctcagcaaactatcacaaggacaaaaaaccaaacatcgcatgttctcactcataggtgggaattgaacaatgagaacacttggacacaggaagggggacatcacacactggggcctgttgggtgggggaaggggggagggatagcattaggagatatacctaatgtaaatgacgagttagtgggtgcagcacaccaacatggcacatgtatacatatgtaacaaacctgcacgttgtgcacatgtaccctagaacttaaagtataataaaaaaaagatttccttcttgtgctttaaccaaaacaacatatcactatagatctcatgcagaaacagctatgaagattcagccatcttttattacatctgatattacaggttggcacaaatgaaaaacaatgccactcttccttgttacattttgttgggaaatatagttatttttaatacaattaggttaattactttaacatgaacttatgattattttaaatgaatatatatatatattgagatggagtctcactctgtcacccaggctggagtgcagccactgcaacctctgcctcccaggttcaagtgattctcctgtctcagcctcccaagtagctaggacaacaggcacgtgccaccatgcccagctaatttcttgtatttttagtagagacggggtttcaccgtgttaaccaggatggtctctatctcctgacctcgtgatccacccacctcggcctcccaaagtgctaggattacaggcgtgagccaccaagcccagccgaataaataaataaatattttttaaattcctccgtgttaatttctaatgtggtaaatatcaatagaaataatctactaaacaaaagttatttggagttctcaataactttaaagagtgtaaaggggtcctgagaccaaaaaattggagaattgctgatctagcccttaggttctatgtgatacgttaaacataaccactagtggaagtcagaatagttcaagcaggatcaggtgttttatataatatttctaagaattgtttacctatgagtgtgacatgtcatccacaaattattcatctgtgaccttttgaacagtgtcatttctaattccctaatgtctttaatatactgtttcctgaggactccatctaccagagaatttttgtgctatatcaagtatgtgacccatttcctaatgtattattgccttcaaaaactacagcaaaattatctagaggtgcagggcagaaaggcaacttgctgtactctacattagctatgtgcctttgttgattttaaaaaatggtaataaaggtgatttgggtcacattccctgcgatacaccctccctccaaaagatgatctgtgataatccagaatattaagaaccattgctttaatcaacagctaatctgtactaatgcctattctgcaacagactagattttaacaaaaggctagataggaggtgtctaagttcatttgtgtggctataaagaaatacgtgaggccaggtaaagaaagaaaagaaatttgggggccaaataaaccatattcaaaccatagcaggaggataatcactttatacaagggtatgcactactgattttgtctggttcctagtgaaacaccgatatataatccagatacttttaagaaatcacttgtgtatttgtttctttgatgaggtacactgatagtaaatacatatatatattgcaagaactgctatgaaggaatcaagaaacgcaaatttggttcatctgtgactgagaccaatcaaaaggaaacaaaaaaagttgccactaaacaggactttgaagaaagagaggctagtttggcttaaaagtttagattttttttttctgttttgaaaaatcactacttaggattcttggtctgatgaagtttggtatcaccctttgaaataattgtccttccccagttgtctgaagagtttgggatataggaggaaaagccaagcctttgaaaagctactgtggacaaaatgaatatttagaagtccacttgaattggttccagattttataatggaggaaatgtttgttacgttggaactctttacacctagatcttgttcattctggatatcagcaaattcagaagtgctgaccctattgtattatcaggatgtttggacagtattgaatgtagttttataagaagaactactttgcccttcagttgcccttattattctcattgtgaataacctctattttctaatatgttaatattagaaaatgttagttgaaagagatactagaacagcttccttcaccttgtattttgtatttcaatgccaaggtgctgtaagtatgttatcactatgctagaatatttaatatattgtaaaaatattttagaatttattttacattttaacacgttaatattaaatgtggggaaaaaaaggtccagaggcacagaacttattacatagttggtgcttaataaatatttgttcagtgaatttgtgtttacaaataagattagacaaaaaccataatatcattagctttttgaaggaaatgaaagaagttggccaccagcaggatcctacagtggatttctatacgttgtgaataataatttttccccaataatgcccaagatagacattctttgtattaacattttaattgaatgatattcaacagcaataggtaagagttgctacagcttatttcattacctttgttcccaagataggtaaatgccaaaaccttttttcactgttaaacatttgaaattgaatctctatttcttcttctacttaattgctacctatttctaatctgtcccttctcctaagatactttagatagcagaatgaaaatgcatgaaactctagccatgtctcgttattattaatgactattaagcttgagaatttctcctagaattggaatctgtaactactatatacatttgttgtatcaagataagtgtgctttaagttataatggactcaggaatctatatttaagtaataagggtccagattaactactcttgatgactaaattgtcaaatacaaagtggtataaatacactggaattataaaaatgacagctttttctgctattcaactctgaaaatgtaattattagatataagatttatgagtaaatccttgattgatctctacaaatcagataggcatttaacaaataaattttatagtttgtgttaatgatttttgcctaacagtccatgaaagaaaagggtgtgaatgatctcacaattacctttgaaacaaagtacagatttagaaagattgaaatcttgaaaagacagctgttctgtgattggggtttagactatctgttgtccaattatcagtttttctcatcagatacttttagcaaattaaggacttttttcttttctttgggatgagcgctatgtttgtttagaaaaataggatgaaattaataaatgatttggagagattctataaggatagaagaaatgtagtgatcttcctttgccagacttgattatagaaccttagaaacctagcacagcctgacctccttcatgcagaagatgcaacccaatcttctgatcccatttgagttactttggctacattatactgtttctctctcccaaactgtagactgtttcaggttaccagtttttaaataaagaacactatcaagttgagaaatatcaaaaccaatacaaaacaatttgttattttacaaatcattggacattgaaggaaaataaattttcctttttattctacttgtatcagtttgaaatgtgatttgggaattattattttctactactggccataatagtagatatatacaattcatttcactggcttggatcatattcttcctagtgatgaatatctaacatacggaagatatttgcaagtgtgtagagggcagggactgcactttattactctctatagccccacaggctagcatagtgccaggcatgtgtgtagatattcagtaaaacacttaatgaatgaaattaagagtactgtctgtcttctgtataaccggtccacaagaaagttaatggaaccatagctttgatcttattagtgctacgttttaatcaactgagctatgtaacccatttttggcttcttaagcctggtactttccaaaggaaatagttgttacagtgaaattttggacagaaaagtggaaaactctagaacttgtacaggaatctatgtattagcatatcaacattggttttaaagatcagctctcaacattttgagaaaaaaacataattttacagactgtggtaaaactgattccatttgtataatatggtgttgttttattatgagagaataacaaaatttgctgataagcaaaactcagcaacataaacaacatagattcagtgatatggtttctgttcattggacttgtgttcttgagggcctgaactcttgttttcaaagatcaatttttatgagcacttaaagaaatgctttgatattgcagcactatttacaatagccaagatatggaatcagtcatcaaaagatgaatggataaagaaaatgtggtatgtgtacacaatggaatactatacagccttaaaaaatgaaatcctgtcatttgtagcaacatggatgaaactagaggatattgtgtcaaatgaaataagcaaggcacagaaagacaaatgtcacatgttctcactcatgtgggagctaaaaaagtgaatctcatgaagatagagagtagattggtggttatcggaggccaggaaggggagggatgaagagaagttgtataaggggcacaaaaatacagttagacagaagaaataagctctagtatacaataatacagtagtgaataacttacagctaaaagaattgtaatcttctcaacacaaagaaaaataaatatttgagatgacaaatatcctgattaccctgatttaatcattacatattatatacagttatcaaaatatcacatttatcacaaaaatatgtacaactatgatacatcaatttttaaaaaaggaagtgaatttttttctcaggcaaaagatgatattttaatctatctttgaaaaaaatgccatccttcacattttccaaaatcttgtttaatatgagaaaagcttctggtcctgtgtatgttttaaatattcccttcactttctattccctaacacactgaaaatcgggagattaaatatctatgataaattctgaacatgaccacatctatattgcttataataaatggctaactttacatctgaatgttttgtggtcctttagaaagataacttacaaagtcactaattttaatttgaaaggtttggaattcgctggcgcattataagagaccctttccaatattttaaggatagaaaaaagctaaagggaaaaagaggctcaacaaggcctgctgtagcaacagaaacacacaacaccacacaaaaaagcacacacactaaaagggtttctttcttgttccacaaaggaagtttgattgttcttccttggagtttcagggtacatattttgtggttttcaacagagtaacaagtagaaacacttaatttgggaatgtgcatgggttttcactagtttttaaacataagtatgaggccagccatggtagttcacacctgtaatcccagctctttaggaggccatggtgggaggatagcttgaagccagaagtttgaagccagcctgggcaacatagtgagacccctgtttctacaaaataaaaaaattacccgggtgtggtggtgtacacctgtattcccaactactcaggaagctgaggtgggagtatcacttgatcctgggaggtggagactgcagtgagccgtgatcgtgccactgcactccagcctgggcaacagagcgagaccttgtttcaaaaaaaaaaaaaaggaaattaggtatgcacaagtgaaaagaatagcaaagtaaaatagttacagattttgaattgtatttagttgtagttaagcttttttaagactaggtaagttcagtagtgagaagtggggaaagagtagaataagcagttcaatctgtaactgagtgaataatcaattgtacttaagttttgaatctgtaatgtccagtggtgagcttgttcagtcagttgtacacatttcatcccaattccacattcacgtggctatggtgggagtatttacaccatggaaactggcacacactacacattagggctttctccaaccctgagagcagatttctaaacatttactactgcacccatgaatgtgcctatttaattttcacttttacagttaaataacagctttaggtttcattgaagataactagtgtagaatggtgaagagcagagataccagagccaaactatctgggtacaaataccatttcttcacttactagcttgtgttaccctaggcagttagtcaaacttatcattaatggggatagtagcaatgcctaccttatagggttgacgtgaggattaaatatgttaagggtctgttttatagataaatcttatctggcaacctcagaaatccagtgcatagccaggattcaggaaataaacaaaaacatcactgagccaccaatgtaaatgtcagacagagggtacttgccctgaagcccccaagctttctctagaagctaattttactctttctgtagaaccaagcttgattgtcttttctgagccaaagggatattagaagcatgacatcacacaaaaaaaaagagagagaggagagatgctgctagaagcaacaactgaagtgagaaccttcctccctcaaagaaaattatccaatgtgagaactcaaaaatgagtcagactgcttgattgctaagatctgttccatttccaaaaatttatgacaagagtgaaaaattgcaacagtttagaaacaaataatcttactactatgttaaataatggcatacaaagataatccactgtcaataataaatcataatcagtatctattagttaagaaaataggacagggagcaagatggccaaataaaacccaccagtgatcatcccctccataggaacaccaaattgaacaactccccacacaagaaagcatctttgtaagaatcaaaaatcaggtgagcagtaacagtgccttgttttaacatcatattaaggaaagaggcactggataggataggaaagatagtcattaatttcttacaccacccctccctcatcccctggtggtgcagcttggcacagagagaaaatctgtgtgtttaggggaaggagagcacagtgattgtgggactttgcatcagaactcagtgctaccctgtcacagaggaaaacaacatggggcataattgtgcccatacccatggagggagcatttagaccagccctagccggaggagaattgtccatccctctggcaagcctcaccactgtgagctaaagtgccctggggtcctaaataaatacgaaaggcagtctagaccaaaaggactgcaattttgaggcaagtcctggtggttctgtgctgggctcagaaccagaggacttgcggtgcatatggccaagaaagcgtttgcatcacccctcccccaactccaggcagtacagctcacagctctgggaggagaggaaagattaaagtggactttgtcttaacatttggataccagctcagccacagtaaaataaagcaccaagcagagtcctgaagcccacactccaggccctagatcctggatgacatttctagacacaccctgggccagaagggaacccaccaatttgaaggaaaggacccagttctggaaggattcatcacctgctgactacagagcccttggaccttgaataaacattattagtagctaagcagtactcaccatgagccttgggcaaggcttcaggtgtgacccagcacattcccagctgtagtggccaaggggagagactccttttctctgcttgaggaaaggagagtgaaaagtaaaaaggacttcaccttgcaatttgggtaccagttcagccacagtaaaataaagcaccgaatagattcctaaagttcctgactccagaccctacctcccagacagcatttctagacccaccctgggccagaagggacaccaccaccctgaagggaaagacacaagcctggctggattcaccacctgctgattaaagaacccttgggccttgaacaaacagcaatactcaccataagccttgggcaaaacccagaactatgctggtttctggtctaatgcagctcagtcccagcagtggtggccacaggggtgcttgcatcacctctcctccaactccaggcagcacagcatggtgagagagattccttttgtttgagagaaagtaagggaagagaacaacacattctgcctggtaatccagggaattctcctagatattacccaagaccaccaaaacagtacctctactagtctgcaagagccacagcgttactgggcttggggtgccccctaatgcatatatggctaaagtgaccaaaaacttagatcacaacactcaattccctttgaatgcttgaaaagcattctcaagaaggacaggtataaacaagcccagactgtgaatattataatacctatctcttcagtgcacaagcaccaagaaatatccacaagcatccagatcatccaggataacattacctcagaaaatgaaataaagaaggaaccagtgaccaatcccagagtaacagaggtatgtgaccttttagacagaattcaaaatagctgttctgaggaagctcagtgaaattccagataacacagagaaggaattcagaattctatcagataaattgaacaaagagattgaaatactttaaaaaaatcaagcataaattctggagctgaaaaatgcaattgatataccgaagaatgcatcagagtctttcaacagcagaactgatcaagcagaagaaaaaagtattgagcttgaagaggggctgtttgaaaatacacagtcagaggagacaaaaaaagaataaaatagaatgaagcacacctacaacatctagaaaatagcttcaaaagtacagatctaagagttatttgccttaaagaggtggtagagagatcgagatagaaagcatattcaaaggaataatattataacactgtagttgtggtgtgtgaactactcataccttgagtaggaagactaagagatgaacctatcaaaaataataactgcaagttttgaagacatagacagtataataagatatgaatagaaacaataaaaatgtaaaaagccatggaggggataaagttaaagtatagagtttcaattagttttctctttgtttgtttgtttgttttagcaatcactgttgtcatcagtttgaaataatgcaatataagatgttatctataacattcatggtagcctcaaatcaatgaacctagaacagatacaccaaaaaataaaaagcaagaaattaaaacataccaccagagacaatcaccttcacaaaaagaagacagagagggaacaaaggaagagatcacaaaacaaccagaaaacaaataataaaatgggaagggagtaagaacttatcaataataacattgaatttaaatagaataaacttttcaatcaaaaaacatagaatggctgaatgcattaaaaagccccaactagctgccatccttaagaaacacacttcacctataaggacacacatagactgaatataaaaggatggaaaaagatattccatgcaaatagaaaacaacaaagaggagtagctatacttatatcacacaatatagatttcaagacaaaaactataaaaagagataaagaaggtcattatataatgataagaggatcaattcagcaagaagatagaacaagtgtatatatgcacccaaagctggagcacccaggtgtataaagcaaatattatacaaactagaaggtgggatatagaccctgatataataatagctggagacttcaacaccctactttcagcattggacagatcatccggacagaaaatccacaaagaaatatcacacttaatgtgcagtagagaacaaatggacctaatagatatttacagaacatttcatccaacagctacagaagacacaattgtctctttggcacgtggatcattctcaaggataaaccatatgttaagtcataaaacaaataatttttttcttttttcttttttttcagacaagttctcactctgttgcccaggctggagtgtagtggcatgatttcggctcactgcagcctaaacctaccagacttgaagggaaccttccacctcagccttccaagtagctgggactacagtgggactacaggcacatgccaccacacctggcaatgttttctttctctttttttttttttttttttttttttttttttgtagcgacagggtctcaccatattgcccaagctgttctcaaactccttggctcaaatgatctgccaccttggcctcccaaagtgctgggattacaggtgtgagccagcatgcccagccaaaattttttttaaattgaaatatcaagcatcttctctaaccacaatggaataaaactaagtcaataataacagaaactttggaaactatacaaatacatggagataaacagtatgctcctgaatgaccagtgggttaatgtagaaattaagaagaaaattttaaaatttcttgaaacaagtggaaatgaaaacaaaatgtaacaaaacctatgagatatagcaaaaacagtactaataggaaagtttataaaaatgagtgcctacatcaaaaatgtagaaaaccttcaaattaacaacctaataatagaactagaaaagcaagagcaaaccaaatggaaaattagtagaagaaaagaattaataaagatcagagcagaaataaattgaaataaaaaaacacaaaacatcaatgacatgaaaagttgttttctttaaaaaataaataaaatcaacaaacctttagccagaataaagaaaaagagaaaacccaaatagataaagatgaaaaatgggacatacaaccaataccacagaaattcaaagaatccctggagactactgggagcagctatacgccaataaattggaaaacgttgaagaaatggataaattcctagacacacagaaccttccatgattggatcaggaagaaaaccaaaacctgaatagaccaataacaagtaatgagaagaaagccatgacaaatagtcccccagtaaagaaaaacctggaacccaatgacttcactgctgatttttgccaaacgtttaaagaagaactaatgccaaccctactgaaactattctgaaaaaacggagcaggaagaaatacttccagactcattctatgaggccagtattaccctgataccaaaaccagacaaagacatatcgaaaaaaaaaaggaaactactacaggcaagtctctctgatgaacatcaatgcaaaacctcaaccaaatattaacaaaccaaattcagcaacacattaatagggtaattgatcatgatcaagtgggatttatcctagggatgcaaggatagttatacataaatcaatcaatgtcctacatcctatcaacacaatgaaggacagaaagcatataattccaattgatgctgaaaatcatttgataaagttcaacatcctttcacgattaaaaaccctaaaaaagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttaatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaagaaataaaagaggatacaaacaaatggaagaacattccatactcatgggtaggaagaatcaatatcttgaaaatggccatactgcccaaggtaatttacagattcaatgccatccccatcaagctaccaatgcctttcttcacagaattggaaaaaactactttaaagttcatatggaatcaaaaaagagcccgcatcaccaagtcaatcctaaaccaaaagaacaaagcgggaggcatcacactacctgacttcaaactatactacaaggctacagtaaccaaaacagcatggtactggtaccaaaacagagatatagatcaatggaacagaacagagccctcagaaataatgctgcatacctacaactatctgatctttgacaaacctgacaaaaacaagcaatggggaaaggattccctatttaataaatggtgctgggaaaactggctagccatatgtagaaagctgaaaccggatcccttccttacaccttatacaaaaatcaattcaagatggattaaagatttaaacgttagacctaaaaccataaaaaccctagaagaaaacctaggcattaccattcaggacataggcatgggaaaggacttcatgtccaaaacaccaaaagcaatggcaacaaaagaaaaaattgacaaatgggatctaattaaaataaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaccccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctagggactgtggtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaataaatttaaaaaaaaccctaaaaaatctgtgtatgcaaggaacatacctcattgcaataaaagctatatgtgacagatccacagctcagtatcatattgaatagggaaaaactgaaagcctttcctttaatacctggaacaggacagatatatccacttttaccactgttatgcaacgtagtactggaggtcctagctagagacatcagacaagagaaagaagggcaacaaaattggaaaggaaaaagtcaaattatccttgtttgcagataatatgatcttatagtttgaaaaacctaaaggccccacaacaaactattagaactgataaattcagtaaagctgcagaatgcaaaatcaacatatataaatcagtagtatttctagatgccaatggcacacaatctgaaaaagaaatcaagtaagtattcccatttacaataacaacaaataaaataaagtactaggaggaaacctaaccaaagaagagagctctacaatgaaaactgtaaaacaatgatataagaaattgaagatggcacaaaaagatggaaagatattccatgttcatggattggaagtttcaattttattaaaaggttcatactacccaatgcaatctacagatttaatgcaatccctattaagatataataccaatgacatcattcacataaatagaaaaaataattatagaatttatatgaaaccacagaagacccagaatagccaaagccatcctgagcaaaaagaacaaaactagaggaaacatattacctgactttaaattatactacacagttatagtaaccaaagaagcatggtactggcataaatacagacatatagaccaaagaaaaataatagagaattcagaaataaatctatacattcacagtgagcttattttcaacaaagtgccaagaacatacattggggaaaagataggctctccgattaatgctgctggcaaaactgcatatccatgtgcagaagaatgaaactagacccgtatctcctgccatatacaaaaatcaaatcaaaatggaatgaagacttaaatctaagacctcaaaatatgaaactactaaaagaaaacactggggaaactctccaggacattggactgagcacagattacctgagcaataccccaccacaagtacaggtaaccaaagcaaacatgaagaaaggagatcacatcaagctaaaaagcttctaccagcaaagaaaacaatcagcaagtagaagagactacccatagaatgggagaaaatatttgcaaactattcatctgacaagggattaataaccagaatacttaaggagctgaaatcactaaataggaaaatatctaataatccgattaaaaatggacaaaagatctgaatagacatttctcaaaagaagacatacaaaaggcaaacaggtatatgaaaagatgctcaacataattgatcatcagaaatgcaaataaaaactacaatgagatattatctcatcccagttaaaatggcttttattcaaaagtcaggcaataatgaatgctggcgaggatgtagaggaaagggaacccttgtacactgttggttggaatgtaaattactacagccactatgtagaacaatatggaggttcctcagaaaactaaaaatagaattaccgtataatccagcaatcccactgctaggtatatacccaaaagaaaggaaatcaggatatcaaagagatgtctacacccccgtgtttattgcagcactattctacaataaccatgatttggaagcaacctaagtgtccatcaagagacaaatggataaagaaaatgtggtacttacacacaatggagtactattcagccataaagaaaaatgagttcctgtcatttgcaacaacacatatggaactggagaattattatgttaagtgaaataagccaggcacagaaagacaaactttgcatgttttccactcatttatgagagctaaaattttaaacagttggagatagatatcagaaggatggttaccagaggctgggaagggtagaggtgggtagaaagaaattggggattattactgggcacaaaaatatagttagatagaatgagtaagacctagcattttatagcacaaaagggtgactgtagtcaacaataacttaatgtacattttaaaataactaaaagcataactggaatgtttgtaacacaaagaaaataaaaatgcttgaagtgatggataccccatttaccctgatgtgattattacagattgtatgtctgtatcaaaatatctcatgtaacctagaaatatatacacctgacatgcacccataaaaactaaaaattttataaaaagaataaaaaatttaggaaaatatagattactttttcgagtgttcattcaaaattgttaaaactaagtatttgtgtaaaaccttttgttacctataaattttacttttatggaacatctaattcctaaaaatagcagataaaggcattactgtcattaagagactgttaactcaaacaattaaatagcaaaacaacaaataatctgattttacaatgggcaaaagacctgaatagacagttctcaaaagaagcatacaaatagccaacagttacatgaaaaaatattcaacgtcaccaatcatcaggaaaatgcaaatcaaaactgcaatgtgatatcacttcactccagttaggatggctattataaaagagacaaaaaacaaacaaatactggcaaggatgtggagaaaagggaactcttatatacttactgttggtgggaatgtaaattagtccagccatattggaaaacagtatggagagtttttaaaaatgttagaaatacaattaccatataatctggcaattcaattactgggtatctatccaaaggaatggaagtcagtttgtccaagagatatctgccctcccatgtttattttagcactattcacaacagcaaagatatggaatcaagctaagtatccatcaatggatgaatggatatagaaaaagtcacacgtgtatacaatggaatactattcagcatttaaaaagcagcaaatcgtgtcatttgcagcagtgtggatgaacctggaggaaattaagtgccaaaagcaattgcaacaaaagcaaaaacaaaaacaaaagttggcaaatgcaacctaattaaattaaaaagcttttgcatagcaaaagaaactatcaacagagtaaacagacaacctacagaatgggagaaaatatttgcaaactatgcatccaacaaaggtctgatatccgaaatctttaaggaacttaaattaacaagcaaaaatccaacaaccccattaaaaactggacaaagaacatgaatagacacttttcaaaagaagacatacatgcagccaacaaatgaaacatatgaaaaattactgaacatcactaatcagattactagagaaataccaatccaaatcacaatgcaataccatctcccaccagtcagtatggctattattaaaaagtcaaaaaataacagatgttaacaaggttttagagaaaagggagcgcttatacactgctcgtgggaatgtaaattagttcagccattgtggaaagcagtttgctgatttctcaaaaaactcaaagcagaattgcaatttgacacagcaatcccattattgggtatatacccaaaggaatataaatcattctaccataaagacacatgcacatgtatgttcatcacagcactatttacaatagcaaagtcatggaatccacctaaatgcccatcaatggtggactgaataaagaaaatgtggtgcaaatacaccatggaatattatacagccataaaaaaagaatgagatcatgtatgatctcatgagtactcagatacagccacataggactattgtcattcacttttcttaactgttcattctgatctttctgcctaaaatacccatatttgctctgacactccctgtcctctgcttatctatgtattacttaagtcccagctcaaatgatgcttctatacaggttccccaagctccaagtgagagaataaatgtttcctctttggtcccctgtcacttggtttctaacctctatctagtatttcattttactttgcatctcaattggcatgcctctctaaattaagaacttttttattttgggcagacactgtctttttttttttaaagacccttaatttaaaaatttataattgacacataattgtatatatttatggggtacaatgtgattgtaaatgtaagtatactatgtagtataatgatcaaatgggggcaattaccatatccatcacatggaacatttttcatttgtttgtggtaacatcattcaaaatcttttcttctagttatcttaaaacatacactacattgctgtttgctatagtcaccctactgtgtaaaaaaacaccaaacttattcttcctgcctaactgtaagtttgtacacattggccaacctctctccatccttccctaccctgtaccctccccagcccctggtaatcactattccattctccacttttgatttttttttttttttgagatggagttttgctcttgttgcccaggctggagtgcagtggcaccatctcagctcaccacaacctctgcctcgggttcaagcgattctcctgcctcagcctcccgagtagctgggattacaggcatgcactgccacgcctggctaattttgtacttttagtagagacagggtttttccatgttggtcaagctggtcttgaactcctgacctcaggtgatccgccccccatcggcctcccaaagtgctgggattacaggtgtgagccaccaagcccagtcttgaaattttttaaacttttattttaggctcaaggacacatgtgttggtttgttgtataggcaaattgtgtgtcacaggggtttgtgtacagattatgttctttgcagcaacatggatggagctggaggccattatcctgagtgaacaaacacagcaacagaaaaccaaataccacatgttcttatgtataagtgggagctaaactttgagtacacatggacacaaagaagggaacaacggacaccggggcctacttgagggtggaggaagggaggaggatgaatacctattgggcactatgcttattacatggatgatgaaataatctgtacacaaacccctgtgacacacagtttgcctatataacataccaacacatgtgcaagatcagttgagatcagatcatatatggctttacatgttaggctaaggagtcagattgtaatgagtaattaggagccactaaagactcctgggcagaaaaagaggcatgattcaaccatgttatggcaaaagtcaagcagaaaggtcaactctaatgaaactttaagggagggactggatataggatgaccagctaggaggttactgtaatagtttcagtaccctatttcaaagaaattatgagggtctatattaagacagcagaaatagaaagatctgataatggagacaccaagaaagtaaatagcatctccatgactgactaggtgagcagtgaggattcaaacatgattctgaggttactaaactaggtgaccagaggggttgttacactgttaactgcaattgagaacagtggagggggagcagtttacagatattttcaagtgcatgggaagtatcaaaatgcttagaaataggtcttttacatgattaggaagccaattcagggttttttgttttcgttgagacggagtctcgctctgtcgtccaggctggagtgcactggcacgatcttggctcactgcaagctccgcctcccgggttcacgccattctcctgcctcagcctcccgagtagctgggactacaggcgcccgccaccacgcccggctaattttttgtatttttagtagagatggggtttcaccgtgttagccaggatggtctcgatctcctgatctcatgatccgcccgcctcctcggcctcccaaagtgctggaattaaaggcgtgggccaccacgcccggccaattcaggttttttaatagttggactgtatatagcacgtatgaatatagattgtgaggactgaagcacagcattgttgctaagatgtatacaatgtacatttcttgcctatccttgttttttggtttggtttggtttggtttggtttggtttggtttttgtttttgttttttgagatggagtctcgctctgtcgcccaggctggagtgcagtggcacgatatcagctcactgcaagctccacctcccgggttcacgccattctcctgcctcagcctccccagtagctggggctacaggtgcccgccaccacgcccgactaatttttttttgtatttttagaagagacggggtttcaccatgttagccaggatagtcttgatctcctgacctcgtgatccacccacctcagcctcccaaagtgctggaattacaggcgtgagccaccacgcccggccttgttttgtttttcaaccttcatctgaccacaatggcccatgtgttcctgagtatccacccctgccacctaccccatatgttctaaaagaacaaaacatttctattagttaaaaacttatggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtaaggagcgaaactccgtctcaaaaaaaacaaaacaacaacaacaacaacaaaaaccaacttattagcagtacacatctgtgattcaaaagaaatatttaaaaatatattccaaagcctaacttttagaattctctatgctttcaaagattatacagtttataatatcggaaatgaatgctacattatataattaatcacaactttattactatacattttcctgagagatggctcttagagaaaagacaaataatgtctgtgattttagtgccatagctaaaaatttaaagcccctaaataaatagaaaaaaagggccactgtttggtaaaattatctccagatccataagggatatttgggtcatatactgatattggaagaaaatataacagagggtctctacatttcagactccttcactccccattgtttttgagattttccttttgtaaatgagaacaaggtgagtcattaatctctatcaaactgaatgatcacacatgactcagtagagttttaaaaagggcttaactaaatggctatcatgtaaaaatagtgtcttttggaatgttaaggatctataataaaatgctttgaataaaatgtttaaattaataacttcaaataaagagagaatcttagcatactatgagatatttctttttggccccatcttttgaaaactttggctactgaggaccataaatttaagggattgcttgattaacaattttactgtgtacattgccatttaaggtttatacccttaatttgaaaattaaaactgtgaatactattttaatattttactgagaaatggcttttagagaaaagacaaataatgtctgtgattttagtgccatagctaaaaacttaatgtccccaaataaatagaaaaaaggggcactctctggcaaaattacctccagacccataagggatatttggataatacactcatattggaagaagatacaacagagggtgtctacatttcagacattcagtatttttgtatttaaattctagtctaaaagtcctttcattttatttttattttatattttgttggtttttttattattatactttaagttctaggctacatgtgcacaacatgcaggtttgtcacatatgtttacatgtgccatgttggtgtgctgcacccattaactaactcgtcatttatattaggtttatctcctaatgctatcccccccagccccccaccccacgacaggctccagtgtgtgatgttccccaccctgtgtccaagtgttctcattgttcaattcccacctatgagtgagaacatgcggtgtttggttttctgtcttggtgatagtttgctcagaatgatggtttctagcttcatccatgtccctacaaagacatgaactcatctttttatggctgcatagtattccatggtatatatgtgccaaattttcttaatccagtctattattgaaggacatttgggttggttccaagtctatgctattgtgaatagtgccgaaataaacatacgtgtgcatgtgtctttatagcagcatgatttataatcctttgggtatatgcccagtaatgggatggctagatcaaatggtatttctagttctagatccttgaggaatcgccacactgtcttccacaatggttgaactagtttacactcccaccaacagttaaaggagttcctatttctccacatcctctccagtacctgttgtttcctgactttttaatgatcaccattctaagtcgtgtgagatggtatctcattgtagtttggtttgcatttctctgatggtcagtgatgatgaacattttttcatgtgtcttttggctgcataaatgtcttcttttgagaagtgtctgttcatatcctttgcccactttttgatagggttgtttgattttttcttgtaaatttgttcaagttcattgtagattctggatattagccctttgtcagatgggtaaattgtaaaacttttctcccattctgtaggttgcctgttcactctgacggtagtttcttttgctgtgcagaagctctttagtttaattagatcccatttgtcaattttggcttttgttgccattgcttttggtgttttggtcatgaagtccttgcccatgcctatggcctgaatggtatttgcctaggttttcttctaggatttttatggttttaggtctaatatttaggtctttaatccatcttgagttaatttttgtataaggtgtaaggaagggatccagtttcagctttctatatatggctagccagttttcccagcaccatttattaaatagggaatcctttccccatttcttgtttttgtcaggtttgtcaaagatcggatggttgtagatgtgtggtattatttctgagggctctattctgttccattgatctatatctctgttttggtaccagtaccatgctattttggttactgtagccttgtagtatagtttgaagtcaggtagggtgatgcctccagctttgttcttttgacttaggattgtcttggcgatgcgggctctttgggttccatatgaactttaaagtagttttttccaattctatgaagaaagtcattggcagcttgatggggatggcattgaatctataaattaccttgggcagaatggccattttcacaatattgattcttcctatccatgaacacggaatgttcttccatttgtttgtgtcctcttttatttcgttgagcagtggtttgtagttctccttgaggaggtccttcacatcctttttaagttagattcctaggtattttattctctttgaagcaattgtgaatgggagttcgctcgtgatttggctttctgtttgtctgttattggtgtataagaatgcttgtgatttttgcacattgattttgtatcctgagactttgctgaagttgcttatcagcctgaggagaatttgggctgagacgatggggttttctagatatataatcatgtcatctgcaaatagggacaatttgacttcctcttttcctaattgaatactctttatttccttctcttgcctgattgccctggctagaacttccaacactatgttgaataggagtggtgagaaagggcatccctgtcttgtgccagttttcaaagggaatgcttccagtttttgcccattctgtataatattggctgtgggtttgtcatagatagctcttattattttgagatacgtcccatcaatacctagtttattgagagtttttagcatgaagcgctgttgaattttgtcaaaggccttttctgcatctactgagataatcatgtggtttttatctttggttctgtttatatgatggattacatttattgatttgcttatgttgaaccagccttgcatcccagggatgaagccaacttgattgtggtggataagctttttgatgtgctgctggattcggcttgccagtatcttattgaggatttttgcatcattgttcatcagggattttcgtctaaaattttctttttttattttctctctgccaggctttggtatcaggatgatgctggcctcataaaatgagttaggaaggattccctctttttctattgattggaatagtttcagaaggaatggtaccagcttctctttgtacctctggtagacctcggctgtgaatccatctggtcctggactttttttggttggtaggctattatttattgccacaatttcagaggctgttattggtctattcagagattcaacttcttcctggtttagtcttgggagggtgtatgtgtcgaggaatttatccatttcttctagattttctagtttatttgcgtagaggggtttatagtattctctgatggtagtttgtatttctgtgggattggtggtgatatcccctttatcattttttattgcatccatttgattcttctctcttttcttctttatttgtcttgctagtggtctatcaattttgttgatcttttcaaaaaaccagctcctggattcattgattttttgaagggttttttgtgtctctatctccttctcttctgctctgatcttagttatttcttgccttctgccagcttttgaatgtgtttgctcttgcctctctagttcttttaattgtgatattagggtgtcaattttagatctttcctgctttctcttgtgggcatttagtgctgtaaattttcctctatacactgctttgaatgtgtcccagagattctggtatgttgtgtctttgttctcattggtttcaaagaacatctttatttctgccttcattttgttatgtacccattagtcattcaggagcaggttgttcagtttccatgtggttgtgtggttttgagtgagtttcttaatcctgagttctagtttcattgcactgtgatctgagacagtttgttataatttctgttcttttacatttgctgaggagtgttttacttccaactatgtcgtccattttggaatatgtgttatgtggtgctgagaagaatgtatattctgttgatttggggtggagagttctgtagatgtctattaggtctgcttggtgcagcgctaagttcagttcctggatatccttgttaacttactgtctcgttgatctgtctaatgttgacagtggggttttaaagtctcccattattattgtgtgcgtgtctaagtctctttgtaggtctctaaggacttgctttataaatctgggtgctcctgtattgggtgcatatatatttaggatagtcagctcttcttgttgaattgatccctttgccattatgtaatgaccttctttgtctcttttgatctttgttggtttaaagtctgtttgatcagagactaggattgctacacctgctttgttttttttttttttttttgctttccatttgcttggtatatcttcctccatccctttattttgagcctatgtgtgtctctgcatgtgagatgggtctcctgaatacagcacactgatgggtcttgattctttatccaatttgccagtctgtgtctttttcttttcagtctatgtcttttaattggagcatttagcccatttacatttaaagttaatattattatgtgtgaatttgatcctgtcattatgatgttagctggttattttgctcgttagttgatgcattttcttcctagcatcgatggtctttacaatttcgcatgcttttgcagtggctggtaccagttgttcctttccatgtttagtgcttccttcaggagctcttgtaaggcaggcctggtggtgacaaaatctctcagcatttgtttgtctgtaaagaattttatttctccttcacttttgaagcttagtttggctggatatgaaattgtgggttgaaaattctttaagaatgttgaatattggccccgactctcttctgatttgtagagtttctgccgagagatccgctgttagtctgatgggcttccctttgtgggtaacccgacctttctctctggctgcccttaacattttttccttcttttcaactttggtgaatctgacaattatgtgtcttggagttgctcttctcaaggagtatctttgtggcattctctgtacttcctgaatttgaatgttggcctgccttgctagattggggaagttctcctggataatctcctgaagagtattttccgacgtggttccattctccccgtcactttcaggtacaccaatcagacgtagatttggtcttttcacatggtcccatatttcttggaggctttgttcatttctttttactcttttttttcctctaaacttctcttcttgcttcatttcattcatttgatcttcaatcactgataccctttcttccacttgatcaaatcggctactgaagcttgtgcatgcaccacgtagtcctcatgccatggttttcagctccatccggtcatttaaggacttctctacactgtttattctagttagccattcgtctaatcttttttcaaggtttttacttctttgcgatgggttcgaacatcctcctttagttcagagaagtttgttattaccgatcatctgaagccttcttctctcaacccatcaaagtcattttccatccagctttgttctgttgctggcgaggagctgcattcctttggaggagaagaggcgctctgatttttagaattttcagcttttctgctctggtttctccccatttttgtggttttatctacctctggtctttgatgatggtgacgtactgacagggttttggtgtggatgtcctttctgtttattagttttccttctaacagtcaggaccctcagctgcaggtctgttggagtttgctggaggtctactccagaccctgtttgcctgggtatcaccagcggaggctgcagaacagcaaatattgcagaacagcagatgtggctgcctgatccttcctctggaagcttcgtctcagaggggcaccccactgtatgaggtgtcagtcggccccttctgggaagtgtctcctagttaggctactgaggggtcagggacccacttgaggaggcagtctgtccgttctcagatctcaaactccgtgctgggagaaccactactcttcaaagctgtcagacagggatgtttaagtctgcagaagtttctgctgccttttgttcacctatgccctacccccagaggtggagtctacagagtcaggcaggcctccttgagctgtggtgggctccacccagtttgagcttgcccgccactttgtttacctactcaagcctcagcaatggcgtacgcccctcccccagccccactgctgccttgcagtttgatctcagactgctgtgttagcagtgagcgaggctccatgggcatgggaccctctgagccaggcgcgggttataatctcctggtgtgccatttgctaaggctgttggaaaagtgcagtattagagtgggagtgtcccgattttccaggtacggtctgtcacggcttccctttgctaggaaagggaattccctgaccccttgcacttcctgggtgaggcgatggcctgccctgctccgtgggctgtacccacttgtctggcaagccccagtgagatgaacccagtacctcagttggaaatgcagaaatcacccgtcttctgcatcactcacactgggagctacagactggagctgttcctattcggccatcttggaacctcctctaaaagtccttttagagttgcatgtgtgtatttgtatttattccagattggagttggatcattaacccagattagcaccttaacttaatatcagtgggaggtttctctagttggttataccttaacattcaataagtgctcttcttttgcttaagattattggtctcaggtcatataaactagagggaatataaaccttgataagcattggaatggcatgagcaatctgacattcttttaacattgggaaagataatgtttgtactttatttttttccacaaaacttatataattggtggtagagaggtaagtattttagataattagacctttagtaataagattagtcttagtttaggcttgtctttaataggtagtgaatagaaatgtgcatttctatatgttatcttcattgctaacctgatcacgtctgtgtaaaaccttagaacaccttgagcaaattttatattgcttttgaggatatagaaaaatggtacatcatggacatatgtagtttgtacatttgggtttgtaaacattgtttggctcaaattactatcccaatatgtaaatccttatacatgctagtagtgagctcttgagataatttatcatcttataaattgggaaatatttctgtattccccaaatcttagattccttatcatataagccctattttctacaatttgggggactatttgtctttaagcaagccttcatataagatgcaaattgggtctcaaaggcaatactgttgaattatagatagttaatctgaggagggggaggtgtttgttgtatataatagcttccttactaagttatgagttccctaaaatcggtaaccaaatctcatgcgtgtttatataacctacaactttcatatagatagtaggtgctcaaaaatgttaattgaatgaatgggtatccttcctttgtctcattgagacccatttaaaatcattttagcaattgggttattatactaagaatgtttcaccaaactaaaactgaatttgttttattttacaggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcaggtttgtaatggtcctttcttccactattaaaaaaaatttactgttctaattgtagtttcagggtcctgcattttaatacattgtacttgctagacaatgatctccccatatgttttacaaaatctggtagtttttaaaagtatgtcagctcttctcaaaggtttattttctatatttgtcaaagaacttaatcctacctgattaaattttctaacacctcattagagaacacatccagcatttaattacatataggtgtaaatacatatgttcttttaaataaacatttttttctaaattacaaaaacatttcatactcaatatagaaaacttagaaattagaaagtacacgggaaaaaaactcacctaaaacctgatatagcaatataactatagtcatcgcccaaaggtaaccactattattttatatgtacgtctgtatttgcatgtggggatggggctgagaagagggactaggctgagaaggcagggtagaagatctgattgtgcatgatatattgttaggcttcaagtggagtcaaatattaatagtttctaccatattataacagtgtataaaaaggtacaaggtacacaaacaacagagcaaaaataccaaagcattactgaacagtaaagtacctatggttgtatggcattgttcctgccaccattaaattgtccccctcagccccctgatatgctcacatttctccttacccagcttaaattccatggttactcccatgcatacatcttcagttcccgtggcccttctttctctttgttatagttgctggaaaaacaaatccaaccctggttaaatttacttcccacctactctatgtcttcaccttgcacaactgaagtatcagaaaggcatttacagctgtactgactgatctcactttaaatttgtgaccgtaaaatcagagtgggcccttaatgctacccaggaatcacactatgttttcttggccatttactctcctactgttggataaccatatgtgttcctttccctttctccaacacctcctccaactttactctcaatttgtattttattttactgagaaaattgaagcaatcaataatacttccacatcttctcatctatcttcatctgcgtctatcctattcccctgctttgtcttctgtttttatggatgaactgttcctttgcaaaggctaactctttcactcaggtataagattatttttgtcttttgtatactcaaggacatcactccagaaattttcctctctcactctcctactttaacaatttctccctctcctcctcatcttttccaccaacatgcaaacatagtattattgctcccattttcaaaagattttctcttggccccaggccaaaaaccttgaagttgttctttattcctttttttctgtcacctcccatgtaaactatcagcaaatcctattatttctaccttcattatatatccagaatttgattatttcttattaccttcattgcttctgccccagtcaaagccaccataatttcttacctcctcctcccttcaggtattctcagtataacagcggaatggtgtgccacttctttagaaagctcagtagggatttaatgctttcagatgaaaatacatttttatatgtactgagcagtttctctaaaggcgatcgatttctggtcacttcatgtactcttcctccaataagtgaaaaggaactcaatttatttagggggcggaaggagcagtgaggatttttatatagcaagaaagttaatttaatttaggaatagatgagaaattgaaattttattataaaaacttcataaagattagataccagcatatggtaataagtgatggttatctcagtgtttaaagttaattggcttctatccttctccttagagaagcagcttatcacattggtggcaggttcagcctgatactagctgcagtcaaaaagatgtttaaaattcctgtaccaggccactcagtagtttcacactgtgttaatatttgacatttgtatattgtgcggttttttatctgcgaggctggaaggaaattggtgtccagtgtgactaactattcaaaggttatagttacaatgacaagagtgtttggtttgcatatgttcatggtggggtatgtgtttcagtattctcagtgctataataaatttattgacatggcattaaaccccatcagaaaataataaggtttataaagaactttgtctggtgttacagagcttcattggacatttagctctggtctacgcatttaattttcatagtttataatacatcttatgataattaacctctgtagaaatggtcaagaatagcattaaaacttctcatctatttggagaaggcttttgaaggggcttttaaaaattacttaatggactatatctgtttatcctttgaggactaaaagattaaatatatggctgataatcctttttgcttataaatatttgagagtgctagaatgtcatttatatatttaattttcatgacagtattaatttttaaaaggtagagcttaatgcatatgctgattataattatcactaaacatttaactatattatctccattttactggtagaaatgatgatgaagctgagttatggaaatttggcttcattagaatgttaggcaaatttaatatattcaagaatttcttccttctgaaggttatgatacatggtatataatgtcaggaaactgataactgtaaccataaattctgatgactgaatgctcagatgagcccccagacagaatagcctcatatgttgtagtgtgatgtgtaagaacacatatcatccctgttttttagatacaaagcttttaaacagaacaaaaaagtatcaatggattataaatgaaaataacatattaggccttataagttagtttcatgtcccttccgggaacaaccctaacttgagacaagaaagattatgggaaaccttatggcatacacaaattaaactacattcaggagtgaccactatacacttgactctagcatggagtaccaaacattttcgggtaccgtaaatgtatcctaactgtattcaagcagttaatactcaatagccacaatgcatgtgttggattaaacattggcaagtgaaacaaaagagggctgtaggtgaaataggagctggcctagatataatgtgaaaagctgaatttacttttaatgaagagtggctttcagaagaaaaggatttactaactaaaatagacagattagaaggaaatcatcttccaagaggagggaaaagaatgggaatccacttgcaaaggtcataaagctttgataaactgatcacacagacccaacacataatgctagagaatgctaggaatcaatattgggaaagagaatatactctaacacaacagaatctattaactattttacttaaaagtgatccccaagtagccatgggggtaatgaccttccatttttagctgtagaagctcaggcagagaatctttgagacacatgcagatcctcaaatttatggaatttttttttgtaaaattgcaacttgcactgctgatctctgactgatctggaccaaaggatgggccaaaataaggctagtaggaatagaactaatactgaatgatacccatgtactcccatgggagggaaatggccttgctgtacaaagttaacaggaacctataacttgataataatataagttgagacaaatgattggctttgtccccagctaacatggaacctagaaatgacagaatgattgcaactggtgacagcatttgttcctcatcatatctggcatatgggcaaaggctaattcttctaggaaggtttaataaatatttctgtgacatttccggattttttttgtaaccaaaccaaactgtatcataaccatgctctgatatggtgtaatactggtattgttagtaaaattcaactatcttatataaataaatcatatggtaatcaaatatatttgagacattgaactaaaaactcctcacagtgtgataccaagggagagtgactggcatgaagaagaagtagaatgatttagttcattactatattaaattgctctgtgcaagtctatcacaaagttcaagtggccatagatcaagggaataaatggataattaaattggtataataatgtaaagatgtttgtgatggtcttataaactggatgaattgttcctttgaacctgtttccactccttgttggcttctgcaagtattagatagacttgtgttgttcttatggcaccttatataaaaatactgtgctaactgaacagtatatacagttgacccttaaacaacttgggtttcaaccacacgaatccacttttacacggatattcttccacttctgccacaccggaggcagcaaggccaatatatccttttcctcctccccagtctagtgaatgtgaagaaagaaggatggaggccttcatgataatccacggcctcttaattaagataaaatttattttctctcacacctgtcgtaccagcactttgggaggccgaggcgggtggatcgcttgagcccaggagttccagaccaacctgtgcaacatggcaaaaccctgtccctgcaaataatagaaaaattagccaggcatggtggcatgtgcctgtagtcccagctacttgggaggctgaggtgggagaatcacttgagcccgggaggcagaggttgcagtgagccgagatcatgccactgctctccagcctgggtgacagtgagaccctgtctttaaatatatattcttttcttccttatgattttcttaataacattttcttttctctaatttactttattgtacaaacacagtatataatttatataacatacaacataggtgtttattaactgtttatgttatcagtaaggcttccagtcaacagtagactattagtagttaagttttgggggtgtcaaaagctatatgtggagtcttggctgtgtgagggtcagtgcctataactgccatgttgttcaagggtcaactgtatactgtatgtagtacactgtttataaatattatgctaactgtatagtaactatactgactactgtaccaactgaagtgataatatataaatactgtacaaacagttactgtactgaaagttttattataaaaaggctttgaccaacaggatggattgtgaggaaaaaggtaacacaacagatgcagttgcttactccttccatgtccccaagggaaccatgattggcccctggccaaccctgggaatgtggctctcaaactggtctttatgttagtgattgataattttgttatatacacctggaaaaatggaccatgttgtaccagcctgtcagagttgcttttcacaacaatcaagattgatgatatcctagtttcattgttggggtcctcagtttccggcaacatggccagttgctagcaggatgcacctagtaagcagtcccttcatctgagtcttggaccccaacacttaaattggttccctgggcagagatatgccacacatttctgtagtttgctgccagacagaaagagcactcctgtgtgctctcagatgaggaaggactaggctacattaatattttaaaatctgtccttcaacttaaagcattactaaaaattatctaaactatttctggttacattaagtttttttctactccactagtacacgaaattatctggaagattcattaagtacctgcacactgtaccactattaacatatatacatttgcagttggtgtgttcacatgtatgtatctatttctgcctacatttgagagtagttcagggtcttttacagaaaccatgagaattttgactcttgtataagaagaacagattaaatccttgtctaagtaagacttagttttacaatatttcttctgactttctcactgaacaaaagaaagctcttataatgggtctcaggatttttatatattcacttactctaattttaaatttataccactaattctttttccagctttattgaagtatgattgacaaataaaatttgtatatattcaaggtgtacaacattatgatttgatatacatataaattgtaaaatgattgacataaattaatacatctatccctacacagttacgtgtgtgtgtgtgtgtgtgtgtgtgtgtgtgtgtgtgtgtgttgaggatacttaagatctactttcttagcaaatttcaagtaaaccatgctgtaaataagatcctcaggatttattcatctaaaaaatttgaactcatagatgcagagaacagagaagtggttgccagggggattggggaaatggggagatgttagtcaaacgatacaaacttgcagttataccacaaattctaaagggtgttaatcacatttctttgaaaaaaatgctgtaatctgagctataacctatctactgagtcaaattcaccctttcttcactgttcttccttatagtgtatttccttacactgctcacagttatgttcttcatgagagtggtctgcactcttgtttatcccctcatctgtagttccatagatttataggaagctgttttatagcctgcacctcctcttacctgtaggaatattttcactcaaatattgtggataggtttttattgaataaaatggatttctttcagttctcagatacctaaacagctacatggctcagacttttattttgtcctaggaatatatctgaggaaaagaatcctcttactataattcttgattttaaatatcttgtgttaaaactcttagccaaatttttaggaaaatgtttatttttaaaatatggtgacttaagtacagaaaaatctagtttgcttatatctctctcctttcttgctttttgcacaccctgtcctccatcaagtaattaggtttgactacatacttaatactattcatgtgggtttcagttaagctaaaagctgaacgccctgggaccaaaaatcaggctgaaaaatcaccagactgaaacatatactttacctaattggatataaagacaccagtgaactaggtagaatatctttgctttcaccataatttcaaaattgaacattgtaataaagaatgatcattggtttgacattttatcatcaaccccaatatattcccattcagaatcaagaaaaaaaaccatgtagtggagattcttcactaactagagcgaatgcagcttttgattagtcagaatagtcacattaagcttctgttaagaaaattggccaacaaccagcttctttgaatcagtcttcagttctactgccaaatattcttagaccaggtatctcttaggattagagaggaggaggggaaaggcaaaaggcgtttgacatcatatacttgctttttaaaattccccaaatcacagtaaatagccagtttgggaagaattttaagattggataattgctggctttaaaggggtttttaaatttccttcgtttgtcttcttcacaagaaatgtgaagcctcttaaaggcttctttgccattacacaatggaggcagtgtacaatagtggagagatcatgggctttaaagccagatagaacctgggcttgaattgaatcacagctctgaagcttaccagctgtctggactttagtcaagcttctgaaccttacttttcttgtctataaaacttggatattaaaatagctatttcacaatgttgttaatgattaaacaagatgacacatgtaaaaagcttacaacctgacacatggtaaaggttcaattaatttgtaaacctttctttccccaaacttaatggagtagagacttttaataattgaaatgagaagtgtcttgcatgagaaaatcaagaaagtctgtttatattttctaaattcagaaaataatttttgagcaaactctagccactggggaatttttttctaagtgactaaggcccagtcctccagctactcaagagagaaaggcacattaataatacaattactgaacaagataagaggtggaaataatgtgttactggaatttatagactaaggaaattctgatctggtagcaaggcattggaaaagtatctcatgtaatttgtataatgtagatatgttcttgaaattctgttttttaaggagtaaggtacaaattacagttcacatggggcatattgtctttaaatgttgaggtatatttgggcactgtaaagttgacataatgttgttcaaacacgtgttgaatataatctactgggccctaatggtgttctcatatttcagtttttttaagagggaggcttgcatcttggaactcttgctatcagtgtcacagtgaaatatcttgagtactatcttgaatatcgtgaggcagtttttttgtgagtgactttcctttaagctctaaaaatagtttgtgctttttattaaatcacttgtcttgcatccatatttaaagaaaatagcttttctttatatcagcccagtaggagctattgaaaatactcaaattttcttttaaacacatttttattctaaggctgctttgttaaacattagtttatgctatgctgcaaatcttttagagatcctttataatcaaatctcttgtctagtgtcttctggcattttggatttggccctgtttttttattttttgtattctcccccaccatcattttctagcatcgcccttaatgcaagttctactgttctcctgggcatagactcagacattacatacaaagtttccctttgatcccacacttcaaattaatttgcattatagtcttggctataattaagaaagttatatatttggcattaatgcctaataaattgataagcactatcactggagattcagacatttatattgtattgaatcaaatattttgcaatgagaaatcagactgtatagactgaatcaagtaaataccctagagaggtatcaattccttatgagagctttccccaactgtgtgatacagcttgttgcctaaacctaaattagaattgctttaagcacaaagagcaaaacgattgtgaaagacatcatcaactacattacattttttcccctttcttcttgctggctctatttttttatcatttgcatttttctcatctcgatgtccaactgactcatgatctatgtggaaagaaagtagtgaagtgtaggtgtgtgggccagggccaggaccctgtaggcatacaggtggaaggattgccacagtttgacagaccctagaatccaggagctagaaaaacatcaaaagacagatgagttatggatggttgtattgtaatggactcttggaatatgaagagcagagttccagtaccagctttattatttagatgctgcattcccttttgaataagttattttactttttcaaccctccacttgagcatctctaaaatgaggatattaccttcttctgggggttgttgtgaggattaaatgaggtaatggatataaaaaatatattttaaactgtataacaactgtatattgtaaggaaatggtaggagtagcttcctactccatgctacagtcaaaacagatagctactttgatataactctggacttcagtggggctgacactagctctgatatttcaagcaagacattcttcctctttgagcatcagttttcttctctgtctgattagatgtcgggctcggtaatctaaagatcctaggtgtacctttgttcactgtcactctattattatcttacaagtaacaaaatagaagggaagatatttgtgctgaaattaagtcccatcatagaatttttttagttcacaattatgtcccaaaatgggagtgaaagtgccttgattatcacctcttttcctttttagggtctaggccttcctattcactgtttctgttagacttatttgctggtcaggtaataatctgagaggtttctgcttttcctgtgacagcaaagaaatactttggctaatattctccttggcattaagctaaatatcttccacaaaatgatatcttatataggagacaggtttgggcatcaatgagattcctcacctactgatacttatagattcttaccttccaaaatatatttgctacaaatatttgtagcatttgtagcaaatatatattggcaagtacctgttatgcttattgatgaatggtagtttacattttgtgtaataaacattttattgagtatctgctatatgccagacattatactaaatacttacattatctctaattttcatgtaacataaatgtcagctggggacgggggtacatataggagggaagctgcttacattctcccaaaggtctgggggcctactttttgccgaatttctaagtttgttcattttacagttcaaaatagaaagatcacttatcttgccatgctgcacatgctaccattatattccacacatgtattagtcgggtttgtgttgctgtaaaggaatacctgaggctgggtaattcataaagaaaagaggttgatttacctcatggttctgcaggctatacaagaagcttggcgccaacctccgcttctggtgaaagcttcaggaatctacctatcatggcagaaaggaaaggggaagcacgcgtgtcacagggagagagagggagcaggcgccaggctcttttaaacaaccagcgggaactgagaactcactcattaccataaggatggcactaagcccttcatgagggatcctcctccatgacccaaatacctcccaccacgccccacctccaacattgggggtcacacttcaatgagatttggaggggacaaatattcaccatttcaacacagcatctaccaagtgtcatacttagcctctacttcaattcatatgtatattatattcactacttcaattcatatgtatattatattcacttgaggcattcctgtctgtagtagaccttagtgaaggggaatgaagtatttgcagcatcaccagtaacttcaaattgacaaatatcttaacaaatatcacctgggattttttcctctggctagttcaccatacatagagggacaatgtgttattgaactgtatagactctctttatagtctttccctcacctggtagattcttcccacaccccaacttcacttctgactcaattatgcataatgttttagtttttattccataaatgagcctgtggcttgcttttgcatatccagacacatctagatatatgctcagtgaaacaataaaaggcgaccactctcagaatcaatcttcttcattaagcaatcgtggttataagcaccaatatttttcttaataccaaacagtgtaaaggttggtactaccctcattttatagataagtaaacaagctcaaagaattaaatgactcgtgcagggttattcattgagtaagtgataaagtcagattttgaaccattggaatccaaatcctatgcactttccaccaaacaagacacgattcaaaaaggaaattggaaaaaaaatgcatattaatgtcctctgagcttgcaaataggaagattgctttgaaaattcatagtatttgaatccattaggggtgggggaaatgtatttttaccattatggtcccaacagtattgtttaagaaagtagggaaacataagttaagtaaaaagtctcagtaacttggaaaatcctgccttatatcaggtaaatgggacatttattatggctaattaagttttatcttttaaaattgatttgtacattgacttttacctgataaatatttattgatcctctctatctttttcatcatacttcttttaaaaaatagtttttctaatacctgctgtttttttttttacagaggcaattaaaggcagatgctaaaaaagctattggaaggcttcaactacgcacactgaaacaaggagacaaggtacattcatgacttttaaatgctatttattttaaagcagtgctaccaagccattgttcaggctaaatgttcttcctaagtatgcttttattggcatttatgaaccttattgactttatatgcatttgattctagaggttggctgaataatggcctcccaaagatatctaagataactattcccttgaacctgtgcatattaccttatatggcaaaaaggactttgcagatatgattaagttaagggtcatgagatggggagattatcctggattatccagatagattcaaaatataattgcagtgtccttataagagggagagagagggagatttgaccacagtacagtaagggatgtgacaagggaagcaagagggtggggtgatacaagaaagaggcaaggagctaagggatgcagacagcctctagaagctgggaaagataaggagagggattctcccctggtgcctccagaaggagtgcagtattgccaatgccttggttatagacttcggatttccagaacagtaagagaataaacttgtgttgttttaagccactgaattatgataatttgttacagcagctacaggaaactaatacaatgctttagtgttactttggttgaatacgcattttcagatttaggacagttgaaaactaccattcatgggtaaaacatgtatttcaaaaaatagctatagaacttatggaaataatacaccattttaaatcttaccaaagtcatgaaactgtaaaacactaatgaaagagataaatcaaagaagatctaaataaatggaaacatataccatgttcatgggtcagaagacttgctgttgttaagatgtcggttccccaccaaactaatttatggatttgatgcagtttcaataaaaatcctagtgtaaatcttttatagaaattgacaggctgattctaagcttagatgaaaatgcaaaagaactagaatgaacaaaacaattttgataaagaacaactttggatgattcatgctacctgatttcaagaattattttaaagtcacagcagtcaagatagtgtcgtattggaaaaaggatagatttatagatcaaagaaacagaagagagagtacagaaataaacccatatatatatggtcagttgattttccataaaagtgcaaaagcaattcaatgaagaaaggatagccttttcaggaggatagccctttgttggctatccatatgcagtgattggatatccttaagcaaaaaacaagcaaacagacaaaaaagaacttaaatccattcttcataccctatgtaaacattatttcaatagatcatagaccttaacataaaacctagaactatgaaatttttagaacaaaacgttaaagaaaaatattttcatgacttgggtgacaaatatttcttagatataactccaaaaacaagtccaaaaaagaaaaaagttgatacatttggccttgtcaaaattaagaatttctgttctttgaaaggcactgttaaaagaaggaaaagataaggtacagactgggagaaaatatttgcaaatcatatgtctgttaaagggctgtacccagaatataaagaactcttaaaacttaacagtaagaatacaaacaacctaatagaaaactggcaagcaaaacagacaattcaccaaaaaaatatatatatgaatggcaaataaacacataaaagatgttcaacatcattaataattaaagaaatacaaattaaagccacaatgaaatacaactacgcattcattagaatggctaaaatgcatacaactgaaaataccaagagctgggcgagatttggagcaactggtacactcattcatttgctggtgagaatgcaaaatgtatagccaatttgaaaatgtttggcagttccttatgaagttaaaaatacacttaccatagcacctagcaatctcactactagatatttaccctaaagggagaaaaaatctacgttcacataaaaacacaactgttcatagcagctttattcataattgtcaaatactggaaaaaagccaaatattgttcaactggtgaatggataaactgtggtacatacatatcatggtatactatttagcaataaaagtgtgatgggaatcccattgatacatacagcattatggatgaatctcaaatgcattatactaagtttaaaaagccagactcaaaagctagataatgcatgattccatttatatgacattcggggaaagccaaaactataaaaacagatcagtggttgccaggaggtggggatgagaggaaaggttaactacaaagagtttagaggagtttgttgggagtaatagcactattctatatcttgattgtgataaggattaagtgacgacatatttttcaaaacgtgcagaactgtacactaaaagggtgaattttactgtatgtgaattataccttaattttttaaaaatgagaaaagttatagagcttgcacaaatggtattttatatatcctaaatcaggaaaaataaatcagtgctacatgtttccctttgttctgttccccttttgtttcagtttattcttttacctttttaaagtctggatacttttaaatcacctttgggaactttacagttacataatcattcagtgatataatgctcctccttttataggaatttaggctggttaagtacatgtatgttctgatcttgttctgtagtttaatgtattttttcttatctgtcagagtaacaataactacttgcttgtaggaaattggccctgatggagatagttgtgctgtgtgcattgaattgtataaaccaaatgatttggtacgcatcttaacgtgcaagtaagtttgattttcttctatatcttcaataaaatagctgacccacaaaaatgactgtgatggaagaaaactattttgaatatttccaaattaatgtaaaaaatgtttattttttaacttatcttcatttaaatatagaatggtttatttttatttttattcatttcttaataccactgaaattggtataagtctaattgtaatctgcttcaatttgttctaaactaattccatagaaaactgagaacctagccagcacaattgatatatatgtattatatatatattatatatagtatatatactatataatatgtattaatattatatatactatatataatatatattatatactatatataatatatattatatattatatataatatatattatatataatatataatatataatatatattatatataatattattataattataatatatataatattattataattgtaattatatattataattataattatataattataattataatatatataatatgtattatatattaaatataataatatatttatatattatatagtatatatcttacatagtatattatgtataatacatatactctatattatatatactatataatatagtatataatatataattatatatactatataatatagtatataatatatagttatatataaatatattttatatatagtatattttaaatatagtatataatatacatagtatactatataatatatatactatatataatacatattttatataattatatatactgtatatactataatatataattatatatactacatataatatgtattatatattatatattatataatgtataatatattatatattatacattatatactatatactgagtatatatactatatagtgtatagtatataatatatgtatatgtacatgtacatatatatactatatgtacagtatatatactatatactgagtatatatactatatagtgagataatataccatatattatctattatatagtatacaatagtgtatatatactatatagtatatagtatatatatactatatactatatatactatatactatatagtatatagtgtatatatactacatatatataaattgtgtatatattatacatatatgtaaattgtatatatataatacatatatataaattccaactaaggagtgaacacttccaaatagatgctcataacttgatttcattttattttttcttgatagattagaataaatttaaaattaatccagtactatccttatatttatgtgtatttatattatattatgtatatatgtatattatatatttatgtatatatatgtacattatataatatatatactctacataatatatagtatatattatatacattatacactatataatatagtgtatatattatatacattatacactatatataatatagtgtatatattatatacattatacactatatacattatatataatatatactatataatattataatatgtagtatatatagttacacatgtaaatataaggacagtactggattaatgttaaatttattctaatccatcaagaaaaaaataaaatgaaatcatgcatctgtttgaaagtgttcattccttagttttttaaattatccctctcctgaaggttgttcttaacactacttcttttagctatttaatacaatagtgatgctcttggaacatatcacattgcctaaagcatcagtacagtgttgttgtactcaatactatattggactatattattgagaatgactgtaccatttatcagttagggaattctaactgtttaagatttgaaataatgaacaaagtcttaggtcaggtagtgtcctagccattttcaaatgagtactgaaaatatttttttttggagctagagtaatgaggcttttacatttaaaagtaccgtattatggaatttccaaattttgtttctgtgactccttcattttatgaatagtgtgtttaaaaggaaaggcatccattcaaagactaaataaagttacactaagtaatctgttaatatatattaggtaaagtgttgctactttacaactgataattatgtttttttcctgaattagccatattttccataagacatgtgttgacccatggctgttagaacacaggacttgccccatgtgcaaatgtgacatactcaaagctttgggaattgaggtaaacattaatatgttatttatatgaagaatatatgcctgggctttggagaaaataacaaaataacatccttattttttcgctatgtaatacaccatacttatagtttatacctaaaaccagacatatttatatcatatagacaatgaggtgccatcttgggccatctccattttccttcttcctccctctttccaaatagactcattatttggtcagaatttgaaatgataaccatataaaccaccaacttggcatccctctttctgtttttgtaatcttttactattgcatagtgaccaaacttgtagttaaataagcagacataatttgagaaagcataataaatattaaattataattttatatttggtaaatgaaaaaaaggcctattttcaagatacaacataaaatcgagctcaaatcttgacttgggaaggtacatagatgacaatgattctcaagttccataggggacagcatgatgtttttttagggcctaacttgtacccagcattattttatgaagtgctggtatcacccaaatgaacataccagatgagagtgcactccgcctatagcatctttcatcccattggtggacccagttactctgttttgactggggctaacaagagacttgtgatcatcaaaagggatcataggtttaaaaggttaagaaatattgctccaatgagtcacctataaagaaactttgaagtgatatgtcgaggaaaagcgtgtacactgagaggcttttaatttgttacatgttctttaaaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaagtaagcatcatactaaaggttaacgagtgccctgcaatccattgtagatcatatgcctgtatagtactcttgctttttagcgtttgttccattcagccattatcatgatccaggttttttctacttaaaataatgccgtgaaggatgcacccctaccttaatatacatatattcaaatgtatttgaaatagatgaaatgcatcagagtggggattatttacaaaagaaagatttattggaaagcttctctctgatgcatttaaatcttggcttattaactaattacagagggtaaggagaaactttaaactttaggagccattgtttattgcagataaagcagaaattaaaataaaggagttctgaaatgataaaacagaattcaatttataaaagtttgatttatacccaacttctctggaacccatgttttgcaagtaggaaactgtttaagaatggtatgtgctgccacctgttgactatttaccgtgaaatgaacaaactgttagaaactaaaattgaatatatcattttcaaaattcatgtgaatttgtattgcaacttagtaattttatgccaaatgagaaattttagggagttctgtttttccctataaagataaaacccctataaaaattattttccctttcttttacctcaatcttttccatgtttttgttggtttgaaagtcttctctcaatcctcattttgagataatttaattctagtataaaagtaaaacaaaaactgattgtcaagatgacttatgaaactttcagcttcctattatataaacctttgtcctctataggcttatcagtgccatagataccacttctgaagatatcacaatgaatataaccacacaaaggcaaactttgtatttcttatatctaatcttcagacattcccttgaatataaactagttataagtatcttaataatctgtggattattctacctgtaatagagaatcattgtctgattgccccagatgatcttgtactctcataattgtgtggtaatagaattcagtaaagataaaagagagtgtacgagataatttattgctagtcttttaaaaaacaacattccaatctactctttttgtgttctgttcttctgtgggtaggggtggggtgggggaaaaaggtaagcacaacagattttgcagagatttgaaaagcaaatgaaataatgatccatgtttctcctcctgtattcttaatttggatgatagtaatactcacccaaccgccccaaaccagaaactagggacatcccaaattcttcccacttccccttctgtgttctcaattctgtcccctaatttccaaccttaattccacagtcatagtttgagccactatcttctctttgcctattccttccattcttccttacccaagaagttaggggagcccagtataactcctgtttctcctttaagactgacacctctttgagaagcctctcttgactagatgtgatggccctactgttggcttccatagaacttcgatcattgcacttactacactgagttgtattaaaacttttaaagttcttttggataagaacagtgtcttatattcactgttgtctatccagcacccagcacatagtagatactcaaatttatgttgaatgaattaccacttaaaccagatttaattttgtctgggattacatattactagtttaagaatcttgcgtattagccattgattcttatggtgatagttgatttgcataactttgtaaatacacatagttcatgtcgtgtgtcacatcattgggctaagttctattagagcactggttttcaaacttaagtattcattgagtcacttggagggcttattaaaacggaaaggtcaccaccagagtttctgactcagtgggttttgggtgatgcctaggaattttcgtttctaacaggttcacaggtgatactgattctactagtccagggaccacattttgagaaccattgaataagggccctactgtcaatcctggctatacataaaaatcacctggagagattttaaactttgctgatgtttggactgtacctcagagcaactgtgatttaacatgaggtgcagggcctgggcacaggtattttttattttaatttgaaatgatttcagactgactgacaaaaacgtttcaaaaataatacaaagaatgcccatataccattcacccagcttctccaaatgttaacatataaccatatacaattatcaaaaccaggaaatttgctgataaaatgttattatcaaaactataaacttgactcaaatttcaccaactggcccactaacgtcctttttctgtcccaggatcccacattgcatttaattgtcatgtgtccttagtctccaatctgtgacacttcttcagtctttgtctttcatgaccttgacacttctgaagattactggtcagttattttctagagtgtccctcaatttgggctagtctgctgtttccgagtgattaaatttattgtccatttttgtcaagaatactacagaagtgatgttgtgcccctttcagtgcccccatatcataccaggaagcacgtgatgttggtgtcttattagtgatgattcaaactttgcccacttggttgaggtggtgtctgccaggtttctccctttaaagttactatttttccctttgtaattattaaatatcttatagagagatacttggagactacacaaatgtcctggtacttatcatacttctacccactacttttagcaatcattgatgcttcttgcttgcagtaattattgaagtatttaccaaatggtgattttctgtttgcatcattctttgtacatttattgattaaacttctaatataaggaagagctcttccttctcctccatttatttattgagttatttatttattgtactataggatcctagacgtttctttcattctataatatcattctcatcgtttatcccttgctcatatcatcctagatttggtcattgggaacttgttcaagttggtttttgtgttctttcaactttcttactttctggtaacacaaggtgttctaggtctgggattagccaactttttctgtaaggggccacatagtaaatatgttaggctttgaaggccttaagtcttcattttcatactcttatttttttgtttttgttggtttgttttacaaccttttacaaccatgataagcacttttagctatggtttgtaggctggagtttgctggcccctaggctaaaatctaggttaaccttgtactttccctctcctagccctagaatcagccacttcttcaggaggccttttactggagaatagtatttcaaaaccaggatctgagcaacgggcatgcttattgctaccggggtgtcattgctattggcccttttagtgaacaagactagaaaatatatgtatttactctcacaaatatacacatacatatacattatttctctatctgtcattttatctatctatctgaaaaacaatgaccctactaatacatctgattccaatcccacactacagggttcattctagcctccccctttatttatttgtaactcctttctccgacagtgaaaggagaaatattctttttatccacagtatttttacttatttgttcaattatagaatatacataaaatagtttcagcattgctaacacatacccctgtgtaaaacaatgtcagtaactagtgtacagttctttttgtttttagccttacaggttagagtcaaaatactgttttccaaagttatttaagtttagttgttttcttccccattctcttcacatggttatgtatttcatttataatacaattaagttcatttattactgtttgtattcaattcaattttgggcatccttccaacttcctggttgattttttaaatctgtctatctatatttatgtgaatgaagaagcactggtaattttttaagtgcccaggtgattgaaatgtatagccagatttaacagcttgttatatttaaggtaaggaagaagtagaagacataatttttgctcttaaggaggctataatctaggtagaaataagcacatgtacgtgaatcaaaaaagcaattataaatcaatataataatgccatatgtgctttatgtaagatatagcataaatcatataattattagaggtacagggaatgaatatggtaatcagtgtatgttgaaattaaataagaaagacttcttggaagtaaatgttgaattttgtcttaaaagaggagaggggcaaaatcatcctaaaattgctatttctttttaaagatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaa

SEQ ID NO: 3548 - DNA, 70329 bp, human
cttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgcagctactagattgcacccctccagacctctgccatggccagtttctcttattttcctcattgccctcctcgtcctatccccttgctccgaaggaaagtgggtgctctttctgtccccacggagtggggcagggtcctccccgagattcaccaggcctgggtgttgggcaaaaaaaaatccttcatttgcctctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtcttagagtctgggttctctcatcagtcaaatgagaatgaataataagaaaacttatccacaagtttgccttcaggataaaatgaaataatgccttaaagagtttagtgcagtaaagcacatcatccactctcagtaagggttagctgataggattagccttctgggagtcactggaaggaagaagctgcttatttgactactggaggttttctgtttttcttaaaaccttatgactgaacctgcctagagagcacttgtattgagtggctggatggcgtaatggaaagaacactgaattggaactcaggagatttgagttcttttagccccttctttgcctctaccgactttgtaaccttgtacaagttactcacatgtcaaatgattgtataggcagtggaggccaagttagaagcgtgtactgaaacaaaacaaaagtagatgaactctaagatccctttcagatctaaaatgctatgatttttagtttttatattgattaaaggagaaactgtatctctcttggccgataattcattgattagaatgaatcagtagcttttagaagttactgaaaatcaagaataaagacctaataaagtttatagtctttatatttcagttgactgtctaatagcaagggtttgactttgtcttctaatgagattcatttgcatgaatgatttgtaattgaagagtatttaattacagagtcctacttagaccattttccttttacttctgttaagggtatttatctgatagttttaggagacaataaaattaacttttgcttggctcccactatatgccaggcactctacatacatattacttatactttattgagaggcaatatggtgtactaagaaaaacacaggcattttagtcaagattgggaataaaattctggatttaccacacaatagctttgtgtccttggtaggattatttaactttactgagccttggataccccatctgtaagatggagataatatttatgttgctgtgattattaaggattatatatatatatactacccagctgataatagtcactgaatgttataataggttaatgctaacaggatgcaaaaaaataatgtacaaatgtatgattgtgcaactgtcgatttgaagacatgaatacactgagaatctaactatgggtgttgtgtttcaggataccatataggaataaagccctaaatattgatcactaaattacactacattcagaaaagcattttgatactttaaaaacaatattatctgagataaaggctataccaaagtttgccatcaagctaactagataaaaccagcaaattacttgaggtaaggaatcacatttctccttgaactcctggaaaaactatttttcaatatagggggaaaatcactgcatattatccacatgtgttattgaatatttgtttgcaaagtgttatattgtttgctttactcattcctcagagtaagcctagggtttccttttaacctctggtcaaaaacttatcttggatcatagtggcagagagataggactgagatttaagtatggattagttcattatatattgctgtgaattacgaaggggccaccaaatgtggaaaagccttctgtatcttctttgtttacaaaatctctcttcactcactctcataggggcctgcacttgaattgtttgcccttggttagagtttgtgctgagtgtctatattcccacctaactaatttagaacagttgctttaaaatttttgtttaggagaaagaaactccactatataagagcaatcaattaggaaaatgagacttttatgtataccaaaatttttcaaaagttaattgtagcctaacatcaactcatgcagtttatttctgtattttgtttgcagagtattcagaaaattctgattcacacagataaataattgcaaatgacagatgcttattggcagtttggcttgcaatctctggatatatttcaatcaaatcagtgcagaaacctgaaaggaaattaggagaaaatttttattccaaagtgtaattactattcaaatttcttatcttaaaaatgaaagtcagataagtggccaaatcttaaagtaagcattaaaaccatctaaaatgtaagattgtcacgagacacgttaagcatgttctcactattgcacaacaaactgttctgcttacgccaggcagatgggcctgagctttgcctggtgtctaattgagcacaacccacaggttgaagagatatgtatacttgcttgtacaattttccttgagtcaacattgtaggcatgaatttattgaaagactggtgcagaactacaaccttcataattcatgaaacatttacaacgttatgcataaaacatatgcaaagggatgtcaggagaagcattattcctgagggctgtaaaaaaaaaaagtgaatgaaccaagcagtttaattaatgatttgggggtctccaatgggatacagtttgatatataacacagttgcttgtgtacattgttgaaagatagtggaacagattagttaagaggttgtgctctgccaattagtattttttaaatcttaggccagttattttacttctctaagtctcagttttctcctatgtaaggtaggcataataataaacttgcctcctaaggttgctgggattcaatgagataatgcagataaagcgtttagcacagtgtctgacatataggaagctactattatgttttaatcacagttaaatatattttagaaaatgaaagttgaatcctgtgtttgtagaacataattggaaatgaacagtctagagtacttcaaagtccacattacctgaaattctaatttgatccctttaggtacggagggtagactgaattttaacaggaaaaagatcttttggtcctcctatgtttgttgtacttttctcaaataactgcttctccctcctgctaccaatctttttccgttcacagaggaccttggaatagtatgtttgtactacttaatcaccacccaatcccttctcaaccattttatatttaagttttattctactttttctagaatgttgactttgaaaataaatctttttttaatagagaagttcaaaagggattggccagtgatgattaaccaatgtaaaatactattcccaaagccattttcagatgtagccttcttggtacctctgcaggactgtatttgacactgttgactgcctctttaaaactatcccaagtagtgtcttccttccttgcctctcttttgtttcattactattttattaattcatgcatctgacacttctcacttgcatcccagactcctagcactcctcctccagtaaatagatgccacatcctgttgattctggcactttaaacattctcacatatgtctccttcttccttgctttcaataccctgctttcagttcctgtgtcttctcatgggaaaaaatacttagcctcttgattggtctccttgcctccagtagtttttttcctagtatgcagttcttcctccatgccatcagaacacagctctgatcacatatatgctattacttataaattttggactacatttatcagcatggcatataaaactcctagtaatctgatcccaaactacattcaaagctttatatgtctcttctttcatgttggtccctaaacattctctattcttttccactaacattcctttgcttctgctattgccaacagacctgtttttcttagctctgctagtcaaaaatttacacatccttcaaaatgcaacacaaatgcctcctcatctttgaagcctttcttaattctttcttttcctcttcccagcacagcccacacccaaaacaaagtatagtaatctctttttgttccaatagcacttcctctcttatagtacgttctgcattttgctggtaattatttgtttacatattttaccttctactggattataatcattttaatgttttgttaatctttgtaatctctatagaaacctttgtactatacatgctctagaaatgcttgctgaattgccttaaacactcaagaactctaatgccagaagggtcacaagattcactagaaaagtatctagtggatcggaattcaattcatcgagcatttatcaaaggtctgctgtctgatagatactgtgcttcttgcctgagtatacaaaataattaaggtaaagtccctgccctcttaagcaatgtagagcctggtagaaggaagaagagcatacaggaatagagtgtacacatacttcaagattgctggctaacttctatggtgattagcctggttttatggatttttaatggcaaaatgccctaggtaacaagaaaataatgacaaatgacttttcatattgagttttccctgtgctggggtgttttatttttttgatcttttaaaaactacaccagcattatatttatgtctccaattaaaatgcttccattgaacatgttggtgaatgtgaaatttcataaagtaaaaatcttttttaaaaaaaggaaaatagagtcagccccctatatctatgtccacatctatggattcaaccaactgaggaggaacaatatttgggggaaaagaagcatctgcactgaatatgtacagacctcattttcttgtcattatcccctaaatgatacagtataacaactatttacatagcatttacatcatattaggtattataaataatctagagattatttaaaatatacaggaagatgtgcactggttatatgcacacattgaaccattttatataaggaaattgagcatctgtggattttggtatcattgggaggtcctgaaaccaatcccccatggatactgagggatgactatatagcttgatcagtgaattgttttctaagcacataaataacttttcccccctcagtccctggaagatatgtgttttcaatacagaatgccacattttaactctgttcacactcaaatggacagaaaagaggagagtactaaagacattttctaagtaattttctgattataaaattaactgttatagaaaacttgaaaaatacagaaaagtgtaaaactaaaatacccataattctacaacacagatgacaccattaatattccttcttaccttgatttctgtacataggcataactttgtattctacttttgtaatagttaattttttataaatattaatgtagtaataaaatacagaaaaaaatgaaaaaagatatacaaatctgttttagcattggggggattagtcattttattcttttttatttatttattttttttgagacagagtctcgctttgtcacccaggctggagtaccatggcgtggtctcagctcactgaaacctcctcttcccgggttcaagtgattctcatgcctcagcctctcgagtagctgggattacaggcctgtgctaacacacccggctaattgttatagttttagcagagacagggtttcaccatgttggccaggctggtctctaacgcctgacctcaagttatctgcctgctttagcctcccaaagtgctggaattacaggcgtgagccacagtgcccagcttatcattttattcttttgctctgtatatagatatattatttaaagaattatatactatatatactagttttgtatactgctttctattgtaagaatttctccatgtatctagaaatagaagatggtcctcttgtagttgaaggttgtggtcattgactgagagttggggattgagcctctctttctttagctaccagaaaggaagtgaaaaaatggagatggggagggttgtgaattggggcatttaaataaaaaatatgcttcaccgaggtttacattgaaatatacttactagccttaaacatggtctgatctaacccatatgcattgcctattgtggccttggtatttcttagggtttgatcaccacttgtgcttcagttcattttctcccccaatattcccataggtaatgcctttttatttttctttttttatgtcttcttcacaattgaggtttgcacctggtttccctgttgcttttaagtagcttttctattataatgatggctactgaactataaactattgttggtgtttaccccaaagtttatttgataaggcaccataggtatttcctgggaataaataatttttgtatatgtaagttctatcgaagtataatatacatcccaaaaaggtacataaatcattgatttagctcagcgaaatttcacaattgagcacacctgtgtgaccagcgccctgctcaaggaataaaatagtaccaaactccagaagagcacctcacgctccaatatgaagaatttttgatgtagcacaattatcaattttgtttcctgagggaatgccctcttgcagcatgtggtaggagcccagtcacccacagaaatattctcctcttcactgcactggggttattttatggtggtgatcctcagctacataccgtagggagttattaccaagcacagagtatatgcacctttccaagccagttcagaattgccacactttgctgtacaccaccaccttggagccctatgggcaaagtggaacacaagggctctttgttgtgttatttcctgttctgtccttttctttttcagctgtgtgtatgtccttccatgcaccatagcacgtagttactgcttgaatttaccgatagtcttagtgcaatattgatttatttattaaggaaagtttggtgattcatgctgacctctgggaaactggacttgatgaaggttgttagctccagaatctgctcatgaattacttgcttttaatacttgaatgaccaagttggtacaaatcagtaattctgagttaaccctattcattttgaccttttttgaaagaagatagtccttgagctcaatagttgatatatgtttctctttaaatgttaacttgtcatttcagacaaaatgttgaaatagcttagttaaatactgcctgcaactaaaagcgtcttagcttttaaaaagaaaatgcaccataatgttaatattgttggtgaaattataggagaaagtatttgttctcttcattattatttttctatattttctgactttcttataatgaatgttttacttttataatcagaaaaattcgtagttttaaagaacccaaaatactccaaaattattgatagatcctaaagaaagcattactaatgtgactatagtgacaacaggaacaaagcatatctgctcatagaaatgatttacaaactattatgagaatttaagaattgctttggccttttgaatatagctatctaatccatatgatagttggtgttaccttttattgttaacactggtttcttcatgtgccttgacgactaaaagaattttcaggactgacttttcctattttaatatggaatctttctcttctctttacccattgtatcactagctttttttaccctccccccaacacacacacacataaaaaaatgcacattccatgcctttctttgtatttttgtttttttttcccgtaagaggcctgcttaccctcattagcccccttcagtatccattctactcaatactgttaagattagtgctaatagctcaatatgaagaattcaatatattggtaattttcatccatgagacactgacttcatctaatggtgatagattttgtcattctagaaaataggaggaaattgtattagattaagggcagaagggaatcgtgatattcttattttacactttattaatgatagaacacacaagctcatttaaattgagttacttgtttttaaaatgagcatttcccttgggattttattcagctatataaaattccactagttggtggtttatacaagaaactgtcaagttccaaggttgctttggtaccacttattttcctcttagaatgtattttgtgtcatacttttctaccctcctctgtctttcataacatgattaattttaccttaggtaatcttacacatacatacacacccctcttagagcttctttttccttttcaaaaattttgtgcttccttctatgtgattccacttcttttgatgtagtagtaaacattatagcaaaccagtactctcaaaatctaatgaccttgaaggtgtccataacttactcccataaattctataaaaaccacccattaaccatgtaatcctcctgattaaatacacatttccttcatgtaccagtattcatgataaatttgatgtgcctttgttttactttagatattgcagtgatactgctttctgaaaagttttattacaaatatgggttaaataataatttatatttgctttgcagttttttgtcctcaaagcactttcatatgtaataatctttgagctcatttgagaacccagtgtttagcaacattactgtgggaaaatatgttgtctctacttccaaagaactggtttacaaatgaacttttaaaacataacctactagtgtttctattgtggctgttcattatgatagccccatcgagtatggattattatattattcccaaccatgctggtttagggagttttaattcagtttctgtgtcatgttgaccaaagttctgtctcaccttttccatgtacttcaccttaaagactacattttgttttcttaatctttgaggatctcagatgttggcttatcttaagagcatttgtaatgtccctaaaagtcttaagaatgtatcttaacttgatttgtggcttagttagtcatcagtagattttctttttttattattattattataatactttaagttttagggtacatgtgcacaatatgcaggttagttacatatgtatacatgtgccatgctggtgtgctgctagattttcaagtacagttgtccattggtgtctgtggaggattggttccatgacctcccgcatatactaaaatccacagatgctcaagtccctgatataaaatggcatagtatttgtatataatatatgcatctcctcctatgtgctttaaatcatctctaaaatacttataatacctaatacaatgtaaatgctatgtaaatagttgttaatagcattgtttagggaataatgacaagagaagaaagtctgtacatgttcagtacaggcactttttttcccaaacatttttgatccttggttagttgactccatggatgcagaactcatggatatggagggctgactatacatctcttatcttcgaagatttcaacagtcacttggatgaaagctagaaaaaatgtgattatactgagtgagggtttcattcatagaaccatgggcaatctatattgaacacaattccaaaatactttcataggtgtgtttcaatcaaattctttcatcaccagttcattttggcaaaagggcaggatatgtaagaaagactgaaactggatggtgtgaaatcaccaattacctcccttggcacaaaccataactgccattatttttgctgctcctctatggctgatgctttttggttgaactggctagtaagacaaaagaattgacttactttgagtaatgtaattaaaggccaacagatcatcatttgatggtaaggaaagctatttgattgctctgtttttatttcaacctattgtaccaaggtgaatgtgttccatttgaaattgggggacagcatattgcaatggaagcaggtgtccttgagtcagacagcttgatttgaattccagctctaccaattaataaatatgtgatcttgggcaagttgttaacctagaccttatttatcttgttcatcaaaagggggataataatacctacattttccatgatattataaatcaagtgtttggcaggtagtgagcatttagtaaatgctagttctcttgaacctttgctaataatttcattactactaaacataatacttctccattggttattatagatatttactaccacactttgaaatatgtaattgtttcatatgtagaagcagaaaaaacggaacatccatattgcaatttttctgggcagttcctgaaaaatgcaggaagaaatcacataatcaagaaactgaaacgactatattatcttccttctccctggtgtatttccattttaagcaaaagcaaaaccttaaaatcaagatattaagctctaacaatggaaatggctatgacccttttgctggcacagtggttaagaagaggggacttaggaatcaaatggatttggtatgagtcccaactctatcatgtaaaactttgtgaccttaaccaaattaatctaagactcagtttcttctcccatagaatgggtaatataattgtctctatgtcatagggttattgtgaggtgtaaattaaataatatatgtacagtgctcagtgcacatcctggtttattaaaggatagcttgaccatctccttaccctcatctatagcccagctttggagattggcagtgtatatcactgcagggcttcttagagcctctaatatgcaaaagaaaccctgtttgactttgttcaatgcattattttctgaatttatctgcagagtcctttttgtctttccaaatacttaacatccgaaatacgatttgggtagcactgattatcagacacttaacaatttctctcttctattctcttctcttctcttccttccttccttttttccttccttccttccttccttctttctttctgactttttttttgagacgcagtcttgctctgtcacccaggctggagtgcagtggtgcaatatgggctcacttcaacctctacatcccgggttcaagcgattctcctgcctcagcctcctgagtagctgggattataggagtgtgctaccatgtccagctaatttttggattttagtagaggcggggtttcaccatgttggccaggctggtctcaaactcctgacctcaagtaatccgcccaccatggcctcccaaagtggtgggattacaggcatgagcaaccatgcccggccctcatattttaactgtgtcaaagctttgtcaatgtcagagactaaccaataaagttaacctcagtatgataggaacagaatatattcaatgtgatgacaaatattctttttttgtactaatatggtagcttttatatcaggtttatgtggctttaaagtggttctacatgctaggtttattctctttactgactttcagaaacaatttatagtgaaaagataaggacataagtgagacagattcatgtttggttttataattcatgtgtggaccttaatgtagaagctagcttttgtaatatgtcatacaggaggaaatttaatatactcaggtactagaatgttcttttttatagattttttggtacctatatgataccaaaagtcatgcagaggcatcccaaattctccttttctctaatttgagtacataatggaataataactaattggactactggaactcttgcacccttggattttgtggccaggtcaaaatgaatacctaatctctcaacataatattcttcctaactttaatgacaaatgcaatttccaacccaatccccatattaaaaactatacctgaagagaatgcacataagaagaagcaccaatttcaataaaagtttgaatgcccctttatgaccagcattatgctgaatgttgtagtaggagaaggggagtgtgtaagcagcatgctcaaaacaatgatagtgttttttccttccagggacctcacatttttagcctctgttgttgttgttgttgttgttttgtttgtttgttttgcctaataatattttagtctggcacttaaatgtcaatttaggtagggctttcagatctacacaaaaaaattgcattgactagagtttggcaacatttaaggtacagagtacaggtacctttcatgcattgttttactagttccacctggtctgaaaggttcaggataaagtggtgaaggtcatgtcccagtttcattgtaagtctaggctatgacctatgcctgtacccatatgtttgctcctaaataaacaattgaataaacagtggaattctcctttacaagggctcacattataggaaaatacaaccaacaaataatttttactttttatttttagagacagggtcttgccctgtcatccaggctggagtgcagtggtgcaatcatagttcactgcagccttgaactcctgggctcaagcattcctcccgtctcagcttctcaaagtgctgggattacagacatgagcaaccacacctggctagaaccaaaaaataaaggacaaaaggaacaccgtaatttctaatgatcatttgtataaattttctctctctaaaacctcaaagtctcctgtttgctcctttttttaaactgcccgacaaataatctaattatttttaaccacttgtgtatatcttgttagtcatagttgtttcaccttttcttatcaaatagtcctatcagattctgaacagctttttgtatttcatagtttatgggattgaaaatgttgatggtatagagtttactgactagcattcctctagaaaacataaataaatagcaactgcaaatgttaaatctggcttctagaaaccttaccaccccaaaacagaaacaatgacaatagaaaacattggcataaaaattttaatataattacagaataccctatttatcaatataataacatatacactataatttctgcctggccttgcaatagcatatcttatttttttcctcagtatcagcagaaatttaaggttttatagagactcaacctgttctggatgcttcaatgcttctcttttatgccctctgaaattcctcataaccatccaagccatcagcctactagtgaaccaggatgactgtgttttaacttgagctttgggctaaaatggcatgtgtaccagcatctgaatggaagtttgaaactgaggtataccaaagccccatgttggaaggggattatttgtcaccattaatgcagctctggaagtatggtaatttcaacagaatcagcactgtggcaataagcattccactaaacccaaggtctataggatagaattagtatttaattttttatctgtttttgtgataggtctttgctgtaggcagacatgtcttgtctagatatgccatctttatatagagagaggacgcacaccttagactgttaaccacagttatctttaaaagatgaatttgttttcagattaaatcaaaattcaaattatcactaaatatattatacttaaaattgcattcatcagaaatttatttgacatgtgttatgtggtaggcactctgctagttgctatagatacagtgatgaaagacctagtccctaacatgaagttcatagtttatgaaggacaaataaaccagataactttaagggaagtctgtagtagatagtgtaaaagcaggacatctaacgcagtcaggtcagaatcttataaaaggaggttcaattttattccgtaggtgaaatggagctctttaagggtcttttgaaaaagaataatgtactttttccttttagaaatgtttcattagtagccatgaggagaatgaattagaagtctaagactggtggcttggagaccagctaaggggttgttaatggtgatttaagtgaaagataatggtgacaatggagatataatataacaggaaaggaatgggactatttctgatatagcaaatttttaaaattctatgtgaagtacattacatactgaggaaaacaaaataattctattggcagagtttttctctgcatggtaaaggattggcattgatctggacagagggaatagactgctatcttgaaactctttgaccttaatgtttgaaaagctataaacaaactccaatccagtatttctcaatgtattttccacagaccacatgcagcaaaataacccacagaacttgttaaacctgcagattcccaagccccaccccagacatactgaatgaaggaatggggcccagagagctcagtgttttaacaagttttccaggtgattcttctgcctattaacgtttgaggatcatcgatccagcacaatggttctgaaattatgatctggggactactagtctctgagattctttcaggggtccatgagatcaaaactatttttataataatacttacacattgtttgccttattcactgtgttaatatttacacagatgatataaaagcaatggtgggtaaaactgctgtcaccttaacacaaattaagactgtggcaccaaactgtattaattgtattctctacctccatgcacttcaggaaacagaaagtgctagtttcacttaagaatgcccttgatgaatcaaaaagaataattaattttattaaatctctaccctgcacaactatgtatatagtgtgtgtacatattgatatacatatatgtatatgcacatatatatacatgtgtatatatacacatatatatgtatttctgtgtcatgaaatgggaagtgggcataaagcacttcaacagcataccaaagtatgatggttatctgaaggaaaagcacttgtatgactgagtcatgagatgaaatagccacttcaaacaactctttaacttgaagatccactgacaaacaacagttattcagacttcagtcctatttggaagatattttctctaaagttaactgggtgagcctgtcatttcaggaaaacaaatgacaatatttgttgccaatgataagatttaagtttttaagcaaaaatcagaattttgaaaaacttttatctactatgtaagcataacttcccaatacttagacttttctaatgggatcaatggtgatattaacaactgacttttttgttattgttttatcttgaaatgagtcaccatataactgcataactcagtgaatctgcataactgagtctgcctaactgggatctatgtaacacagtgagccaatattttccaaatgaccaatgcatgatattgcaaaaccccatataaataaaagatccattcaatgtgtgagatagaccaatggattttcatttaaccaagtagaaagaattcattgatattgtttcaaattctaccttgcacatagtatttaagaaactaccatttgttgagttttggtgtagtatcaaaggataatatctacagttatctgaaaatgctattgagacatccatcagttttccaattgcatatctgaatatagtttcccttcttgtgcttatttgacccagccatcccattactgggtatatacccaaaggattataaatcatgctgctataaagacacatgcacatgtatgtttattgcagcactattcacaatagcaaagacttggaaccaacccaaatgtccaacaatgatagactggattaagaaaatgtggcacatatacaccatggaatactatgcagccataaaacatgatgagttcatgtcctttgtagggacatggatgaagctggaaaccatcattctcagcaaactatcacaaggacaaaaaaccaaacatcgcatgttctcactcataggtgggaattgaacaatgagaacacttggacacaggaagggggacatcacacactggggcctgttgggtgggggaaggggggagggatagcattaggagatatacctaatgtaaatgacgagttagtgggtgcagcacaccaacatggcacatgtatacatatgtaacaaacctgcacgttgtgcacatgtaccctagaacttaaagtataataaaaaaaagatttccttcttgtgctttaaccaaaacaacatatcactatagatctcatgcagaaacagctatgaagattcagccatcttttattacatctgatattacaggttggcacaaatgaaaaacaatgccactcttccttgttacattttgttgggaaatatagttatttttaatacaattaggttaattactttaacatgaacttatgattattttaaatgaatatatatatatattgagatggagtctcactctgtcacccaggctggagtgcagccactgcaacctctgcctcccaggttcaagtgattctcctgtctcagcctcccaagtagctaggacaacaggcacgtgccaccatgcccagctaatttcttgtatttttagtagagacggggtttcaccgtgttaaccaggatggtctctatctcctgacctcgtgatccacccacctcggcctcccaaagtgctaggattacaggcgtgagccaccaagcccagccgaataaataaataaatattttttaaattcctccgtgttaatttctaatgtggtaaatatcaatagaaataatctactaaacaaaagttatttggagttctcaataactttaaagagtgtaaaggggtcctgagaccaaaaaattggagaattgctgatctagcccttaggttctatgtgatacgttaaacataaccactagtggaagtcagaatagttcaagcaggatcaggtgttttatataatatttctaagaattgtttacctatgagtgtgacatgtcatccacaaattattcatctgtgaccttttgaacagtgtcatttctaattccctaatgtctttaatatactgtttcctgaggactccatctaccagagaatttttgtgctatatcaagtatgtgacccatttcctaatgtattattgccttcaaaaactacagcaaaattatctagaggtgcagggcagaaaggcaacttgctgtactctacattagctatgtgcctttgttgattttaaaaaatggtaataaaggtgatttgggtcacattccctgcgatacaccctccctccaaaagatgatctgtgataatccagaatattaagaaccattgctttaatcaacagctaatctgtactaatgcctattctgcaacagactagattttaacaaaaggctagataggaggtgtctaagttcatttgtgtggctataaagaaatacgtgaggccaggtaaagaaagaaaagaaatttgggggccaaataaaccatattcaaaccatagcaggaggataatcactttatacaagggtatgcactactgattttgtctggttcctagtgaaacaccgatatataatccagatacttttaagaaatcacttgtgtatttgtttctttgatgaggtacactgatagtaaatacatatatatattgcaagaactgctatgaaggaatcaagaaacgcaaatttggttcatctgtgactgagaccaatcaaaaggaaacaaaaaaagttgccactaaacaggactttgaagaaagagaggctagtttggcttaaaagtttagattttttttttctgttttgaaaaatcactacttaggattcttggtctgatgaagtttggtatcaccctttgaaataattgtccttccccagttgtctgaagagtttgggatataggaggaaaagccaagcctttgaaaagctactgtggacaaaatgaatatttagaagtccacttgaattggttccagattttataatggaggaaatgtttgttacgttggaactctttacacctagatcttgttcattctggatatcagcaaattcagaagtgctgaccctattgtattatcaggatgtttggacagtattgaatgtagttttataagaagaactactttgcccttcagttgcccttattattctcattgtgaataacctctattttctaatatgttaatattagaaaatgttagttgaaagagatactagaacagcttccttcaccttgtattttgtatttcaatgccaaggtgctgtaagtatgttatcactatgctagaatatttaatatattgtaaaaatattttagaatttattttacattttaacacgttaatattaaatgtggggaaaaaaaggtccagaggcacagaacttattacatagttggtgcttaataaatatttgttcagtgaatttgtgtttacaaataagattagacaaaaaccataatatcattagctttttgaaggaaatgaaagaagttggccaccagcaggatcctacagtggatttctatacgttgtgaataataatttttccccaataatgcccaagatagacattctttgtattaacattttaattgaatgatattcaacagcaataggtaagagttgctacagcttatttcattacctttgttcccaagataggtaaatgccaaaaccttttttcactgttaaacatttgaaattgaatctctatttcttcttctacttaattgctacctatttctaatctgtcccttctcctaagatactttagatagcagaatgaaaatgcatgaaactctagccatgtctcgttattattaatgactattaagcttgagaatttctcctagaattggaatctgtaactactatatacatttgttgtatcaagataagtgtgctttaagttataatggactcaggaatctatatttaagtaataagggtccagattaactactcttgatgactaaattgtcaaatacaaagtggtataaatacactggaattataaaaatgacagctttttctgctattcaactctgaaaatgtaattattagatataagatttatgagtaaatccttgattgatctctacaaatcagataggcatttaacaaataaattttatagtttgtgttaatgatttttgcctaacagtccatgaaagaaaagggtgtgaatgatctcacaattacctttgaaacaaagtacagatttagaaagattgaaatcttgaaaagacagctgttctgtgattggggtttagactatctgttgtccaattatcagtttttctcatcagatacttttagcaaattaaggacttttttcttttctttgggatgagcgctatgtttgtttagaaaaataggatgaaattaataaatgatttggagagattctataaggatagaagaaatgtagtgatcttcctttgccagacttgattatagaaccttagaaacctagcacagcctgacctccttcatgcagaagatgcaacccaatcttctgatcccatttgagttactttggctacattatactgtttctctctcccaaactgtagactgtttcaggttaccagtttttaaataaagaacactatcaagttgagaaatatcaaaaccaatacaaaacaatttgttattttacaaatcattggacattgaaggaaaataaattttcctttttattctacttgtatcagtttgaaatgtgatttgggaattattattttctactactggccataatagtagatatatacaattcatttcactggcttggatcatattcttcctagtgatgaatatctaacatacggaagatatttgcaagtgtgtagagggcagggactgcactttattactctctatagccccacaggctagcatagtgccaggcatgtgtgtagatattcagtaaaacacttaatgaatgaaattaagagtactgtctgtcttctgtataaccggtccacaagaaagttaatggaaccatagctttgatcttattagtgctacgttttaatcaactgagctatgtaacccatttttggcttcttaagcctggtactttccaaaggaaatagttgttacagtgaaattttggacagaaaagtggaaaactctagaacttgtacaggaatctatgtattagcatatcaacattggttttaaagatcagctctcaacattttgagaaaaaaacataattttacagactgtggtaaaactgattccatttgtataatatggtgttgttttattatgagagaataacaaaatttgctgataagcaaaactcagcaacataaacaacatagattcagtgatatggtttctgttcattggacttgtgttcttgagggcctgaactcttgttttcaaagatcaatttttatgagcacttaaagaaatgctttgatattgcagcactatttacaatagccaagatatggaatcagtcatcaaaagatgaatggataaagaaaatgtggtatgtgtacacaatggaatactatacagccttaaaaaatgaaatcctgtcatttgtagcaacatggatgaaactagaggatattgtgtcaaatgaaataagcaaggcacagaaagacaaatgtcacatgttctcactcatgtgggagctaaaaaagtgaatctcatgaagatagagagtagattggtggttatcggaggccaggaaggggagggatgaagagaagttgtataaggggcacaaaaatacagttagacagaagaaataagctctagtatacaataatacagtagtgaataacttacagctaaaagaattgtaatcttctcaacacaaagaaaaataaatatttgagatgacaaatatcctgattaccctgatttaatcattacatattatatacagttatcaaaatatcacatttatcacaaaaatatgtacaactatgatacatcaatttttaaaaaaggaagtgaatttttttctcaggcaaaagatgatattttaatctatctttgaaaaaaatgccatccttcacattttccaaaatcttgtttaatatgagaaaagcttctggtcctgtgtatgttttaaatattcccttcactttctattccctaacacactgaaaatcgggagattaaatatctatgataaattctgaacatgaccacatctatattgcttataataaatggctaactttacatctgaatgttttgtggtcctttagaaagataacttacaaagtcactaattttaatttgaaaggtttggaattcgctggcgcattataagagaccctttccaatattttaaggatagaaaaaagctaaagggaaaaagaggctcaacaaggcctgctgtagcaacagaaacacacaacaccacacaaaaaagcacacacactaaaagggtttctttcttgttccacaaaggaagtttgattgttcttccttggagtttcagggtacatattttgtggttttcaacagagtaacaagtagaaacacttaatttgggaatgtgcatgggttttcactagtttttaaacataagtatgaggccagccatggtagttcacacctgtaatcccagctctttaggaggccatggtgggaggatagcttgaagccagaagtttgaagccagcctgggcaacatagtgagacccctgtttctacaaaataaaaaaattacccgggtgtggtggtgtacacctgtattcccaactactcaggaagctgaggtgggagtatcacttgatcctgggaggtggagactgcagtgagccgtgatcgtgccactgcactccagcctgggcaacagagcgagaccttgtttcaaaaaaaaaaaaaaggaaattaggtatgcacaagtgaaaagaatagcaaagtaaaatagttacagattttgaattgtatttagttgtagttaagcttttttaagactaggtaagttcagtagtgagaagtggggaaagagtagaataagcagttcaatctgtaactgagtgaataatcaattgtacttaagttttgaatctgtaatgtccagtggtgagcttgttcagtcagttgtacacatttcatcccaattccacattcacgtggctatggtgggagtatttacaccatggaaactggcacacactacacattagggctttctccaaccctgagagcagatttctaaacatttactactgcacccatgaatgtgcctatttaattttcacttttacagttaaataacagctttaggtttcattgaagataactagtgtagaatggtgaagagcagagataccagagccaaactatctgggtacaaataccatttcttcacttactagcttgtgttaccctaggcagttagtcaaacttatcattaatggggatagtagcaatgcctaccttatagggttgacgtgaggattaaatatgttaagggtctgttttatagataaatcttatctggcaacctcagaaatccagtgcatagccaggattcaggaaataaacaaaaacatcactgagccaccaatgtaaatgtcagacagagggtacttgccctgaagcccccaagctttctctagaagctaattttactctttctgtagaaccaagcttgattgtcttttctgagccaaagggatattagaagcatgacatcacacaaaaaaaaagagagagaggagagatgctgctagaagcaacaactgaagtgagaaccttcctccctcaaagaaaattatccaatgtgagaactcaaaaatgagtcagactgcttgattgctaagatctgttccatttccaaaaatttatgacaagagtgaaaaattgcaacagtttagaaacaaataatcttactactatgttaaataatggcatacaaagataatccactgtcaataataaatcataatcagtatctattagttaagaaaataggacagggagcaagatggccaaataaaacccaccagtgatcatcccctccataggaacaccaaattgaacaactccccacacaagaaagcatctttgtaagaatcaaaaatcaggtgagcagtaacagtgccttgttttaacatcatattaaggaaagaggcactggataggataggaaagatagtcattaatttcttacaccacccctccctcatcccctggtggtgcagcttggcacagagagaaaatctgtgtgtttaggggaaggagagcacagtgattgtgggactttgcatcagaactcagtgctaccctgtcacagaggaaaacaacatggggcataattgtgcccatacccatggagggagcatttagaccagccctagccggaggagaattgtccatccctctggcaagcctcaccactgtgagctaaagtgccctggggtcctaaataaatacgaaaggcagtctagaccaaaaggactgcaattttgaggcaagtcctggtggttctgtgctgggctcagaaccagaggacttgcggtgcatatggccaagaaagcgtttgcatcacccctcccccaactccaggcagtacagctcacagctctgggaggagaggaaagattaaagtggactttgtcttaacatttggataccagctcagccacagtaaaataaagcaccaagcagagtcctgaagcccacactccaggccctagatcctggatgacatttctagacacaccctgggccagaagggaacccaccaatttgaaggaaaggacccagttctggaaggattcatcacctgctgactacagagcccttggaccttgaataaacattattagtagctaagcagtactcaccatgagccttgggcaaggcttcaggtgtgacccagcacattcccagctgtagtggccaaggggagagactccttttctctgcttgaggaaaggagagtgaaaagtaaaaaggacttcaccttgcaatttgggtaccagttcagccacagtaaaataaagcaccgaatagattcctaaagttcctgactccagaccctacctcccagacagcatttctagacccaccctgggccagaagggacaccaccaccctgaagggaaagacacaagcctggctggattcaccacctgctgattaaagaacccttgggccttgaacaaacagcaatactcaccataagccttgggcaaaacccagaactatgctggtttctggtctaatgcagctcagtcccagcagtggtggccacaggggtgcttgcatcacctctcctccaactccaggcagcacagcatggtgagagagattccttttgtttgagagaaagtaagggaagagaacaacacattctgcctggtaatccagggaattctcctagatattacccaagaccaccaaaacagtacctctactagtctgcaagagccacagcgttactgggcttggggtgccccctaatgcatatatggctaaagtgaccaaaaacttagatcacaacactcaattccctttgaatgcttgaaaagcattctcaagaaggacaggtataaacaagcccagactgtgaatattataatacctatctcttcagtgcacaagcaccaagaaatatccacaagcatccagatcatccaggataacattacctcagaaaatgaaataaagaaggaaccagtgaccaatcccagagtaacagaggtatgtgaccttttagacagaattcaaaatagctgttctgaggaagctcagtgaaattccagataacacagagaaggaattcagaattctatcagataaattgaacaaagagattgaaatactttaaaaaaatcaagcataaattctggagctgaaaaatgcaattgatataccgaagaatgcatcagagtctttcaacagcagaactgatcaagcagaagaaaaaagtattgagcttgaagaggggctgtttgaaaatacacagtcagaggagacaaaaaaagaataaaatagaatgaagcacacctacaacatctagaaaatagcttcaaaagtacagatctaagagttatttgccttaaagaggtggtagagagatcgagatagaaagcatattcaaaggaataatattataacactgtagttgtggtgtgtgaactactcataccttgagtaggaagactaagagatgaacctatcaaaaataataactgcaagttttgaagacatagacagtataataagatatgaatagaaacaataaaaatgtaaaaagccatggaggggataaagttaaagtatagagtttcaattagttttctctttgtttgtttgtttgttttagcaatcactgttgtcatcagtttgaaataatgcaatataagatgttatctataacattcatggtagcctcaaatcaatgaacctagaacagatacaccaaaaaataaaaagcaagaaattaaaacataccaccagagacaatcaccttcacaaaaagaagacagagagggaacaaaggaagagatcacaaaacaaccagaaaacaaataataaaatgggaagggagtaagaacttatcaataataacattgaatttaaatagaataaacttttcaatcaaaaaacatagaatggctgaatgcattaaaaagccccaactagctgccatccttaagaaacacacttcacctataaggacacacatagactgaatataaaaggatggaaaaagatattccatgcaaatagaaaacaacaaagaggagtagctatacttatatcacacaatatagatttcaagacaaaaactataaaaagagataaagaaggtcattatataatgataagaggatcaattcagcaagaagatagaacaagtgtatatatgcacccaaagctggagcacccaggtgtataaagcaaatattatacaaactagaaggtgggatatagaccctgatataataatagctggagacttcaacaccctactttcagcattggacagatcatccggacagaaaatccacaaagaaatatcacacttaatgtgcagtagagaacaaatggacctaatagatatttacagaacatttcatccaacagctacagaagacacaattgtctctttggcacgtggatcattctcaaggataaaccatatgttaagtcataaaacaaataatttttttcttttttcttttttttcagacaagttctcactctgttgcccaggctggagtgtagtggcatgatttcggctcactgcagcctaaacctaccagacttgaagggaaccttccacctcagccttccaagtagctgggactacagtgggactacaggcacatgccaccacacctggcaatgttttctttctctttttttttttttttttttttttttttttttgtagcgacagggtctcaccatattgcccaagctgttctcaaactccttggctcaaatgatctgccaccttggcctcccaaagtgctgggattacaggtgtgagccagcatgcccagccaaaattttttttaaattgaaatatcaagcatcttctctaaccacaatggaataaaactaagtcaataataacagaaactttggaaactatacaaatacatggagataaacagtatgctcctgaatgaccagtgggttaatgtagaaattaagaagaaaattttaaaatttcttgaaacaagtggaaatgaaaacaaaatgtaacaaaacctatgagatatagcaaaaacagtactaataggaaagtttataaaaatgagtgcctacatcaaaaatgtagaaaaccttcaaattaacaacctaataatagaactagaaaagcaagagcaaaccaaatggaaaattagtagaagaaaagaattaataaagatcagagcagaaataaattgaaataaaaaaacacaaaacatcaatgacatgaaaagttgttttctttaaaaaataaataaaatcaacaaacctttagccagaataaagaaaaagagaaaacccaaatagataaagatgaaaaatgggacatacaaccaataccacagaaattcaaagaatccctggagactactgggagcagctatacgccaataaattggaaaacgttgaagaaatggataaattcctagacacacagaaccttccatgattggatcaggaagaaaaccaaaacctgaatagaccaataacaagtaatgagaagaaagccatgacaaatagtcccccagtaaagaaaaacctggaacccaatgacttcactgctgatttttgccaaacgtttaaagaagaactaatgccaaccctactgaaactattctgaaaaaacggagcaggaagaaatacttccagactcattctatgaggccagtattaccctgataccaaaaccagacaaagacatatcgaaaaaaaaaaggaaactactacaggcaagtctctctgatgaacatcaatgcaaaacctcaaccaaatattaacaaaccaaattcagcaacacattaatagggtaattgatcatgatcaagtgggatttatcctagggatgcaaggatagttatacataaatcaatcaatgtcctacatcctatcaacacaatgaaggacagaaagcatataattccaattgatgctgaaaatcatttgataaagttcaacatcctttcacgattaaaaaccctaaaaaagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttaatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaagaaataaaagaggatacaaacaaatggaagaacattccatactcatgggtaggaagaatcaatatcttgaaaatggccatactgcccaaggtaatttacagattcaatgccatccccatcaagctaccaatgcctttcttcacagaattggaaaaaactactttaaagttcatatggaatcaaaaaagagcccgcatcaccaagtcaatcctaaaccaaaagaacaaagcgggaggcatcacactacctgacttcaaactatactacaaggctacagtaaccaaaacagcatggtactggtaccaaaacagagatatagatcaatggaacagaacagagccctcagaaataatgctgcatacctacaactatctgatctttgacaaacctgacaaaaacaagcaatggggaaaggattccctatttaataaatggtgctgggaaaactggctagccatatgtagaaagctgaaaccggatcccttccttacaccttatacaaaaatcaattcaagatggattaaagatttaaacgttagacctaaaaccataaaaaccctagaagaaaacctaggcattaccattcaggacataggcatgggaaaggacttcatgtccaaaacaccaaaagcaatggcaacaaaagaaaaaattgacaaatgggatctaattaaaataaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaccccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctagggactgtggtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaataaatttaaaaaaaaccctaaaaaatctgtgtatgcaaggaacatacctcattgcaataaaagctatatgtgacagatccacagctcagtatcatattgaatagggaaaaactgaaagcctttcctttaatacctggaacaggacagatatatccacttttaccactgttatgcaacgtagtactggaggtcctagctagagacatcagacaagagaaagaagggcaacaaaattggaaaggaaaaagtcaaattatccttgtttgcagataatatgatcttatagtttgaaaaacctaaaggccccacaacaaactattagaactgataaattcagtaaagctgcagaatgcaaaatcaacatatataaatcagtagtatttctagatgccaatggcacacaatctgaaaaagaaatcaagtaagtattcccatttacaataacaacaaataaaataaagtactaggaggaaacctaaccaaagaagagagctctacaatgaaaactgtaaaacaatgatataagaaattgaagatggcacaaaaagatggaaagatattccatgttcatggattggaagtttcaattttattaaaaggttcatactacccaatgcaatctacagatttaatgcaatccctattaagatataataccaatgacatcattcacataaatagaaaaaataattatagaatttatatgaaaccacagaagacccagaatagccaaagccatcctgagcaaaaagaacaaaactagaggaaacatattacctgactttaaattatactacacagttatagtaaccaaagaagcatggtactggcataaatacagacatatagaccaaagaaaaataatagagaattcagaaataaatctatacattcacagtgagcttattttcaacaaagtgccaagaacatacattggggaaaagataggctctccgattaatgctgctggcaaaactgcatatccatgtgcagaagaatgaaactagacccgtatctcctgccatatacaaaaatcaaatcaaaatggaatgaagacttaaatctaagacctcaaaatatgaaactactaaaagaaaacactggggaaactctccaggacattggactgagcacagattacctgagcaataccccaccacaagtacaggtaaccaaagcaaacatgaagaaaggagatcacatcaagctaaaaagcttctaccagcaaagaaaacaatcagcaagtagaagagactacccatagaatgggagaaaatatttgcaaactattcatctgacaagggattaataaccagaatacttaaggagctgaaatcactaaataggaaaatatctaataatccgattaaaaatggacaaaagatctgaatagacatttctcaaaagaagacatacaaaaggcaaacaggtatatgaaaagatgctcaacataattgatcatcagaaatgcaaataaaaactacaatgagatattatctcatcccagttaaaatggcttttattcaaaagtcaggcaataatgaatgctggcgaggatgtagaggaaagggaacccttgtacactgttggttggaatgtaaattactacagccactatgtagaacaatatggaggttcctcagaaaactaaaaatagaattaccgtataatccagcaatcccactgctaggtatatacccaaaagaaaggaaatcaggatatcaaagagatgtctacacccccgtgtttattgcagcactattctacaataaccatgatttggaagcaacctaagtgtccatcaagagacaaatggataaagaaaatgtggtacttacacacaatggagtactattcagccataaagaaaaatgagttcctgtcatttgcaacaacacatatggaactggagaattattatgttaagtgaaataagccaggcacagaaagacaaactttgcatgttttccactcatttatgagagctaaaattttaaacagttggagatagatatcagaaggatggttaccagaggctgggaagggtagaggtgggtagaaagaaattggggattattactgggcacaaaaatatagttagatagaatgagtaagacctagcattttatagcacaaaagggtgactgtagtcaacaataacttaatgtacattttaaaataactaaaagcataactggaatgtttgtaacacaaagaaaataaaaatgcttgaagtgatggataccccatttaccctgatgtgattattacagattgtatgtctgtatcaaaatatctcatgtaacctagaaatatatacacctgacatgcacccataaaaactaaaaattttataaaaagaataaaaaatttaggaaaatatagattactttttcgagtgttcattcaaaattgttaaaactaagtatttgtgtaaaaccttttgttacctataaattttacttttatggaacatctaattcctaaaaatagcagataaaggcattactgtcattaagagactgttaactcaaacaattaaatagcaaaacaacaaataatctgattttacaatgggcaaaagacctgaatagacagttctcaaaagaagcatacaaatagccaacagttacatgaaaaaatattcaacgtcaccaatcatcaggaaaatgcaaatcaaaactgcaatgtgatatcacttcactccagttaggatggctattataaaagagacaaaaaacaaacaaatactggcaaggatgtggagaaaagggaactcttatatacttactgttggtgggaatgtaaattagtccagccatattggaaaacagtatggagagtttttaaaaatgttagaaatacaattaccatataatctggcaattcaattactgggtatctatccaaaggaatggaagtcagtttgtccaagagatatctgccctcccatgtttattttagcactattcacaacagcaaagatatggaatcaagctaagtatccatcaatggatgaatggatatagaaaaagtcacacgtgtatacaatggaatactattcagcatttaaaaagcagcaaatcgtgtcatttgcagcagtgtggatgaacctggaggaaattaagtgccaaaagcaattgcaacaaaagcaaaaacaaaaacaaaagttggcaaatgcaacctaattaaattaaaaagcttttgcatagcaaaagaaactatcaacagagtaaacagacaacctacagaatgggagaaaatatttgcaaactatgcatccaacaaaggtctgatatccgaaatctttaaggaacttaaattaacaagcaaaaatccaacaaccccattaaaaactggacaaagaacatgaatagacacttttcaaaagaagacatacatgcagccaacaaatgaaacatatgaaaaattactgaacatcactaatcagattactagagaaataccaatccaaatcacaatgcaataccatctcccaccagtcagtatggctattattaaaaagtcaaaaaataacagatgttaacaaggttttagagaaaagggagcgcttatacactgctcgtgggaatgtaaattagttcagccattgtggaaagcagtttgctgatttctcaaaaaactcaaagcagaattgcaatttgacacagcaatcccattattgggtatatacccaaaggaatataaatcattctaccataaagacacatgcacatgtatgttcatcacagcactatttacaatagcaaagtcatggaatccacctaaatgcccatcaatggtggactgaataaagaaaatgtggtgcaaatacaccatggaatattatacagccataaaaaaagaatgagatcatgtatgatctcatgagtactcagatacagccacataggactattgtcattcacttttcttaactgttcattctgatctttctgcctaaaatacccatatttgctctgacactccctgtcctctgcttatctatgtattacttaagtcccagctcaaatgatgcttctatacaggttccccaagctccaagtgagagaataaatgtttcctctttggtcccctgtcacttggtttctaacctctatctagtatttcattttactttgcatctcaattggcatgcctctctaaattaagaacttttttattttgggcagacactgtctttttttttttaaagacccttaatttaaaaatttataattgacacataattgtatatatttatggggtacaatgtgattgtaaatgtaagtatactatgtagtataatgatcaaatgggggcaattaccatatccatcacatggaacatttttcatttgtttgtggtaacatcattcaaaatcttttcttctagttatcttaaaacatacactacattgctgtttgctatagtcaccctactgtgtaaaaaaacaccaaacttattcttcctgcctaactgtaagtttgtacacattggccaacctctctccatccttccctaccctgtaccctccccagcccctggtaatcactattccattctccacttttgatttttttttttttttgagatggagttttgctcttgttgcccaggctggagtgcagtggcaccatctcagctcaccacaacctctgcctcgggttcaagcgattctcctgcctcagcctcccgagtagctgggattacaggcatgcactgccacgcctggctaattttgtacttttagtagagacagggtttttccatgttggtcaagctggtcttgaactcctgacctcaggtgatccgccccccatcggcctcccaaagtgctgggattacaggtgtgagccaccaagcccagtcttgaaattttttaaacttttattttaggctcaaggacacatgtgttggtttgttgtataggcaaattgtgtgtcacaggggtttgtgtacagattatgttctttgcagcaacatggatggagctggaggccattatcctgagtgaacaaacacagcaacagaaaaccaaataccacatgttcttatgtataagtgggagctaaactttgagtacacatggacacaaagaagggaacaacggacaccggggcctacttgagggtggaggaagggaggaggatgaatacctattgggcactatgcttattacatggatgatgaaataatctgtacacaaacccctgtgacacacagtttgcctatataacataccaacacatgtgcaagatcagttgagatcagatcatatatggctttacatgttaggctaaggagtcagattgtaatgagtaattaggagccactaaagactcctgggcagaaaaagaggcatgattcaaccatgttatggcaaaagtcaagcagaaaggtcaactctaatgaaactttaagggagggactggatataggatgaccagctaggaggttactgtaatagtttcagtaccctatttcaaagaaattatgagggtctatattaagacagcagaaatagaaagatctgataatggagacaccaagaaagtaaatagcatctccatgactgactaggtgagcagtgaggattcaaacatgattctgaggttactaaactaggtgaccagaggggttgttacactgttaactgcaattgagaacagtggagggggagcagtttacagatattttcaagtgcatgggaagtatcaaaatgcttagaaataggtcttttacatgattaggaagccaattcagggttttttgttttcgttgagacggagtctcgctctgtcgtccaggctggagtgcactggcacgatcttggctcactgcaagctccgcctcccgggttcacgccattctcctgcctcagcctcccgagtagctgggactacaggcgcccgccaccacgcccggctaattttttgtatttttagtagagatggggtttcaccgtgttagccaggatggtctcgatctcctgatctcatgatccgcccgcctcctcggcctcccaaagtgctggaattaaaggcgtgggccaccacgcccggccaattcaggttttttaatagttggactgtatatagcacgtatgaatatagattgtgaggactgaagcacagcattgttgctaagatgtatacaatgtacatttcttgcctatccttgttttttggtttggtttggtttggtttggtttggtttggtttttgtttttgttttttgagatggagtctcgctctgtcgcccaggctggagtgcagtggcacgatatcagctcactgcaagctccacctcccgggttcacgccattctcctgcctcagcctccccagtagctggggctacaggtgcccgccaccacgcccgactaatttttttttgtatttttagaagagacggggtttcaccatgttagccaggatagtcttgatctcctgacctcgtgatccacccacctcagcctcccaaagtgctggaattacaggcgtgagccaccacgcccggccttgttttgtttttcaaccttcatctgaccacaatggcccatgtgttcctgagtatccacccctgccacctaccccatatgttctaaaagaacaaaacatttctattagttaaaaacttatggccaggtgcagtggctgacgcctctaatccctgcactttgggaggccaaggtgggtggatcacctgaggttaggggtttgaaaccagcctggccaacatggtgaaaccccgtctctactaaaaacacaaaaattagctgggtgtggtggcatgcacctgtaatgccagctactcgggaggctgaagcaggagaatcacttgaacccaggaggcagaggttgcagtgagccaagattgcaccactgcactccactctgggtaaggagcgaaactccgtctcaaaaaaaacaaaacaacaacaacaacaacaaaaaccaacttattagcagtacacatctgtgattcaaaagaaatatttaaaaatatattccaaagcctaacttttagaattctctatgctttcaaagattatacagtttataatatcggaaatgaatgctacattatataattaatcacaactttattactatacattttcctgagagatggctcttagagaaaagacaaataatgtctgtgattttagtgccatagctaaaaatttaaagcccctaaataaatagaaaaaaagggccactgtttggtaaaattatctccagatccataagggatatttgggtcatatactgatattggaagaaaatataacagagggtctctacatttcagactccttcactccccattgtttttgagattttccttttgtaaatgagaacaaggtgagtcattaatctctatcaaactgaatgatcacacatgactcagtagagttttaaaaagggcttaactaaatggctatcatgtaaaaatagtgtcttttggaatgttaaggatctataataaaatgctttgaataaaatgtttaaattaataacttcaaataaagagagaatcttagcatactatgagatatttctttttggccccatcttttgaaaactttggctactgaggaccataaatttaagggattgcttgattaacaattttactgtgtacattgccatttaaggtttatacccttaatttgaaaattaaaactgtgaatactattttaatattttactgagaaatggcttttagagaaaagacaaataatgtctgtgattttagtgccatagctaaaaacttaatgtccccaaataaatagaaaaaaggggcactctctggcaaaattacctccagacccataagggatatttggataatacactcatattggaagaagatacaacagagggtgtctacatttcagacattcagtatttttgtatttaaattctagtctaaaagtcctttcattttatttttattttatattttgttggtttttttattattatactttaagttctaggctacatgtgcacaacatgcaggtttgtcacatatgtttacatgtgccatgttggtgtgctgcacccattaactaactcgtcatttatattaggtttatctcctaatgctatcccccccagccccccaccccacgacaggctccagtgtgtgatgttccccaccctgtgtccaagtgttctcattgttcaattcccacctatgagtgagaacatgcggtgtttggttttctgtcttggtgatagtttgctcagaatgatggtttctagcttcatccatgtccctacaaagacatgaactcatctttttatggctgcatagtattccatggtatatatgtgccaaattttcttaatccagtctattattgaaggacatttgggttggttccaagtctatgctattgtgaatagtgccgaaataaacatacgtgtgcatgtgtctttatagcagcatgatttataatcctttgggtatatgcccagtaatgggatggctagatcaaatggtatttctagttctagatccttgaggaatcgccacactgtcttccacaatggttgaactagtttacactcccaccaacagttaaaggagttcctatttctccacatcctctccagtacctgttgtttcctgactttttaatgatcaccattctaagtcgtgtgagatggtatctcattgtagtttggtttgcatttctctgatggtcagtgatgatgaacattttttcatgtgtcttttggctgcataaatgtcttcttttgagaagtgtctgttcatatcctttgcccactttttgatagggttgtttgattttttcttgtaaatttgttcaagttcattgtagattctggatattagccctttgtcagatgggtaaattgtaaaacttttctcccattctgtaggttgcctgttcactctgacggtagtttcttttgctgtgcagaagctctttagtttaattagatcccatttgtcaattttggcttttgttgccattgcttttggtgttttggtcatgaagtccttgcccatgcctatggcctgaatggtatttgcctaggttttcttctaggatttttatggttttaggtctaatatttaggtctttaatccatcttgagttaatttttgtataaggtgtaaggaagggatccagtttcagctttctatatatggctagccagttttcccagcaccatttattaaatagggaatcctttccccatttcttgtttttgtcaggtttgtcaaagatcggatggttgtagatgtgtggtattatttctgagggctctattctgttccattgatctatatctctgttttggtaccagtaccatgctattttggttactgtagccttgtagtatagtttgaagtcaggtagggtgatgcctccagctttgttcttttgacttaggattgtcttggcgatgcgggctctttgggttccatatgaactttaaagtagttttttccaattctatgaagaaagtcattggcagcttgatggggatggcattgaatctataaattaccttgggcagaatggccattttcacaatattgattcttcctatccatgaacacggaatgttcttccatttgtttgtgtcctcttttatttcgttgagcagtggtttgtagttctccttgaggaggtccttcacatcctttttaagttagattcctaggtattttattctctttgaagcaattgtgaatgggagttcgctcgtgatttggctttctgtttgtctgttattggtgtataagaatgcttgtgatttttgcacattgattttgtatcctgagactttgctgaagttgcttatcagcctgaggagaatttgggctgagacgatggggttttctagatatataatcatgtcatctgcaaatagggacaatttgacttcctcttttcctaattgaatactctttatttccttctcttgcctgattgccctggctagaacttccaacactatgttgaataggagtggtgagaaagggcatccctgtcttgtgccagttttcaaagggaatgcttccagtttttgcccattctgtataatattggctgtgggtttgtcatagatagctcttattattttgagatacgtcccatcaatacctagtttattgagagtttttagcatgaagcgctgttgaattttgtcaaaggccttttctgcatctactgagataatcatgtggtttttatctttggttctgtttatatgatggattacatttattgatttgcttatgttgaaccagccttgcatcccagggatgaagccaacttgattgtggtggataagctttttgatgtgctgctggattcggcttgccagtatcttattgaggatttttgcatcattgttcatcagggattttcgtctaaaattttctttttttattttctctctgccaggctttggtatcaggatgatgctggcctcataaaatgagttaggaaggattccctctttttctattgattggaatagtttcagaaggaatggtaccagcttctctttgtacctctggtagacctcggctgtgaatccatctggtcctggactttttttggttggtaggctattatttattgccacaatttcagaggctgttattggtctattcagagattcaacttcttcctggtttagtcttgggagggtgtatgtgtcgaggaatttatccatttcttctagattttctagtttatttgcgtagaggggtttatagtattctctgatggtagtttgtatttctgtgggattggtggtgatatcccctttatcattttttattgcatccatttgattcttctctcttttcttctttatttgtcttgctagtggtctatcaattttgttgatcttttcaaaaaaccagctcctggattcattgattttttgaagggttttttgtgtctctatctccttctcttctgctctgatcttagttatttcttgccttctgccagcttttgaatgtgtttgctcttgcctctctagttcttttaattgtgatattagggtgtcaattttagatctttcctgctttctcttgtgggcatttagtgctgtaaattttcctctatacactgctttgaatgtgtcccagagattctggtatgttgtgtctttgttctcattggtttcaaagaacatctttatttctgccttcattttgttatgtacccattagtcattcaggagcaggttgttcagtttccatgtggttgtgtggttttgagtgagtttcttaatcctgagttctagtttcattgcactgtgatctgagacagtttgttataatttctgttcttttacatttgctgaggagtgttttacttccaactatgtcgtccattttggaatatgtgttatgtggtgctgagaagaatgtatattctgttgatttggggtggagagttctgtagatgtctattaggtctgcttggtgcagcgctaagttcagttcctggatatccttgttaacttactgtctcgttgatctgtctaatgttgacagtggggttttaaagtctcccattattattgtgtgcgtgtctaagtctctttgtaggtctctaaggacttgctttataaatctgggtgctcctgtattgggtgcatatatatttaggatagtcagctcttcttgttgaattgatccctttgccattatgtaatgaccttctttgtctcttttgatctttgttggtttaaagtctgtttgatcagagactaggattgctacacctgctttgttttttttttttttttttgctttccatttgcttggtatatcttcctccatccctttattttgagcctatgtgtgtctctgcatgtgagatgggtctcctgaatacagcacactgatgggtcttgattctttatccaatttgccagtctgtgtctttttcttttcagtctatgtcttttaattggagcatttagcccatttacatttaaagttaatattattatgtgtgaatttgatcctgtcattatgatgttagctggttattttgctcgttagttgatgcattttcttcctagcatcgatggtctttacaatttcgcatgcttttgcagtggctggtaccagttgttcctttccatgtttagtgcttccttcaggagctcttgtaaggcaggcctggtggtgacaaaatctctcagcatttgtttgtctgtaaagaattttatttctccttcacttttgaagcttagtttggctggatatgaaattgtgggttgaaaattctttaagaatgttgaatattggccccgactctcttctgatttgtagagtttctgccgagagatccgctgttagtctgatgggcttccctttgtgggtaacccgacctttctctctggctgcccttaacattttttccttcttttcaactttggtgaatctgacaattatgtgtcttggagttgctcttctcaaggagtatctttgtggcattctctgtacttcctgaatttgaatgttggcctgccttgctagattggggaagttctcctggataatctcctgaagagtattttccgacgtggttccattctccccgtcactttcaggtacaccaatcagacgtagatttggtcttttcacatggtcccatatttcttggaggctttgttcatttctttttactcttttttttcctctaaacttctcttcttgcttcatttcattcatttgatcttcaatcactgataccctttcttccacttgatcaaatcggctactgaagcttgtgcatgcaccacgtagtcctcatgccatggttttcagctccatccggtcatttaaggacttctctacactgtttattctagttagccattcgtctaatcttttttcaaggtttttacttctttgcgatgggttcgaacatcctcctttagttcagagaagtttgttattaccgatcatctgaagccttcttctctcaacccatcaaagtcattttccatccagctttgttctgttgctggcgaggagctgcattcctttggaggagaagaggcgctctgatttttagaattttcagcttttctgctctggtttctccccatttttgtggttttatctacctctggtctttgatgatggtgacgtactgacagggttttggtgtggatgtcctttctgtttattagttttccttctaacagtcaggaccctcagctgcaggtctgttggagtttgctggaggtctactccagaccctgtttgcctgggtatcaccagcggaggctgcagaacagcaaatattgcagaacagcagatgtggctgcctgatccttcctctggaagcttcgtctcagaggggcaccccactgtatgaggtgtcagtcggccccttctgggaagtgtctcctagttaggctactgaggggtcagggacccacttgaggaggcagtctgtccgttctcagatctcaaactccgtgctgggagaaccactactcttcaaagctgtcagacagggatgtttaagtctgcagaagtttctgctgccttttgttcacctatgccctacccccagaggtggagtctacagagtcaggcaggcctccttgagctgtggtgggctccacccagtttgagcttgcccgccactttgtttacctactcaagcctcagcaatggcgtacgcccctcccccagccccactgctgccttgcagtttgatctcagactgctgtgttagcagtgagcgaggctccatgggcatgggaccctctgagccaggcgcgggttataatctcctggtgtgccatttgctaaggctgttggaaaagtgcagtattagagtgggagtgtcccgattttccaggtacggtctgtcacggcttccctttgctaggaaagggaattccctgaccccttgcacttcctgggtgaggcgatggcctgccctgctccgtgggctgtacccacttgtctggcaagccccagtgagatgaacccagtacctcagttggaaatgcagaaatcacccgtcttctgcatcactcacactgggagctacagactggagctgttcctattcggccatcttggaacctcctctaaaagtccttttagagttgcatgtgtgtatttgtatttattccagattggagttggatcattaacccagattagcaccttaacttaatatcagtgggaggtttctctagttggttataccttaacattcaataagtgctcttcttttgcttaagattattggtctcaggtcatataaactagagggaatataaaccttgataagcattggaatggcatgagcaatctgacattcttttaacattgggaaagataatgtttgtactttatttttttccacaaaacttatataattggtggtagagaggtaagtattttagataattagacctttagtaataagattagtcttagtttaggcttgtctttaataggtagtgaatagaaatgtgcatttctatatgttatcttcattgctaacctgatcacgtctgtgtaaaaccttagaacaccttgagcaaattttatattgcttttgaggatatagaaaaatggtacatcatggacatatgtagtttgtacatttgggtttgtaaacattgtttggctcaaattactatcccaatatgtaaatccttatacatgctagtagtgagctcttgagataatttatcatcttataaattgggaaatatttctgtattccccaaatcttagattccttatcatataagccctattttctacaatttgggggactatttgtctttaagcaagccttcatataagatgcaaattgggtctcaaaggcaatactgttgaattatagatagttaatctgaggagggggaggtgtttgttgtatataatagcttccttactaagttatgagttccctaaaatcggtaaccaaatctcatgcgtgtttatataacctacaactttcatatagatagtaggtgctcaaaaatgttaattgaatgaatgggtatccttcctttgtctcattgagacccatttaaaatcattttagcaattgggttattatactaagaatgtttcaccaaactaaaactgaatttgttttattttacaggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcaggtttgtaatggtcctttcttccactattaaaaaaaatttactgttctaattgtagtttcagggtcctgcattttaatacattgtacttgctagacaatgatctccccatatgttttacaaaatctggtagtttttaaaagtatgtcagctcttctcaaaggtttattttctatatttgtcaaagaacttaatcctacctgattaaattttctaacacctcattagagaacacatccagcatttaattacatataggtgtaaatacatatgttcttttaaataaacatttttttctaaattacaaaaacatttcatactcaatatagaaaacttagaaattagaaagtacacgggaaaaaaactcacctaaaacctgatatagcaatataactatagtcatcgcccaaaggtaaccactattattttatatgtacgtctgtatttgcatgtggggatggggctgagaagagggactaggctgagaaggcagggtagaagatctgattgtgcatgatatattgttaggcttcaagtggagtcaaatattaatagtttctaccatattataacagtgtataaaaaggtacaaggtacacaaacaacagagcaaaaataccaaagcattactgaacagtaaagtacctatggttgtatggcattgttcctgccaccattaaattgtccccctcagccccctgatatgctcacatttctccttacccagcttaaattccatggttactcccatgcatacatcttcagttcccgtggcccttctttctctttgttatagttgctggaaaaacaaatccaaccctggttaaatttacttcccacctactctatgtcttcaccttgcacaactgaagtatcagaaaggcatttacagctgtactgactgatctcactttaaatttgtgaccgtaaaatcagagtgggcccttaatgctacccaggaatcacactatgttttcttggccatttactctcctactgttggataaccatatgtgttcctttccctttctccaacacctcctccaactttactctcaatttgtattttattttactgagaaaattgaagcaatcaataatacttccacatcttctcatctatcttcatctgcgtctatcctattcccctgctttgtcttctgtttttatggatgaactgttcctttgcaaaggctaactctttcactcaggtataagattatttttgtcttttgtatactcaaggacatcactccagaaattttcctctctcactctcctactttaacaatttctccctctcctcctcatcttttccaccaacatgcaaacatagtattattgctcccattttcaaaagattttctcttggccccaggccaaaaaccttgaagttgttctttattcctttttttctgtcacctcccatgtaaactatcagcaaatcctattatttctaccttcattatatatccagaatttgattatttcttattaccttcattgcttctgccccagtcaaagccaccataatttcttacctcctcctcccttcaggtattctcagtataacagcggaatggtgtgccacttctttagaaagctcagtagggatttaatgctttcagatgaaaatacatttttatatgtactgagcagtttctctaaaggcgatcgatttctggtcacttcatgtactcttcctccaataagtgaaaaggaactcaatttatttagggggcggaaggagcagtgaggatttttatatagcaagaaagttaatttaatttaggaatagatgagaaattgaaattttattataaaaacttcataaagattagataccagcatatggtaataagtgatggttatctcagtgtttaaagttaattggcttctatccttctccttagagaagcagcttatcacattggtggcaggttcagcctgatactagctgcagtcaaaaagatgtttaaaattcctgtaccaggccactcagtagtttcacactgtgttaatatttgacatttgtatattgtgcggttttttatctgcgaggctggaaggaaattggtgtccagtgtgactaactattcaaaggttatagttacaatgacaagagtgtttggtttgcatatgttcatggtggggtatgtgtttcagtattctcagtgctataataaatttattgacatggcattaaaccccatcagaaaataataaggtttataaagaactttgtctggtgttacagagcttcattggacatttagctctggtctacgcatttaattttcatagtttataatacatcttatgataattaacctctgtagaaatggtcaagaatagcattaaaacttctcatctatttggagaaggcttttgaaggggcttttaaaaattacttaatggactatatctgtttatcctttgaggactaaaagattaaatatatggctgataatcctttttgcttataaatatttgagagtgctagaatgtcatttatatatttaattttcatgacagtattaatttttaaaaggtagagcttaatgcatatgctgattataattatcactaaacatttaactatattatctccattttactggtagaaatgatgatgaagctgagttatggaaatttggcttcattagaatgttaggcaaatttaatatattcaagaatttcttccttctgaaggttatgatacatggtatataatgtcaggaaactgataactgtaaccataaattctgatgactgaatgctcagatgagcccccagacagaatagcctcatatgttgtagtgtgatgtgtaagaacacatatcatccctgttttttagatacaaagcttttaaacagaacaaaaaagtatcaatggattataaatgaaaataacatattaggccttataagttagtttcatgtcccttccgggaacaaccctaacttgagacaagaaagattatgggaaaccttatggcatacacaaattaaactacattcaggagtgaccactatacacttgactctagcatggagtaccaaacattttcgggtaccgtaaatgtatcctaactgtattcaagcagttaatactcaatagccacaatgcatgtgttggattaaacattggcaagtgaaacaaaagagggctgtaggtgaaataggagctggcctagatataatgtgaaaagctgaatttacttttaatgaagagtggctttcagaagaaaaggatttactaactaaaatagacagattagaaggaaatcatcttccaagaggagggaaaagaatgggaatccacttgcaaaggtcataaagctttgataaactgatcacacagacccaacacataatgctagagaatgctaggaatcaatattgggaaagagaatatactctaacacaacagaatctattaactattttacttaaaagtgatccccaagtagccatgggggtaatgaccttccatttttagctgtagaagctcaggcagagaatctttgagacacatgcagatcctcaaatttatggaatttttttttgtaaaattgcaacttgcactgctgatctctgactgatctggaccaaaggatgggccaaaataaggctagtaggaatagaactaatactgaatgatacccatgtactcccatgggagggaaatggccttgctgtacaaagttaacaggaacctataacttgataataatataagttgagacaaatgattggctttgtccccagctaacatggaacctagaaatgacagaatgattgcaactggtgacagcatttgttcctcatcatatctggcatatgggcaaaggctaattcttctaggaaggtttaataaatatttctgtgacatttccggattttttttgtaaccaaaccaaactgtatcataaccatgctctgatatggtgtaatactggtattgttagtaaaattcaactatcttatataaataaatcatatggtaatcaaatatatttgagacattgaactaaaaactcctcacagtgtgataccaagggagagtgactggcatgaagaagaagtagaatgatttagttcattactatattaaattgctctgtgcaagtctatcacaaagttcaagtggccatagatcaagggaataaatggataattaaattggtataataatgtaaagatgtttgtgatggtcttataaactggatgaattgttcctttgaacctgtttccactccttgttggcttctgcaagtattagatagacttgtgttgttcttatggcaccttatataaaaatactgtgctaactgaacagtatatacagttgacccttaaacaacttgggtttcaaccacacgaatccacttttacacggatattcttccacttctgccacaccggaggcagcaaggccaatatatccttttcctcctccccagtctagtgaatgtgaagaaagaaggatggaggccttcatgataatccacggcctcttaattaagataaaatttattttctctcacacctgtcgtaccagcactttgggaggccgaggcgggtggatcgcttgagcccaggagttccagaccaacctgtgcaacatggcaaaaccctgtccctgcaaataatagaaaaattagccaggcatggtggcatgtgcctgtagtcccagctacttgggaggctgaggtgggagaatcacttgagcccgggaggcagaggttgcagtgagccgagatcatgccactgctctccagcctgggtgacagtgagaccctgtctttaaatatatattcttttcttccttatgattttcttaataacattttcttttctctaatttactttattgtacaaacacagtatataatttatataacatacaacataggtgtttattaactgtttatgttatcagtaaggcttccagtcaacagtagactattagtagttaagttttgggggtgtcaaaagctatatgtggagtcttggctgtgtgagggtcagtgcctataactgccatgttgttcaagggtcaactgtatactgtatgtagtacactgtttataaatattatgctaactgtatagtaactatactgactactgtaccaactgaagtgataatatataaatactgtacaaacagttactgtactgaaagttttattataaaaaggctttgaccaacaggatggattgtgaggaaaaaggtaacacaacagatgcagttgcttactccttccatgtccccaagggaaccatgattggcccctggccaaccctgggaatgtggctctcaaactggtctttatgttagtgattgataattttgttatatacacctggaaaaatggaccatgttgtaccagcctgtcagagttgcttttcacaacaatcaagattgatgatatcctagtttcattgttggggtcctcagtttccggcaacatggccagttgctagcaggatgcacctagtaagcagtcccttcatctgagtcttggaccccaacacttaaattggttccctgggcagagatatgccacacatttctgtagtttgctgccagacagaaagagcactcctgtgtgctctcagatgaggaaggactaggctacattaatattttaaaatctgtccttcaacttaaagcattactaaaaattatctaaactatttctggttacattaagtttttttctactccactagtacacgaaattatctggaagattcattaagtacctgcacactgtaccactattaacatatatacatttgcagttggtgtgttcacatgtatgtatctatttctgcctacatttgagagtagttcagggtcttttacagaaaccatgagaattttgactcttgtataagaagaacagattaaatccttgtctaagtaagacttagttttacaatatttcttctgactttctcactgaacaaaagaaagctcttataatgggtctcaggatttttatatattcacttactctaattttaaatttataccactaattctttttccagctttattgaagtatgattgacaaataaaatttgtatatattcaaggtgtacaacattatgatttgatatacatataaattgtaaaatgattgacataaattaatacatctatccctacacagttacgtgtgtgtgtgtgtgtgtgtgtgtgtgtgtgtgtgtgtgtgttgaggatacttaagatctactttcttagcaaatttcaagtaaaccatgctgtaaataagatcctcaggatttattcatctaaaaaatttgaactcatagatgcagagaacagagaagtggttgccagggggattggggaaatggggagatgttagtcaaacgatacaaacttgcagttataccacaaattctaaagggtgttaatcacatttctttgaaaaaaatgctgtaatctgagctataacctatctactgagtcaaattcaccctttcttcactgttcttccttatagtgtatttccttacactgctcacagttatgttcttcatgagagtggtctgcactcttgtttatcccctcatctgtagttccatagatttataggaagctgttttatagcctgcacctcctcttacctgtaggaatattttcactcaaatattgtggataggtttttattgaataaaatggatttctttcagttctcagatacctaaacagctacatggctcagacttttattttgtcctaggaatatatctgaggaaaagaatcctcttactataattcttgattttaaatatcttgtgttaaaactcttagccaaatttttaggaaaatgtttatttttaaaatatggtgacttaagtacagaaaaatctagtttgcttatatctctctcctttcttgctttttgcacaccctgtcctccatcaagtaattaggtttgactacatacttaatactattcatgtgggtttcagttaagctaaaagctgaacgccctgggaccaaaaatcaggctgaaaaatcaccagactgaaacatatactttacctaattggatataaagacaccagtgaactaggtagaatatctttgctttcaccataatttcaaaattgaacattgtaataaagaatgatcattggtttgacattttatcatcaaccccaatatattcccattcagaatcaagaaaaaaaaccatgtagtggagattcttcactaactagagcgaatgcagcttttgattagtcagaatagtcacattaagcttctgttaagaaaattggccaacaaccagcttctttgaatcagtcttcagttctactgccaaatattcttagaccaggtatctcttaggattagagaggaggaggggaaaggcaaaaggcgtttgacatcatatacttgctttttaaaattccccaaatcacagtaaatagccagtttgggaagaattttaagattggataattgctggctttaaaggggtttttaaatttccttcgtttgtcttcttcacaagaaatgtgaagcctcttaaaggcttctttgccattacacaatggaggcagtgtacaatagtggagagatcatgggctttaaagccagatagaacctgggcttgaattgaatcacagctctgaagcttaccagctgtctggactttagtcaagcttctgaaccttacttttcttgtctataaaacttggatattaaaatagctatttcacaatgttgttaatgattaaacaagatgacacatgtaaaaagcttacaacctgacacatggtaaaggttcaattaatttgtaaacctttctttccccaaacttaatggagtagagacttttaataattgaaatgagaagtgtcttgcatgagaaaatcaagaaagtctgtttatattttctaaattcagaaaataatttttgagcaaactctagccactggggaatttttttctaagtgactaaggcccagtcctccagctactcaagagagaaaggcacattaataatacaattactgaacaagataagaggtggaaataatgtgttactggaatttatagactaaggaaattctgatctggtagcaaggcattggaaaagtatctcatgtaatttgtataatgtagatatgttcttgaaattctgttttttaaggagtaaggtacaaattacagttcacatggggcatattgtctttaaatgttgaggtatatttgggcactgtaaagttgacataatgttgttcaaacacgtgttgaatataatctactgggccctaatggtgttctcatatttcagtttttttaagagggaggcttgcatcttggaactcttgctatcagtgtcacagtgaaatatcttgagtactatcttgaatatcgtgaggcagtttttttgtgagtgactttcctttaagctctaaaaatagtttgtgctttttattaaatcacttgtcttgcatccatatttaaagaaaatagcttttctttatatcagcccagtaggagctattgaaaatactcaaattttcttttaaacacatttttattctaaggctgctttgttaaacattagtttatgctatgctgcaaatcttttagagatcctttataatcaaatctcttgtctagtgtcttctggcattttggatttggccctgtttttttattttttgtattctcccccaccatcattttctagcatcgcccttaatgcaagttctactgttctcctgggcatagactcagacattacatacaaagtttccctttgatcccacacttcaaattaatttgcattatagtcttggctataattaagaaagttatatatttggcattaatgcctaataaattgataagcactatcactggagattcagacatttatattgtattgaatcaaatattttgcaatgagaaatcagactgtatagactgaatcaagtaaataccctagagaggtatcaattccttatgagagctttccccaactgtgtgatacagcttgttgcctaaacctaaattagaattgctttaagcacaaagagcaaaacgattgtgaaagacatcatcaactacattacattttttcccctttcttcttgctggctctatttttttatcatttgcatttttctcatctcgatgtccaactgactcatgatctatgtggaaagaaagtagtgaagtgtaggtgtgtgggccagggccaggaccctgtaggcatacaggtggaaggattgccacagtttgacagaccctagaatccaggagctagaaaaacatcaaaagacagatgagttatggatggttgtattgtaatggactcttggaatatgaagagcagagttccagtaccagctttattatttagatgctgcattcccttttgaataagttattttactttttcaaccctccacttgagcatctctaaaatgaggatattaccttcttctgggggttgttgtgaggattaaatgaggtaatggatataaaaaatatattttaaactgtataacaactgtatattgtaaggaaatggtaggagtagcttcctactccatgctacagtcaaaacagatagctactttgatataactctggacttcagtggggctgacactagctctgatatttcaagcaagacattcttcctctttgagcatcagttttcttctctgtctgattagatgtcgggctcggtaatctaaagatcctaggtgtacctttgttcactgtcactctattattatcttacaagtaacaaaatagaagggaagatatttgtgctgaaattaagtcccatcatagaatttttttagttcacaattatgtcccaaaatgggagtgaaagtgccttgattatcacctcttttcctttttagggtctaggccttcctattcactgtttctgttagacttatttgctggtcaggtaataatctgagaggtttctgcttttcctgtgacagcaaagaaatactttggctaatattctccttggcattaagctaaatatcttccacaaaatgatatcttatataggagacaggtttgggcatcaatgagattcctcacctactgatacttatagattcttaccttccaaaatatatttgctacaaatatttgtagcatttgtagcaaatatatattggcaagtacctgttatgcttattgatgaatggtagtttacattttgtgtaataaacattttattgagtatctgctatatgccagacattatactaaatacttacattatctctaattttcatgtaacataaatgtcagctggggacgggggtacatataggagggaagctgcttacattctcccaaaggtctgggggcctactttttgccgaatttctaagtttgttcattttacagttcaaaatagaaagatcacttatcttgccatgctgcacatgctaccattatattccacacatgtattagtcgggtttgtgttgctgtaaaggaatacctgaggctgggtaattcataaagaaaagaggttgatttacctcatggttctgcaggctatacaagaagcttggcgccaacctccgcttctggtgaaagcttcaggaatctacctatcatggcagaaaggaaaggggaagcacgcgtgtcacagggagagagagggagcaggcgccaggctcttttaaacaaccagcgggaactgagaactcactcattaccataaggatggcactaagcccttcatgagggatcctcctccatgacccaaatacctcccaccacgccccacctccaacattgggggtcacacttcaatgagatttggaggggacaaatattcaccatttcaacacagcatctaccaagtgtcatacttagcctctacttcaattcatatgtatattatattcactacttcaattcatatgtatattatattcacttgaggcattcctgtctgtagtagaccttagtgaaggggaatgaagtatttgcagcatcaccagtaacttcaaattgacaaatatcttaacaaatatcacctgggattttttcctctggctagttcaccatacatagagggacaatgtgttattgaactgtatagactctctttatagtctttccctcacctggtagattcttcccacaccccaacttcacttctgactcaattatgcataatgttttagtttttattccataaatgagcctgtggcttgcttttgcatatccagacacatctagatatatgctcagtgaaacaataaaaggcgaccactctcagaatcaatcttcttcattaagcaatcgtggttataagcaccaatatttttcttaataccaaacagtgtaaaggttggtactaccctcattttatagataagtaaacaagctcaaagaattaaatgactcgtgcagggttattcattgagtaagtgataaagtcagattttgaaccattggaatccaaatcctatgcactttccaccaaacaagacacgattcaaaaaggaaattggaaaaaaaatgcatattaatgtcctctgagcttgcaaataggaagattgctttgaaaattcatagtatttgaatccattaggggtgggggaaatgtatttttaccattatggtcccaacagtattgtttaagaaagtagggaaacataagttaagtaaaaagtctcagtaacttggaaaatcctgccttatatcaggtaaatgggacatttattatggctaattaagttttatcttttaaaattgatttgtacattgacttttacctgataaatatttattgatcctctctatctttttcatcatacttcttttaaaaaatagtttttctaatacctgctgtttttttttttacagaggcaattaaaggcagatgctaaaaaagctattggaaggcttcaactacgcacactgaaacaaggagacaaggtacattcatgacttttaaatgctatttattttaaagcagtgctaccaagccattgttcaggctaaatgttcttcctaagtatgcttttattggcatttatgaaccttattgactttatatgcatttgattctagaggttggctgaataatggcctcccaaagatatctaagataactattcccttgaacctgtgcatattaccttatatggcaaaaaggactttgcagatatgattaagttaagggtcatgagatggggagattatcctggattatccagatagattcaaaatataattgcagtgtccttataagagggagagagagggagatttgaccacagtacagtaagggatgtgacaagggaagcaagagggtggggtgatacaagaaagaggcaaggagctaagggatgcagacagcctctagaagctgggaaagataaggagagggattctcccctggtgcctccagaaggagtgcagtattgccaatgccttggttatagacttcggatttccagaacagtaagagaataaacttgtgttgttttaagccactgaattatgataatttgttacagcagctacaggaaactaatacaatgctttagtgttactttggttgaatacgcattttcagatttaggacagttgaaaactaccattcatgggtaaaacatgtatttcaaaaaatagctatagaacttatggaaataatacaccattttaaatcttaccaaagtcatgaaactgtaaaacactaatgaaagagataaatcaaagaagatctaaataaatggaaacatataccatgttcatgggtcagaagacttgctgttgttaagatgtcggttccccaccaaactaatttatggatttgatgcagtttcaataaaaatcctagtgtaaatcttttatagaaattgacaggctgattctaagcttagatgaaaatgcaaaagaactagaatgaacaaaacaattttgataaagaacaactttggatgattcatgctacctgatttcaagaattattttaaagtcacagcagtcaagatagtgtcgtattggaaaaaggatagatttatagatcaaagaaacagaagagagagtacagaaataaacccatatatatatggtcagttgattttccataaaagtgcaaaagcaattcaatgaagaaaggatagccttttcaggaggatagccctttgttggctatccatatgcagtgattggatatccttaagcaaaaaacaagcaaacagacaaaaaagaacttaaatccattcttcataccctatgtaaacattatttcaatagatcatagaccttaacataaaacctagaactatgaaatttttagaacaaaacgttaaagaaaaatattttcatgacttgggtgacaaatatttcttagatataactccaaaaacaagtccaaaaaagaaaaaagttgatacatttggccttgtcaaaattaagaatttctgttctttgaaaggcactgttaaaagaaggaaaagataaggtacagactgggagaaaatatttgcaaatcatatgtctgttaaagggctgtacccagaatataaagaactcttaaaacttaacagtaagaatacaaacaacctaatagaaaactggcaagcaaaacagacaattcaccaaaaaaatatatatatgaatggcaaataaacacataaaagatgttcaacatcattaataattaaagaaatacaaattaaagccacaatgaaatacaactacgcattcattagaatggctaaaatgcatacaactgaaaataccaagagctgggcgagatttggagcaactggtacactcattcatttgctggtgagaatgcaaaatgtatagccaatttgaaaatgtttggcagttccttatgaagttaaaaatacacttaccatagcacctagcaatctcactactagatatttaccctaaagggagaaaaaatctacgttcacataaaaacacaactgttcatagcagctttattcataattgtcaaatactggaaaaaagccaaatattgttcaactggtgaatggataaactgtggtacatacatatcatggtatactatttagcaataaaagtgtgatgggaatcccattgatacatacagcattatggatgaatctcaaatgcattatactaagtttaaaaagccagactcaaaagctagataatgcatgattccatttatatgacattcggggaaagccaaaactataaaaacagatcagtggttgccaggaggtggggatgagaggaaaggttaactacaaagagtttagaggagtttgttgggagtaatagcactattctatatcttgattgtgataaggattaagtgacgacatatttttcaaaacgtgcagaactgtacactaaaagggtgaattttactgtatgtgaattataccttaattttttaaaaatgagaaaagttatagagcttgcacaaatggtattttatatatcctaaatcaggaaaaataaatcagtgctacatgtttccctttgttctgttccccttttgtttcagtttattcttttacctttttaaagtctggatacttttaaatcacctttgggaactttacagttacataatcattcagtgatataatgctcctccttttataggaatttaggctggttaagtacatgtatgttctgatcttgttctgtagtttaatgtattttttcttatctgtcagagtaacaataactacttgcttgtaggaaattggccctgatggagatagttgtgctgtgtgcattgaattgtataaaccaaatgatttggtacgcatcttaacgtgcaagtaagtttgattttcttctatatcttcaataaaatagctgacccacaaaaatgactgtgatggaagaaaactattttgaatatttccaaattaatgtaaaaaatgtttattttttaacttatcttcatttaaatatagaatggtttatttttatttttattcatttcttaataccactgaaattggtataagtctaattgtaatctgcttcaatttgttctaaactaattccatagaaaactgagaacctagccagcacaattgatatatatgtattatatatatattatatatagtatatatactatataatatgtattaatattatatatactatatataatatatattatatactatatataatatatattatatattatatataatatatattatatataatatataatatataatatatattatatataatattattataattataatatatataatattattataattgtaattatatattataattataattatataattataattataatatatataatatgtattatatattaaatataataatatatttatatattatatagtatatatcttacatagtatattatgtataatacatatactctatattatatatactatataatatagtatataatatataattatatatactatataatatagtatataatatatagttatatataaatatattttatatatagtatattttaaatatagtatataatatacatagtatactatataatatatatactatatataatacatattttatataattatatatactgtatatactataatatataattatatatactacatataatatgtattatatattatatattatataatgtataatatattatatattatacattatatactatatactgagtatatatactatatagtgtatagtatataatatatgtatatgtacatgtacatatatatactatatgtacagtatatatactatatactgagtatatatactatatagtgagataatataccatatattatctattatatagtatacaatagtgtatatatactatatagtatatagtatatatatactatatactatatatactatatactatatagtatatagtgtatatatactacatatatataaattgtgtatatattatacatatatgtaaattgtatatatataatacatatatataaattccaactaaggagtgaacacttccaaatagatgctcataacttgatttcattttattttttcttgatagattagaataaatttaaaattaatccagtactatccttatatttatgtgtatttatattatattatgtatatatgtatattatatatttatgtatatatatgtacattatataatatatatactctacataatatatagtatatattatatacattatacactatataatatagtgtatatattatatacattatacactatatataatatagtgtatatattatatacattatacactatatacattatatataatatatactatataatattataatatgtagtatatatagttacacatgtaaatataaggacagtactggattaatgttaaatttattctaatccatcaagaaaaaaataaaatgaaatcatgcatctgtttgaaagtgttcattccttagttttttaaattatccctctcctgaaggttgttcttaacactacttcttttagctatttaatacaatagtgatgctcttggaacatatcacattgcctaaagcatcagtacagtgttgttgtactcaatactatattggactatattattgagaatgactgtaccatttatcagttagggaattctaactgtttaagatttgaaataatgaacaaagtcttaggtcaggtagtgtcctagccattttcaaatgagtactgaaaatatttttttttggagctagagtaatgaggcttttacatttaaaagtaccgtattatggaatttccaaattttgtttctgtgactccttcattttatgaatagtgtgtttaaaaggaaaggcatccattcaaagactaaataaagttacactaagtaatctgttaatatatattaggtaaagtgttgctactttacaactgataattatgtttttttcctgaattagccatattttccataagacatgtgttgacccatggctgttagaacacaggacttgccccatgtgcaaatgtgacatactcaaagctttgggaattgaggtaaacattaatatgttatttatatgaagaatatatgcctgggctttggagaaaataacaaaataacatccttattttttcgctatgtaatacaccatacttatagtttatacctaaaaccagacatatttatatcatatagacaatgaggtgccatcttgggccatctccattttccttcttcctccctctttccaaatagactcattatttggtcagaatttgaaatgataaccatataaaccaccaacttggcatccctctttctgtttttgtaatcttttactattgcatagtgaccaaacttgtagttaaataagcagacataatttgagaaagcataataaatattaaattataattttatatttggtaaatgaaaaaaaggcctattttcaagatacaacataaaatcgagctcaaatcttgacttgggaaggtacatagatgacaatgattctcaagttccataggggacagcatgatgtttttttagggcctaacttgtacccagcattattttatgaagtgctggtatcacccaaatgaacataccagatgagagtgcactccgcctatagcatctttcatcccattggtggacccagttactctgttttgactggggctaacaagagacttgtgatcatcaaaagggatcataggtttaaaaggttaagaaatattgctccaatgagtcacctataaagaaactttgaagtgatatgtcgaggaaaagcgtgtacactgagaggcttttaatttgttacatgttctttaaaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaagtaagcatcatactaaaggttaacgagtgccctgcaatccattgtagatcatatgcctgtatagtactcttgctttttagcgtttgttccattcagccattatcatgatccaggttttttctacttaaaataatgccgtgaaggatgcacccctaccttaatatacatatattcaaatgtatttgaaatagatgaaatgcatcagagtggggattatttacaaaagaaagatttattggaaagcttctctctgatgcatttaaatcttggcttattaactaattacagagggtaaggagaaactttaaactttaggagccattgtttattgcagataaagcagaaattaaaataaaggagttctgaaatgataaaacagaattcaatttataaaagtttgatttatacccaacttctctggaacccatgttttgcaagtaggaaactgtttaagaatggtatgtgctgccacctgttgactatttaccgtgaaatgaacaaactgttagaaactaaaattgaatatatcattttcaaaattcatgtgaatttgtattgcaacttagtaattttatgccaaatgagaaattttagggagttctgtttttccctataaagataaaacccctataaaaattattttccctttcttttacctcaatcttttccatgtttttgttggtttgaaagtcttctctcaatcctcattttgagataatttaattctagtataaaagtaaaacaaaaactgattgtcaagatgacttatgaaactttcagcttcctattatataaacctttgtcctctataggcttatcagtgccatagataccacttctgaagatatcacaatgaatataaccacacaaaggcaaactttgtatttcttatatctaatcttcagacattcccttgaatataaactagttataagtatcttaataatctgtggattattctacctgtaatagagaatcattgtctgattgccccagatgatcttgtactctcataattgtgtggtaatagaattcagtaaagataaaagagagtgtacgagataatttattgctagtcttttaaaaaacaacattccaatctactctttttgtgttctgttcttctgtgggtaggggtggggtgggggaaaaaggtaagcacaacagattttgcagagatttgaaaagcaaatgaaataatgatccatgtttctcctcctgtattcttaatttggatgatagtaatactcacccaaccgccccaaaccagaaactagggacatcccaaattcttcccacttccccttctgtgttctcaattctgtcccctaatttccaaccttaattccacagtcatagtttgagccactatcttctctttgcctattccttccattcttccttacccaagaagttaggggagcccagtataactcctgtttctcctttaagactgacacctctttgagaagcctctcttgactagatgtgatggccctactgttggcttccatagaacttcgatcattgcacttactacactgagttgtattaaaacttttaaagttcttttggataagaacagtgtcttatattcactgttgtctatccagcacccagcacatagtagatactcaaatttatgttgaatgaattaccacttaaaccagatttaattttgtctgggattacatattactagtttaagaatcttgcgtattagccattgattcttatggtgatagttgatttgcataactttgtaaatacacatagttcatgtcgtgtgtcacatcattgggctaagttctattagagcactggttttcaaacttaagtattcattgagtcacttggagggcttattaaaacggaaaggtcaccaccagagtttctgactcagtgggttttgggtgatgcctaggaattttcgtttctaacaggttcacaggtgatactgattctactagtccagggaccacattttgagaaccattgaataagggccctactgtcaatcctggctatacataaaaatcacctggagagattttaaactttgctgatgtttggactgtacctcagagcaactgtgatttaacatgaggtgcagggcctgggcacaggtattttttattttaatttgaaatgatttcagactgactgacaaaaacgtttcaaaaataatacaaagaatgcccatataccattcacccagcttctccaaatgttaacatataaccatatacaattatcaaaaccaggaaatttgctgataaaatgttattatcaaaactataaacttgactcaaatttcaccaactggcccactaacgtcctttttctgtcccaggatcccacattgcatttaattgtcatgtgtccttagtctccaatctgtgacacttcttcagtctttgtctttcatgaccttgacacttctgaagattactggtcagttattttctagagtgtccctcaatttgggctagtctgctgtttccgagtgattaaatttattgtccatttttgtcaagaatactacagaagtgatgttgtgcccctttcagtgcccccatatcataccaggaagcacgtgatgttggtgtcttattagtgatgattcaaactttgcccacttggttgaggtggtgtctgccaggtttctccctttaaagttactatttttccctttgtaattattaaatatcttatagagagatacttggagactacacaaatgtcctggtacttatcatacttctacccactacttttagcaatcattgatgcttcttgcttgcagtaattattgaagtatttaccaaatggtgattttctgtttgcatcattctttgtacatttattgattaaacttctaatataaggaagagctcttccttctcctccatttatttattgagttatttatttattgtactataggatcctagacgtttctttcattctataatatcattctcatcgtttatcccttgctcatatcatcctagatttggtcattgggaacttgttcaagttggtttttgtgttctttcaactttcttactttctggtaacacaaggtgttctaggtctgggattagccaactttttctgtaaggggccacatagtaaatatgttaggctttgaaggccttaagtcttcattttcatactcttatttttttgtttttgttggtttgttttacaaccttttacaaccatgataagcacttttagctatggtttgtaggctggagtttgctggcccctaggctaaaatctaggttaaccttgtactttccctctcctagccctagaatcagccacttcttcaggaggccttttactggagaatagtatttcaaaaccaggatctgagcaacgggcatgcttattgctaccggggtgtcattgctattggcccttttagtgaacaagactagaaaatatatgtatttactctcacaaatatacacatacatatacattatttctctatctgtcattttatctatctatctgaaaaacaatgaccctactaatacatctgattccaatcccacactacagggttcattctagcctccccctttatttatttgtaactcctttctccgacagtgaaaggagaaatattctttttatccacagtatttttacttatttgttcaattatagaatatacataaaatagtttcagcattgctaacacatacccctgtgtaaaacaatgtcagtaactagtgtacagttctttttgtttttagccttacaggttagagtcaaaatactgttttccaaagttatttaagtttagttgttttcttccccattctcttcacatggttatgtatttcatttataatacaattaagttcatttattactgtttgtattcaattcaattttgggcatccttccaacttcctggttgattttttaaatctgtctatctatatttatgtgaatgaagaagcactggtaattttttaagtgcccaggtgattgaaatgtatagccagatttaacagcttgttatatttaaggtaaggaagaagtagaagacataatttttgctcttaaggaggctataatctaggtagaaataagcacatgtacgtgaatcaaaaaagcaattataaatcaatataataatgccatatgtgctttatgtaagatatagcataaatcatataattattagaggtacagggaatgaatatggtaatcagtgtatgttgaaattaaataagaaagacttcttggaagtaaatgttgaattttgtcttaaaagaggagaggggcaaaatcatcctaaaattgctatttctttttaaagatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaa

SEQ ID NO: 3549 - DNA, 73465 bp, human
ctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggtcaaggctacagtgagccgtaatagggccactgcactccagcctgggcaacagagggagactctgtctcaaaaagaaaaaaaaaattaaaatagattttatagtcccgtgttacagcctcaggaatagtcttataatttattttcgttcctcatactaaaactgtgttcctttaagtaggtaaatcaaattcttgaaaatataatcactgtaatgtagtattgcatgttttttttaacttgttgcaagtttccttttttttttttttttttttttgtttgagacaggatctctcactctgtcacccaggctggagggcagtgatagtgatgtgattatagctcacagcagcctggaactcctgggctcaagtgatcttcccacctcagcctccggagtagctagggcttcaggtacaagccactaagcctggctaatttctttttttttttttaagagacaggctgtgttgcccaggcatgatcttgaacacctggccttaggatcctcccactttggtctcccaaaggactgggattgggattaaaggaatgagccacctcacccagcctgacatgctttcttcttaaagcatggaccaactgcactagtttacctctatcctgcccactccatttactagtccccatagtctagaataagagaaatttgtctgaagaaataaactaagatttctaccacatatatatgttgtgactagtgatatccacacttatttagtggtcagtttataactcttcatgattattttatctgtggtattgacaagatgcttgaaattaccacatgagagctaccactgtaattccatgtaaattaaacaaaatggataagaaagaaacaaagaggtgcttttaaggttcatttggttctttttggtccagagcataagtgtgtgctgattttcctagctgctcaattactgtattcttacttaaaatcatgaagccaaaagctttgttgtgctttaccacaaatccacatttggattagctctcacaggagcttgactgtgtgccagcataagtttgcctctgttcactttgtttgctaaaatccagtgttatgtgttatccctttaaaagattagtttatgcattttgtttaatgaagaaatgataatgatcatctagaaaccttagtggttatactttaagatttcatttctttgccatatgataattggtggtaatcaccagcaatgtaatgactcttaagtgtggacttgataaagttagttgactccatttttttctaataatggaatagcagcaacagagaactcaaggattattaaaacaagagatgagtttgtaagttagaattctgaggtacctcttttaaattgttgaaacacttctagtggatatctgatagattactgaccatttgcctaactttatcttaattgttctggctcacagcaggatggaatatcttgtggaaatttttggtatacataagcggttttatagataaagcgattttccttcatttagagaaataattcacccttctggattttacggtccccttatgttatctcttgcttctcctagctaataatgacttttctatgacacctacatttagcacctggttttaaagagttaaaactaatttatgcatatttgtcttattaagcacaaatcaatttgctttgcttggcagatgggaactactacacgaatggagctatggggctacattctactaagtactctagtatatgggatttaggaaggtctgccaatcaggaagccttcatataggtagtttttaaagagtattttagtcttgaattttccatatctgaatagtgtaagcaggttcttcagtgttagattgataagctccctcagtagaccttttttgtgtggtgtagaacaaagctacgaagtaaaacttattaaaatggagaatttttagacattctgtttctgatttcctttttcatcttggtaccattactttgaaattaaattgtctgtaaaaaccagaatatgataatatttgaaataagcttttcattttatgatatttatatagactgagcaaatcactgtgtaaacaatttgtcataaacccatacataataaacaataaggtaacctttttaaaacctcttagtgaccatcccttgaaaatataaagcttctttcccctatttcctcaccccagactcaaggagtccaactctgaaaatgtgcgccttagttattagcaaaatatccctgcatttcatgcttacaaaggacatatctgataaaaaaattttggccttctaagtacctgtctactgagatgagggtgcccaagtgccaagcatgacatttcatttaaggtaaggaaagatctacccgcccccccccatacacacacacacaaacacacacacacaaaattaataagttaacattttggcttattaaaaagaaaatcccatggggcaacccctagagagggcagatcacgctttgtgctcccatccctctctggaacatcttggtccctgtgaaatcaagttaaagattacttttaaagatctctgaatgagaaagagcaactttgtaggaggttttgagtaatgaaggatgatcagtgttaccctcacctttttttttttttttttttggaatagtggaaagattattgactgcatacctaagtagaaaactaatatttggtttcaagtagatttaattctaatgaaagaaaaaacaagactgaaaagtcatgacattgaccgtcctttatttctcaaaatctcctacaaggctgccctttcttattcaaagagatctttaaaggtaattttttacttgatttcagagaacgaaatgttccagggagggagaggaaaacagtgtgatttgccctccctaggtattgccctatgggattttaaaaaaataaaaaataaataaaccaggctgggcacagtggctcacgcctgtaatcccagtactttgggaggccaaggcgggcggatcatttgaggtcaggagtttgagactaccctggccaacacgttgaaaccccatctctactaaaaatacaaaaattagccggacttggtggcgggtgcctgtagtcccagctactgatgaggctaaggcaggagaatcacttgaacccaggaagtggaggctgcagtgaaccgagatcgcactgttgtactccagcctaggtgacacagggagactccatctcaaataataataataacaataataataataataaataaaccaactacaagccaacatccacaaatatatgaatataacaccaagttcagtgattccacttgccccattaaccctgtttcttttatcttccttgattttttgatagttttatgtctctattcagctataattattttataaaggcttagtttcctcatctgtaaaatggggataaaaacttgtctttcctacctcacagcattttttatgtgggtcaaatgagttttgaaacttgtgagcaactatacaaatacttgacatttatctattaatgaaagagaaagacgttaaaatgccattttctgggcctgaagaacaaaggggttatatatttatgccattttccctagtaattactttccccatgttgtatatagaaattgatttggagtggtaacatagattatatctgatatgcaatgatatcactacaaaaacaaaacactgatagttactaattgaagaatttgggcatgatagtgattatgcatttatggtttataatcagaataatgtacaagaattagaataacttatcatgacatcatttccttttgatctgtcatcgcccaaaacctggaagttctcaaacagtgcttccgtagatatcagcatcacttgtcttgctgagtggtgataaagagtacatataacattggttaccttagtagtatttttcaaaacaatacttaaaaaataattattcaactggtgaaaactcatgctgtttgtgaacagttgtggaaggcttatggctataaggtaagctaaaaataaaaaataaaaagcagtcaggcatggtggtgcacacctgtagtcccagctacttaggaggctggggcgggaggattgcttgagcccaggagttcgaggccagcctaggcaatatagtgagataaaaaatattttaaaaagtaaaaggcattataatgtttgccacattgctgtacagctatgacagattttatattgcctttattttagaacatttgcccagttttccaccttttgctactgctatgtaagcacaaaaggtaagattaaatcctaaatgtgatggtatacaatgctttaattcaacagatatttaccgagtgccttttaaaaaacaagcactgttttaagtgctggagataaagcaatgaaaaaaaacaaagtccctactctcatggggctaataccgtagttgggggaggcaaataaacaaatagtatatgatatgactggtgctgataagcaatatgaagaaaaataaagtaaggtatcatgatagagaggggagggggttggtatattagagaaattggtctgggaaggcctcttaggatgagctgtggacagagacttgtggtactagaatatatgagccaaacaaatatttgggaacagagtgaatacatataattttttctagaagttttttctgtgaagggaaagagagaaatagggtggtagctggcccttgtcctgggtgttgagtatacagtggtgaataagacaggaatagttctggccaggcgcagtggctcacacctgtaatcccagtgctttgggaggccgaggcagatgtatcacctgaggtcaagagttcgagaccagcctggtcaacatggtgaaaccccatctctacaaaaaatacaaaaattagctgggcgtggtggcacacacctgtaatcccagctacttgggaggctgaggcaggagaatcactggaacccacgaggcggaggttgcagtgagccgagatcacgccaccgcactccagcctgggtaacaagagtgagactccgtctcaaaaaaaaaaaaaaaaaaaagacagaaatagttccaacccttacggagtttatcatgtgatggctcagacagttgataaataagtaagcaaaccaatacaattgctagtgtagtcaataataatagcagccttgttctgttggcttagaaatctccataatgcagggaaaccctcaaagcaattttccaaggccagctgtcttataaagtatgcttatctgaagtcctgttaaagatacaaatatttcctaaaagcagtgattaataataggtggtgtactggtggcaaagttccagtgtggcatctgtgaagcatcttgccaaaaaccagtttggggtgttttcaaattaaatcatccatctatgagcactaacaatatctgagaggtggtttggtagaagtggtgggaggaggggggacgttctaagtaggaggaataatgtgatagtgcaaaagcaaaagataacagttgttggggacacagcaaatattctagattcatttacgtggagttgaaaatatgagactcaatatataatgcacttagcgactagaaaaaggttattaaagagcaatgtcttaatctataccagaggaaaacctgagatagagaattaaagggacctaataattaaacctttgttttttgtgtccactgttctttcagtggacataaaacagcctatgtataacaaaaatttccacaagatattccatcctgctctgagccagaacaattaagtaagataaaattaggcaaatagtcagtaatctatcagatatccactagaagtgtttcaactcataagccaaataaattaacattttggcttattaaaaggaaaatcacgtagagcaacccctagagagggcagatcacactgtgtgctcccctccctccctggaacatcttggtccctgtgaaatcaagtaaaaaattacctttaaacatctctgaatgagaaagggcaaccttgtaggaggttttgaaaaatgaaggatgattagtgttacccccccacttttttggtagcagtggaaagattattaactgcatacctaagtagaaaactaatatttcctgtcaagtagatttcattctaatggaaaaagaagaaagaaaaaaagaaaaagaaaaaacaagactgaaaagtcatgacattggccatactttatttctcaaaatctcctataaggctgccctttcttatgcaaagagatctttaaaggtaattttttacttgatttcagagaataaaatgttccagggagggagaggaatacacattgtgatatgcccctttttccccctcccttactacactataaagaactgaagttttaaaacaaggtatagggctgggcacggtgacccatgcctgtaatctcagcactttgggaggccaaggcaggagaattgcttgagcccgggagttggagaccagcctcggccacacagtaagaccttgtgtctacaaaaaataaacaaaattagcaggacgtggtggtatgcgcctgtagtcccagctacacggaaggctggggtgggtgggagatcgtttgagccagggatgtggaggctccagtgagctgagattgcatcactacactccaggcagggtgacagagtgagaccttgtctcaaaataaataaataaaacaaggtgtaatcacattttctgattattattataatattagttgctctcttgttttaaactaaccaaaatgatgggcctggtttagttcttctaaataatgtttaaaagtactacactgtataccagtttattcatttgctatcatatttgctttcttctttgtacctagaaattcaggtgttgcaatttatttgcttttctgagggttactctttttgtgcattggtgtataggtcttgaagagtaagaagtggctgtaaatatagtaccaattctcatattttcctgtgtctctatctttagaaatgtttctgggtttgattaataattcatctattctttttttcccagaagacattgtaatctgttgtttgttatatcaattgcttccctaaaaaattctaaatcctttaatgaaaaaaagatttcagttagggaaggaaatgagtgcttatatatatatattcagttttcaagtaagtccctttaaaagaatgcagggagagagaaaacaggaccaaagaagaattatttttattaactgttttccgaagctcttaatataaagttggcagctttcaaaatgccaactgtggctattgaattattccaaaataagcattcatagtgtcattttaaggacttacatctggtagcaaagtaatagaatcaggaaaatccacaaactttattgagcacactaccttctcttatttgaatatatttcctgctaagtgtattggcagtttactaattagtttgtttattaacatataatgaaactaagttcagtaaagttgtacttgtttgactttgtaagcatgacaacttatgacaagataaagaatccactgtaagtttccagtaatcattaccgtggaaaaaattataattgaacattttacttagaatggaaataaatcttgtttgtaattaggaagttcattacatggctcttctgcagctagagcagtattcacttacacagtgccctcaatccagtttacaaacagaaagagcaacttgtcaaactaaaggacattttagtttgtgtactaaactagcacattgataatgagtatcattttcaagctgtggctgttttactggtctttcctctagcactcagcccattgccctacctgttcatcattaccattgacctaatacaaaaaaagaaatgtttatgaaatttgcaggtgtctaaatattggaaggggcaattaataccatagatcaatgtgctcaatattggccacaggttagattcaaatgaggaccttttatttttatttatttattcatttatttatttatttttgagatgagtctcactctgttgcccaggtgggggtgcagcggcgcaatctcagctcactccaagtgatgcaacctccgcctcccgagttcaagagactctcctacctcagccttctgagtagctgggattacaggcacctgccaccatgcccagctaatttttgtatttttaatagagacagggcttcaccatattggtcaggctggtctgaaactcctgacctcaggtgattcacccgcctcggcctcccaaagtgctgggattaaaggcgtgagtcaccaagcccagcctctgaggaccttttaaaataaactaaaagatactggatattcatggatgaaatgatacaatgtctagaatttactttaaaatactccaggagggagtatttagaacccagaaattggtacatattaatttctgaatgacttgcagggacttgatgatgattacagcttaatgagctggaagagttccccaagtgactagaaatgtagtctagcactagtttccaaattatttcttgcatagttttatactaactgcctgatttcacacttaacaaaactgagcaattttctttctacatagtacaaggcgcttataatcttgtgaacatttctgctgccaaaaagtgacctttcttgccagtgattttgactactcctctcacatccacatagccaccattaatctttcaacagtatcttcaaaaagatagttatcttttatctttatctgttatctgctaaagctatcctgtattcaataaagtgccttcatttgaaattctaattcctttattttgacaaatttgacaacttatgtttatttatatacacacacatttatgtacttaattctgtttttcaacatagtgatagctcttttggttgtcttttgcgactactcttttatccctttttttagtattttcacattcctatcttcaaattgaaaacattctcctcttctctatttcctcagtaatttttttttattattacactttaagttttagggtacatgtgcacaatgtgcaggttagttacatatgtatacatgtgccatgctggtctgctgcacccattaacgcgtcatttagcattaggtatatctcttaatgctatccctcccccctcccgccaccccacaacaggccccagagtgtgatgttccccttcgtatgttcatgtgttctcattgttcaattcccatctatgagtctgaacatgcggtgtttggttttttgtccttgcaatagtttactgagaatgatgatttccaattttatccatgtccctacaaaggacatgaactcatcattttttatggctgtatagtattccatggtgtatatgtgccacattttcttaatccagtctatcattgatggacatttggcttggttccaagtctttgctattgtgaatagtgccgcaataaacatacgtgtgcatgtgtctttatagcagcatgatttatagtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcgccattctaactggtgtgagatggcatctcatagtggttttgatttgcatttctctgatggccagtgatgatgagcattttttcatgtgttttttggctgcataaatgtcttcttttgagaagtgtctgttcatatcctttgcccactttttgatggggttgtttgtttttttcttctaaatttgtttgagttcattgtaaattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcccattcctatgtcctgaatggtaatgccaaggttttcttctagggtttttatggttttaggtctaatgtttaagtctttaatccaccttgaattaatttttgtataaggtgtaaggaagggatccagtttcagctttttacatatggctagccagttttcccagcaccatttattagatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccgtgtagtatagtttgaagtcaggtagtgtgatgcctccagcttttttcttttgccttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgatcttccatttgtttgtatcctcttttatttcattgagcagtggtttgtagttctccttgaagaggtccttcacatcccctgtaagttggattcctaactgttagaaccaaagacaaaaaccacatgattatctcaatagatgcagaaaaggcctttgacaaaattcaacaacgcttcatgctaaaacctctcaataaattaggtattgatgggtcgtatcttaaaataataagagctatctatgacaaacccacagccaatatcatactgaatgggcaaaaactggaagcattccctttgaaaactggcacaagacagggatgccctctctcaccagtcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctaagcccaaaatctccttaagctgataagcaactttagcagagtctcaggatacaaaatcaatgtacaaaaatcacaagcattcttatacaccaataacaaacagagagccaaatcatgagtgaactcccattcacaattgcttcaaagagaataaaatgctcagtaattttaatcacatagttctgaagacactatctgcatattttggctcctacttttctttctttttactttaccaaatctccaatttctcatagtcactatttcaatgctaaaagtgatagaattatttttccttttatccccaaacccatcagtaattccctcctcattagttgaaatataattattttctgtttccctcatcctcattcccattgtcttttccccaatactttctctttcataatatttgtcagttttctcatttctattttttaaaagcttcaattcatacttgaactttttttcatatcagataacttcttatctctataatctgcacatactgccattgccaaaatcttctttcttgaactttgccctatcaaaatcctcagaaaatttctaattgatgctatgctgcatttgtgactcctgtttttactttttatcaattcctgtatctactctcctatcctttcctttcagctaagccaaatttctctttatgtctttgtcttatctcctactcttctagtttacctccttctatgcatgtaacttcctaatgtgataggaagtgatgtgaggcaaatgtgagcatctgccaatctatctatattctcattcaaaccttgcttaaaatctcaattctttttaagtgggtcaaaataggaagagagccaaaagcctggtttataattgaattaaatttttcttaaaaatctgtattctaaattaaagggaaatgcctcataaagcaaaaccaacactcaaccaatcagagcttccagaaaaggaaggtaaatttatatatttcagccatcccattgatatggttaaatcaacaaactatatccttattgtgcagcaatatgttgaaagttatggatataaacacagagacagaagacatggttattgtcctcagaggacaaataatctagataaagagacaaaaattatatacatgaagctcttagaaagtagttataataaccagcctaatatatgctaggttgtgtagtacaggttaaacatcactaatctaaaaatgaaaaatctgaaatgttccaaaatccgaaacattgattgctgacatgatgccgcaaatggaaaatttccacacctgacctcatgtgacaggttgcagtcaaaactcatgcataaaattatttaaaatattgtataaaattatcttcgggctatatgtataaggtatatatgaaacaaataagtttcatgttcagacctgggtcccatccccaagatatctcagtatgtgtatgcacttaatccaaaacctgaaaaaatctgaaatctgaaacacttctggtcacaagcatttcatataagggatactcaacctgtatagactctaagtcctatgaatattcagagaaaatggaaagtattattgcttgggatagccagtgaggatttcataggggaagtgggtcttgaagaaaatgtagaattcagattagttggactggactagaagactttcattaggatttctttttttttcattagcatttctaggtaaaatgataattgcttagcaaagaccctatgggagaaattaactggttgtttaagaaaacagtgaactttgttctaggaaatagtaggaaatataattagattattaaactggaactaattgatcaagaaccttgaattcctaattgaggaattaagaattgttgaaaagaaaatccctgtacagaagcattttatttaatcaaggttttatcttgtttaaatatctaagattttcttaaataataatagtattaactaatatcgggtgttttactgtgtgctaagcattgctctaagtgcgttaaatgtaacaactcatttaatctttacaacagccctttgtagtaggatctgttttaaccttattttacaaatgaggatgcagaaagggtaagtactttaacttgctcaagttgacacaagcgacagagccagaatttaaacccagttagtctatagtactatattctacattcttatctaatatacatacaaccttatgaacgagatacataagtgctgcagatacattttgagatttggacaattgaagctgacttaactcttttattgaaagataattttctcagatactactcacattggcatactgtaatctctctttatcccaaatgtattttttctttaagaaaaatctctgtaaggactctatgggctagaaaagttttaaaataaatttattagtttgttatatgaagtgatacagatttgatttatctcttgtaaagtccttatttcaacaatctttctattacaacagggcttctggttgggactcttgattcagtcttggactctactgctaaagtagctccatttcgcatcctacaccagacaccagattctcaagtttacttgtcaattgcatgtggtgagtatgatttttaaaacataattcaaattaaataagggtactacaaagctgagtattcatatttatttatagtctgtagttgctttgagatttaaaaacaaattaaatgtgcaactttactttgagagaatagcaagacctctatttttaaaggatatgggttattaagttttttttttttttttaatccattggtgtgagggacctgaagcatgtggtctagcagggctgattctgcacagattttggtcagtgttactgctatataactcctttcttcaacttctgctttatccaactgctgggaagatgagaacttctccatgaaataaattgtttcattactaataactcaaatgagaagaatctgaagttatctgtgaacccaaaacataatgactcctaaggaagtataagcctggaaaattaaaccttttttattcattcccaccttctcagaaaaagcatcatatccttgaaatatgaaggaatgtcttacagttaatgttacatattcattcatgccagggtggttcagatgcttcaacatatatattatgggtagaaaaggaattaggataatcctttctaataaagcaagtcaaaataaatttttaaaaagctgcattgacagtttcttacttccttttatgatgccattataatgttggtctaaattagaatcccagatttctagcctttttgatattgaaaaactgcctttcttcttatccccctctcttctaaagtagatatattataattttttaaaaagaacaaaagcacatgagtttctggaacattcatatgtgtgaacatatagcatacaattaattttttaggttgtgtggcttgttttttatatttccgcctaaatttcttttagtgttgccagtgagtctttcctcctggccctcttaaagtgaatgtcacttaacctaaatgaggttgacattatacctgctgacatcacgagaattctgtaatctcaactctaaatctggttagtaaaaattattttttttaaaaaaaggcctttctacttaaataaagatgattgtataacttatttcccccaaattaacctgatgcagaaatagtgtagttacctactaatgaagcttccttataccaaaagaatcaaacttaaggccttaacatttcccccatggcttttatttgtggtccattaaagacagttattactcttgctatggtgacttagtagcatgaataaaattctgattgaattgtaggaaataggccatttgcaatgtcaacaaattttttaatatgccagtctccatatattataaaatatactaaaaagtcagcatatttcttttgaatatttatataatccatagtgctgagaagactttaatggtatgtgagtgataggaagagattgatagatactgaaatattcttcaagtcaaagcaactagggctaataatgtttaatctcaccctcagcaaacctcttaacactgattcagcgggtcacatggatttaaccttgctacagaatttctaacctcctgtatgaaatttctgtaagtttactaggtcttttgatgaatggggttgctctgagcaaaggttttgtggcttctgaaataagtagagtggccacagttaaaatctacatttacttagcatgcataggattgtcacatacatgctgttttcagccacacatattatagacacagcactaactgcattatttggagaccaaggattgaattacacattatgtattttctggtactctacatattttcttaaaagatactggttattctttaggcaccagttactagcatcttgttttcagaattttatatattttctcatgagctggatttactttactcccctttcattaaatgttttgttctttctatttatgagaagtactgttcatgcccacatagagggataaagtaggaataaatgtaaatattttactcctttatgaccatcattttttaaagtgaaaatgttatttctttttaaactatgcttttaaataacaagagcagttttattgtggagttttccttaagtgttttattttcttgtgttattaatcaggagccaacagagaagaaataaccaagcattgggattggttggaacaaaatattatgaagaccttatctgtatttgattcaaatgaagatattactaattttgtacaaggaaaaataagagtaagtggcacggatatatcttgtagatggagtgccaaaacctttgactctcatgtatgaggatcaaagtttgcatggaaggtcattgtttcactggcacctttcaggattggtagaaacgaacatatgaatttcagaatcagtgtgctaaagaaaactgtaaagtctttagcacagggggagattgatagatattgaaatattctcttaaaacatactggttattctttaggtaccaattactgacatattgttttcagaattttatatattttctcatgagctggatttacttttttcccctttcattaaatgtttgtctttggtgcccttgtgaatgcttttaggggcatttttgtttcaatatctcttgagttttgagttgaataaaccatttgttcattcaaaaaaatatatttagcacttgtatttgtagtagttccttatgaggcattcagaaaaaaacctaagcacaaaactgaagaaaatttgcttacctctgtcctaagagaattatctatgtacacacatatgatatatgtacctgtatagatatatacagtcgtccctaggtatctatggggattggttctggccgccgctgtagataccaaaattcacagatgctcaagtctcctaatataaaatggcatagtatttgcatataacctatgcacatctgcctatatacctaaagtcatctctagactattcattcctaatacaatgcctatgcatcacttcatttgagtggactctgcatagtcttcggtgcatggcaaattcaagttttgctttttggaactttgtagaatttttttcccaaatattttcaatccctggttggttgaatccatggatgaggaacccatggatatggagggctgactgtacaattgtattcaatcaactgtttgaatgtatgaaatatatttttgttggtaggtgatgaattttcagaaaatattttgtctcctttagggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaagtaagtggtttctattgcttactatggccttgaatttgctgtctgacctaccaactctaatgatgttaggttgtaaataaaataataggattgatattaaaggtaattaaactgtacaataaaaagtttatttcatctagggaaagaactcttttaagactggttgcttaacataaaaccattagaagtgtatatagaatgccttgcatatcgtgggaagtgagtcagtattaaatgatgatctggcatatgactgctttcaattccttgttatgaactacctacatgctttagtctgtgttttaatctattttaaacatacaatttgaatatagtggccatagtacctaatggcccacatctcactttgtagctacaaagaagaatcaaacagtgctatttatagcatacaaacagcttttacattggtagttatataattatgtaattatataaagagatagatttaaatatcaaatcagaatcattttttttaaaaattatctaaaattaaattgggcacagtggctcacgcctataatcctagcactttgggaggccaaggcaggaggatcacttgagcccaggagttcaagacgaacctgagcaatatagtgagactctgtctctacaaaaaaaaaaaaaaaaattacattagctgggcatggtggcacatgcctgtagtcccagctacttggggggactacttgggatgtgagaatcacttgaacccgggaggtcaaggctgtaatgagccatgatcatgtcacctcactccagtctgagcaacagagtgagactctatctcaaaagaaattatttaaaattagatctcttcctggaatcaccaattcttgcacgttcatgttgatgcttcaaatttttaactaatcttgaactctaaactattttagctgtttatagtatttttcaagggattaactattgtttcagaagaactgattaataaacataaatcactatgaaaatttaatcatacctgcttatacctcttatttgcagtaaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaaggtattcaaagcttaatttttagttttcaaagtattgtttgaccataagaatgaagatagtattgcttaccattaaaagttaactcttctatattatatgatagggttttttttggagttgattgtgggtgtgtgtgtgttttgtgagtttattcatatgcattacataaatagtacccttctctccaggaaatttaattgtaagaaataatagaagttagatttgaaaattatttcttgagattcagataggacttgccctggaatgcttttagaaatgcagagatttttatgtgtggttagtctaactctaaatttctctatgaatagtctagacagtttgggtctgaaattgttaaacatattgtttattttttaaaataacttacagaaaacattttttaatgaagaggcaagttcgtggagtcagtggagcatggactttagaatgaaagtagaacaacccttagacaagtcatatctctcaggacctcagtttcctcatctgtcatttctacctcagagggcacttatgaggaatgggcatgatatgtgtgaaagcactttgtaaaatataaaatatgaggcaaatattaatcattattagtgcctccttcagaagtatgtgtctgatagctgtttgccattatatttggtttgttgaaactgaccagatatcttttatcctgctgaacattctgaacagttgactaaaatgagcatgccaaaggggaaaaggagaggagatgatccagaaatagctagtgaaagcagcttctggcaaggaggatgtcagtatagactatatgggaaagtataagaggaacctaagccaaagtcctatggatagaccagaacaagtgacctagaaggttgtatgatcactacatagccctcattgggtacagttgttcctcttacctgttcctaaactattcctaaaattgatatacatgaggatttgtttgtgagcctccctgcttttatggaaattagatcagcaaggtaaattttttatacttcagtaccaaaactaggtctcagtatgcatgatttataaatagaattctataaggattaagaatcctgtttgtattatattataggtgggcgtttgtttttgtatttcatttctttattggcaaccataaacaaactgttttgccattttatttcccttaaaatacagtctaaaaggctatcaatgagttattcatcaccaaatcggtatttaattaagatataataaatccatttttgtctgtgtgcatttttaggagagcccattgaaaatcgtacatatctacatctttttttctagtaagttaaaaagaacagtaatttattgggacttagtctccaaatggcttttttataaaatggaatatctttattgctctgcttattgtttttacaaatatgtattacttttatagtttaaacaatacagaagcacagtaatgatagttaagtttagcgtatatccttctaggctttttaatgcatgaatttataaatatttgcaaaaataggtctggacatcacacattgttctacaatctgctttttttctcttgtatcatggacaactttctattcacataaatggactttattttatttaaataatagtgaacccacaaaattgcaatttatttgttttattagctttcccagtttgaaaaaaataccatttaactgaggtaaaaattaacatggttgtgtttttctgttcatgtttatccgaagtattttgaaagacatgatgaactaccacatatttaaatagtatatgcaggaagaatgaatttagttttagctttgttggatttgagttagaacttgcattatttacttattatcccagatggcattgctgcttaatgcaattgtttcgtgtgcctagaaaaaattatactatttaaagcaattgctttttacacaaaggctacatttgtctatcagttaataagccctctgtatttattgacacctatcctgtgcccaacatagtacaagcagtattattttatcatacttctactttagattttttaaaacattcatttaaaattttacttcacttaatttttaatatcgtctttaatagactactctttccctctaaatttttatgccacaaattttcattattttattttacttgaactgggtaactcgcttgattttctggtaaccagataggaacattgttgtcttccaggattgattttaaccatagtcacatattatgcctatatgataatataatagtcttctaggaaatcaccccttagagatagtttgaagacctacatgatctctaacttttgtgcattttaatctactaataaaatgaaattggaagaaaagaacaaacaaaaggagtttgcaaggaatcagtgtatttttttctatttcagaatttgttgaaaaatatagcatttttagtgtttaatctgtgtgcacagtgtatgtagattagtcaatataggcatatgtataccttagaattcatttctaaaaattcatttgtgccttatcccattttttctttcctacagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtaatgtaaatttggttacatatcagtttttagtttgaaaatgttatccttcacagagtaaaatgtcctttaattctataaattattaaaacctcaagatgcaatatccttttagtaatttaaaataattattcttcagaataagagtacagccttctgagatattctcagttccatttagtaaagtctttttttattattatactttaagttttagggtacatgtgcacaatgtgcaggttagttacatatgtatacatgtgccatgttggtgtgctgcacccattaactcgtcacaacattaggtatatctcctaatgctatccctcccccctccccccaccccacaacaggccctggtgtgtgatgttccccttcctgtgtccatgtgttctcattgttcagttcccacctgtgagtgagaacatgcggtgtttggtttttttgtccttgcgatagtttgctgagaatgtcatacatttttgaatgatcaagctccattttgcattaacctaaatgcttatcttgtttttaaattttaaagttttaaaattttcactttcagtaagagctgtaagactttactaaatggtaaagttagactatcacttttgatgtactctgtcagaaaaaaataacattgacatcttttacgtaagtcagaaataaattgttggtatttgatactgaatttttacatttgtactgtcatttttaaaggatacatgttagacctttttcttgagaagtgaaataacttgcactgaggttaattgtatgattggtgcaactagtacccaaagtctatttcttaataagtcatactatagaccaaaacttttggccacaaaagagtaagccaaacacattttacttgaaggtgtcaacaataaaggaaaatttaattgacctctatgtttttcaccccctaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatattagagaggacagagaaatcaggaaagatccaaaattgacaccctaacatcacaattaaaagaactagaaaagcaagagcaaacactttcaaaagctagcagaaggcaagaaataactaaaatcagagcagaactgaaggaaatagagacacaaaaaacccttcaaaaaattaacgaatccacaagctggttttttgaaaggatcaacaaaattgatagaccactagcaagactaataaagaaaaaaagagagaagaatcaaatacacgcaataaaaaatgataaaggggatatcacgaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaacaacgaaaaagagcccaggaccagatggattcacagccgaattctaccagaggtacaaggaggaactggtaccattccttctgaaactattccaatcaatagaaaaagagggaatcctccctaacccattttatgaggccagcatcatcctgataccaaagccgggcagagacacaactaaaaaagagaattttggaccaatatccttgatgaacattgatgcaaaaatcctcaataaaatactggcaagccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaatcataagagctatctatgacaaacccacagccaatatcatactgaatgggcaaaaactggaagcattcccttttgaaaactggcacaagacagggatgccctctctcaccactcctattcaacatagtgttggaagttctggccagggcaattaggcaggagaaggaaataaagagtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatagaatacctaggaatccaacttacaagggatgtgaaggacctcttcaaggagaactacaaaccactactcaaggaaataaaagaggatacaaacaaatagaagaaaattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcgttaccattcagtacataggcatgggcaaggacttcatgtctaaaacaccaaaagcaatggcaacaaaagccaaaattgacaaatgggatctaattaaactaaagagcttctgcacagcaaaagaaacaaccatcagagtgaacaggcaacctacaaaatgggagaaatttttctcaacctacttatctgacaaagggctaatatccagaatctacaatgaactcaaacaaatttataagaaaaaaacaaacaaccccatcaaaaagtgggcgagggatatgaacagacacttctcaaaagaagacatttatgcagccaaagaacacatgaaaaaatgctcaccatcactggccatcagagaaatgcaaatcaaaaccacaatgagataccatctcacaccagttagaatggcgatcattaaaaagtcaggaaacagcaggtgctggaggggatgtggagaaataggaacacttttacactgttggtgggactgtaaactagttcaaccattgtggaagtcagtgtggcgattcctcagggatctagaactagtcataccatttgacccagccatcccattactgggtatatacccaaaggactataaatcatgctgctataaagacacatgcacacatatgtttactgcggcattattcacaatagccaagacttggaaccaagccaaatgtccaacaatgatagactggactaagaaaatatggcacatatacaccatggaatactatgcagccttaaaaaatgatgagttcatgtcctttgtagggacatggatgaaattggaaaccatcattctcagtaaactatcgcaaggacaaaaaaccaaacaccgcatattctcactcataggtgggaattgaactatgagaacacatggacacaggaaggggaacatcacactctggcgactgtggtggggtggggggaggggggagggatagcattgggagatatacctaatgctagaggacgtgttagtgggtgcagcgcaccagcatggcacatgtatacatatgtaactaacctgcacattgtgcacatgtaccctaaaacttaaagtataataataataaataaataaataaataaataaataaataaaatattagagaggacaaggaggattttgatgtttaatatgtctctcatggaaatgcagacaggtcaaattcaaatgaattttcttttacaatgtccaggaaccccaagttttaatagattgatacaacttatcaaattatagctatttgtattttaattaaaattcaaagaaaaactaaatgtgtctttattggctatattattttatttgaattggagtatagagccttttactgctatctccagagtagagattgaaaataatatgctaagtcaattataatgcagtattgataaaactaattttccctttgataattaaaaagcacaatgaaaacatgtaattaaatttttttttccatctcaattccagacgcagaatttctacattggccatcaagggttttccttgccccaactttattatctctcattctcttttagtatgtacccaggatattccttagtttgatgtgggaatacaagtaaaatctgaccagccttagtagttttctctcccaatgctcccaaattcttacttatatcatgttttccttgttctgttctatttcacattcagtccacgtgttagcttcaaagctcaacatatctttctttttcctttaatttgcttttccaaaacctgaagagctgtaactgttccccttaaaactttcatgtgcttttagtagctgaatatgctcagttgtcaagaaaggattttgtttcaaaatgagtttaccatctttccaaatatgcatcagaattctacagttttctagtttctcactcgtttttagaggttttaataaatatatgtacaaaataccagctagtatactatctgcttggaaatatgtatttttaaattgccataatattctgttttcacttaagatttttatcttatcaatgatgaagaatattgacccattttagtatctgtatatatctagttttaataatagtacacgtaaaaacttagtaaagagaaagctttttaaacaagagctagttccatttgatttctaagtaacagaaattatagctatattcttttataactacacttttactaaaacgaagagaaaaattgcattctataattttaataaacctggtgacttttgtacaaacagcaagactttttattttaaatctccaagagtctaaatcaacaagtctaaatatgaatacaggaagtactttaggaaatctttcctgtgagaatgtcaaagacattatacaaagaacaagtcctaccagaagtaattgaaattatgcatgagtaccagttctatccaagtttttatatgggtatatatttaaatgttccacattttaataagttatactaaaatctgggcatataaagagatttagtaaaattctaataaactgcttggaaaaatacatgaatcttttactttcattgacacatataatcaagaactattactagataaggtaatttttcaaaactactcaatgaaagaaaaatgggccctcttaggttagttttaagcaaagtggcctaagaatggaaagcactactgaagatcccttgcctgatgcttttaaactacattatgaatgaattgtagaaactatggaatgtcaagaaaggtagtaattgagtttatgccttaaagtttttagatgggcaaataagtatcttctacatattatcacagaatatgtaaacataacttgtttcatatagttagtaagatagttactaactgtatgtaatatagttattatcttaataagatagtttcataaccaggactatcttactaagtttttaaatagaagtaatgggtttcctacatgataatgtagatcaaaattgtagtttaaccaacataactgattttttcttgccttgataagaataaggtgcttcctatgaccataatataaatttggaaaatgatttttagctgtgggggtagatttatttctaagttgggaaaccagaaactattaaaaatgaaattcacaccctttaaattgtggactatgaacaggatcctatttaagataagcttctgatatttgagaaaagcatttgtttatatttttttgttttaattattggttttacaggtcaactctggcccccaaaccaccatttattataccgagtttatgaagtattctaatttaaatatagtattttgtagaaatttacacataaagaaatgttaatctttgctttgtctttccttcacttttagagccatatgataattgtaaaatcaatgtcagataataaaaatgaaacagattaagaatacctgctatagagttaacaatctatgttgctttctagatgtgattggattttgctcaggcactaaaagtctgatgagtgccaagtttatttgtcgtaagtgtgaacacccaaataaatggagagaaatatagatatttatccaagtatatatataaaacaccatgggtaaaagtttccattcaaaagagccagagcaaaaatgttcaaaaactttaagtttagttccttgaataatctactttattacactcttcaaaatttcaaacattaaactaccatctttgaaggtaaatgttttttattttatttcttttgtcatttttttaaattttctaaccacctactgcctgttgatgaaggtgaaggttttaacgtgactttatgaatacttaagaggcaataatggatagaactgacatacttgtcatcactcttataaatttatgtttagggtttcattgcttaagaggttatttttttccctctgggatacttttcctgtagtttagaacaatagataaactgatgattcagtcatttaaattaaaggaatgtgctgtgcttgagatccagactacaaccatgaattttccaacctgtatttgcaaaaatgtaactcctcgttcaaacagctaaacttaatattaagttgtcaagtatgtgatttgtcaaaataagcatttaaaaaaaaaaagaagggaattgttgcaatttgagacctatactctctaatcattaatttttcctttattggcttcttctaccttaccctttcatttacacattgatttgaatactccttaactttccttgaatcctatctatactcatctgttctcacgctgctatgatgaaatacccaagactgggtaatttataaagaaaagaggtttaattgactcacagttctgcgtggctggggaggcctcaggaaacttacaatcatggtggaaggcacctcttcacagggtggcaggagagaaaatgagtgctgagcgaagggggaagccccttataaaaccatcagatctcatgagaactcactcactatcatgagaacagcatgggagaaactgcccatgattcaattatctccacctagtcctgcccttgacacgtggggattattacaattcaaggtgagatttgggtggtgacacagagccaaaccatatcattccacccctggcccctcccaaatctcatgtcatgtcctcatatttcaaaacacactcatgccctaccaacagccccctaaagtcttaattcattcccatattaacccaaagtctgggtccaaaggctcatctgagataaagcaagtcccatccacctataagcctgtaaaatcaaaagcaagttagttacttcctagagacaatgggggtacaggcattggataaatacactattccaaatgggagaaattggccaaaacaaaggggctacaggccccatacaagtctgaaatccagcggggcagccaaatcataaagccctgaaatggtctcctttgactccatgtctcatatctaggtcacactgatgtgagaggtgggctgccacagccttgggcagttccacccctgtagctttgcagggtacagcccccctcctggctgctttcacaggctagcattgaatgcctgcagcttttccaagtgcaaggtgcaagctgtcagtggatctaccattctggggtctgaaggatggtggccctcttctcatagctccactaggcaatgctccaatggggactctatgtgggggctccgaccccacattttccttccatactgctctagcagaggttcccccatgaggactccacccctgcagcaaacttctgcctggacatccaggcatttccatacatcctctgaaatctaggcagaggtttccaaacctcagttcttgacttctgtgcacctgtgacttctgtgcatctgtagcccaacaccatgtgtaagccactaaggcttggggcttgcaccctctgaagcaatggcccgaactgaaccttggcctcttttagccacagctggagctgaagcagctgggatgcaggggaccatgtcctgaggctgcatagagcaggggggccctgggccaggttcacgaaaccatttttccctcctaggcttccaggcctgtgatgggaggggctgacgtgaagatctctgacatgccctggagacatccaaatttggtgattaacattcggctcctgttgcttacacaaatctctgtggctggcttgaatttctccccagaaaatgagtttttcttttccgtcacatcatcagtctacagattttccaaactttttgctctgcttcctcttgaacactttgctgtttagaaatttcttccatcagatatcctaaatcatctctctcaagttcaaagttccacagatctctagggcaggagcaaaatgccaccagtcttttcactaaagctccatttcccaagaagttcctcatctccatctgagaccacctcaacctggacttcattatccatattactatcagcattttggtcaaagccattcaacaagtctatagaagtccattgtccatattactatcagcattttggtcaaagccattcaacaagtctataggaagttccagactttcccacatctttctgtcttcttctgagacctccaaactgttccaacctctgcctgttacccagttccaaagttgcttccacatttctgggtatctttacagcagcgccccactacctggtaccaatttactatattagtcctttcttacactggtatgaagaaatacccaagactgggtaataaagcaaagaggtttaattgactcacaattccacatggctgggaaggcctcaggaaacttactatcatggcagaaggcacctcttcacagggtggaaggagagagaatgagtactgagtgaagggggaagccccttataaaaccatcagatctcttgagaactcactcactatcatgagaacagcatgaggtaaaccgtccccatgattcagttatctccatctggtcccatgcttgacacatggggattattacaattcaagatgagatttgggtggggactcagagccaatcttaatgtccagccctgctagggcttgtactggcttcttggatttcaaactaaagtaccactggattggtccaccctaagctgctacttttcctctgcctcagtcatgggcattctttatcttacttaagctactaaggtttactaaagtttaagggatgaacttaagtgagtcttttcttcttttttttttttagcactcctagtaataacttgcaatagctggtgtagttataatccatagaagctgggtaactgatatgttttaagagtaaaactttggtgttcataaagttttatgtggaaatacaaaagactcagagtaactaaaacagtattgacaaggaaaaacaaagttggaagactcatgctttccaatttcaaaacttattatacagctatagtaaacaagacattgtgatactggcataaggggagacatgtagatcaatgtaatatagttgagactctagaaatacattcttacatttatggtcagttaattttcaacaagaaggccaagctaactcaatgggggaaagaactattttcaacaaatggtgctgaaacaatggacagcaacatactccccacccccaaaaagatgttgtactcttttcttaaaacatacacaaaaattaaattaaaatggatcaaagaccaaaatgtaagagctgaaactatgaaactctcagagaacacataggagttaatcttcatgatcttgaattaggcaattgtttatagatatgacaacaaaagcatgtgaccttaaagaaaaaataggtaaattggattacatcaaaattaaaaacttttgtgctacaaatgatatcatcaagaaagtgaaaagacaacccacagaatggaggaaatatttgccaattatatgtctggtaagggactgctgtctagaatgtatgaagaactcttacaactaaataataaaaggcaaacaacccaattttaaaaatggttaaaggatttgaatagacttttctccaaagaaaataaagaaatggccaataagcacattaaaagatttttcatatcattagtcaatagagaaatgcaaatcaaaagcataatgagataccatttcatacccactagggtggctataattaaaaagaaatataatactgttgaggagaatgtgaagaattgaaactctcatgtattgctgttgggaatgtaaaatggtacaaccctcccaccccatactttctgtcctctaataaccatcattccactctatacttttatgagctcaactttttacctccttcatatgagtgagaacatatggtatttatctttctgtgcctgacttatttcacttaacataatgttctccatgttcatccatgtcgctgcaaatgaaaatgtttcattcttttttgggctgaatagtattccattgtaaaaatttatcacattctctgtatccatccatctgttggtggacatttaggttgatttcatatcttggctattttgagtagtgctgcaagaaacataggggtataatttatatatttgtgcttatttaacattgcatgcctgtatcaacacatcctcataagcaattggtattttcaatgttttgggttttaataggtgtgtaatgttgttttaatttgcaattacccagtgacatctgatgttgaacctctttcatatgattatttgccatttatatcttccttggtgaggtatctatttagatcttttgcccactttttaatgggtcctttatttttttaaacatagttttaattctttgaatatatttataatagctactttatagtctttatttacaaaatccaacaagtgggccccctcaagacactttctattggttgcttttttaagttcttgtttctatttttaagcctgacttccttggatcaccccctgaatcagtataatttagtggttattcagtgatgggttagatttccttaaatgccttatgctaccaaatattctacctttttctcaaggatatctgtgtgaaggtatatgtcaaacttcaggcaattttcacatcagctttagcttttattccctgctttcaaagatagccagagttgagtgactggggctttcttctgtcccatttctttcctaggcatgttcacagccctgtacatgtattcattcttctagatccccaagaatatgttgcagcccttcaaagttccacatcatcatctggtttttcaggtcttccttttaaatctttagccaggctcttgtttgctctagctgaaatcatagccttggacagctgggttgttaccaaccaattgctattgttttctataataccctgggaacagagttttttcaccaagctgagctgtgaataaaatcaaatgataacaacaccctgggaatagagattttccagggagttgcaagtttggtcaaatattgtctatgccctagggatagggcttttaatgaaactccaaaagatccactggttgccatactgctggctttcatttctgagcttgggcaggtggatagagttaaaagacccacagactcttctggtcttactcaggcaggctcattagtttttctcgaataggtgcttttcagtttattgcatgcctttggttaattccagtgttctgaaatggtttattttgaatgttttgccactattttgttgcttttgttggggagtgtgttcacaggggttctgagcttgccattctagaagtcaggttgttgacatatctaattttgataggtatgtctctgagatattgctttaatatttgttatgtatacagattgtggcttataaataacagtaaacattagaacttttttttcttgtagaaacgtaagcatgcatctgggacaactacattctttctttttcagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatggtaggaaaacaaaatatttaaacctatgggctgaaacatttggtgaaaagtaaaaatcttaaaagcagactagaaggtatcacaactgaaaactcttcttttgggacttgaaaagttttccagcaggtactactgtgtaacttatttagttccactgtacacaaggactattatcaggaatgaagataaaagataaaagttggacattggggatttttacagatacataatagtcgtacatatttattgacattgggttttatttgcatggatttctaatccttacatagatgtgatttggggagaatgatggtttaaagctttgcctcccaagtataacacttttaccatttttatatgagtttagctaagaattaaaatagtaaattaagctgctatgctcacatgagtttaaaagattttcatgatgacaaggattcagtgtttcacccctgggtgaatactgattttggttttctatgttcttaatttctatagatgttgtttcaaggtaaagagagtgggaaagttattttgcagaagttaatttctcactaaatttagttgttttgatttttctgtcattacagttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtattacgtttattcattgtatttatttaatagacattaactatgcctttctaggagttatgccctaagctaaagcaaaagaattacaaagatggttaatacaaagtcttactcatcttgagttcggactagtcaaagaaagaaaggtaagtagttatctataccttacctatctatccacacatccagcatctgagcacattagtttattaggcaagatatgtatactgggggaatctttagtgtcaacagtcagttaagggggaaaaaagctcatgaaattggtattctgttggataaattagtagcttgacatagattctagtgtaaagctcttttctgtttgtgctcagaaatcacttaagcataaggctaaatatcaaggtaatgaaatccaattatttatgtatatatggaaatagcttcattatatccaccttctgttgtatgttaatgtaataatcttcacaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggtatgacttaactatgagcccaactgtgtgtatgttccaaataaaatcacatcaaatccaattccactaatttggaagtggcgattataaggaaagagatgggggtgagatagatagagcatagtattaatgtaagtaggatggtagtgggaatacttaggagaattgatatttcattatttttctttttcacttaacaaatgtttattgaacttctgctctataaaagatactctgctaggtacttaaggctatataaagatgtatcagataagggtcctcccttaaaagtatgtagaccaggagacattaaagcatattcattaagaaacaaaaatcaagtgagaaaaactgttagagaaatataaattcctgtcatgatttataacaaggagaaactatttttcatctggaggagtcagagaaggcttcgtggaaaaggtagcatttgcaagtcttaaaaattggtgaattttggacatatggaaatggaatgaaaagaacatgccaggtgatggaatccatgtaaccgaacataggtagaggtaaacgtaaagtatgtataggaccatgtttgtttagtttggtagaaacatagggtggatgaagtgaagtagttggagaaaaaaaatcaataaggtagattgggatagagctggagtttgaattttattttataggcagtggaggaatcattggaaaaaaattatttaggagcacacaatcaattaggataggctagactgctaacacaaacacagataatagatgaaacagtataattttatttcttgaaggaataaacaaaggagattgactcttcaggtcagtaggcagctctcctccatgagattattcaggaacttagactgtagactgacagcagactgtcattttcaaaacaaaccttcccgagtacattttcatcaccattagcactcacaggaacagggaaagagcatggagaaacaactgtgaaagattttatgggctaggcttgaaaggggcaaatatcacttcatgcacattctattggatgatcttagtcacgtggatacacctattcacaaggaagtctgtggagtatagcgtggctgagcagacatgagcagctactatggaagaagaggagattggaatgtcatggataggtagcactctgtgccatacgtttatttataatgggttgaatacctgtaattgttacatgtcaatactacctatccactgtaacttgtcaatagagattttttttttttgaaaaactgtttaagtgaatggaacatctaaatggcaaggatttttagcatattttaggatctctgaaaggtacaaaagaagcataatgcttcttttctcaaagagcttatactcacagaccctgtgatattgtctataagcagtagtttagagatagcttcaaaataggcagcacttaatattgacttctaaaagatgagagcaaagttagaaacatggagggcaggaggaaagttatttggggctaaagtatgagtgataccattcaggtgagaataagcccaccttgggagataagattggctaggttcacattggaataaaaaagtaaatttgtatggcacaagatcatgaagaatctttcaagcctgggaaaagaatttaaacttaatatggtagacagattttgttggttttgatcaaaaacccacgtgagacacatggctggctagcttgctctatctatctatctatctatctatctatctatctatctatctatctatctattctgtctctctaatcttttctatcatctgtctccatctatctatctaatgttgatatataattcacttaccacaaacgtcacccctttagtggtctctcatatattcacaaagttgtgcaaaccttcaccattatctaattccagaacattttcatcaccctaaaaagaagccccatatccattagcagttactccccatttctcctactaccaacccaagcaatcactgatctactttctagctctatgaatatgcctattgtgcacattttatataaattgagtgatacaatatgtgatcttttgtgcctgccttcttttacttagcatatcattttcaaagttcatccatgttgtagcatgtatcaggacttctttcttatgatttaataatattccattatatggatatataccacattttgtttattcaatgttaatagttatttgagatgttttcttgttttggctgttgtgaataatgctgctatgaatattcatgtacaagttttttatggacattgctttattattcttgtgggtaaatatcttgaagtgaaatttctgggttatatgataactgtctgtttaacattttggcgcactgtcaaactattttccaaagagactgcaccattttatattccctccagcaatgtatgagggttctattttttctttgtctttattttattttatttttttaccaaatctccccttcattgtatgtacaaggattctaatttctgcacatccttgacaacacttcttaattgtctttctttttgattgcagccattccggtgagcgtgaagtggtgccttggcactcttgttgaaaattagttgaccataaatgttagagtttatttctggactctcaattctattccattgatttatacttctacccttataccagtgccacattgtcttgattactgcatctgtgtagtaagttttgcaatcaggaagtgtgagttctttaactttgttcttttctaagattgttttggctcttttagttccttgtatttccatacaaattttaggatcaacttgtcaatctctgcaaacaagaaaaaaaaaaggcagctgggattttgatagtcatcatattgaatctgtagatcaatttcgggagtatttcatattaacaatattaactcttccaacccataaacacaagatgtctttccttttcatttatttaatcattctttaatctgtctcatccaaagatgttttatagttttcagtgttcaaggcttgtacttcctttgttaattttatttctaagtattttaattttttgttattatagtaaattgaattgttttcttgatttcatgttttgattgtttgttgccagcatatagaaatacaactgataactgatcttgtgttctgtaagtttgctaagcttatttattagttctagtagatttttttgtggattaattaggattttctatatacaaaatcatggcatctgaatagtgttacttttacttctcttattccagtatggatgtctttttttcccttattcttgcctagttgaccaggctagaaccttcggtacaatgttgaatagaagtggtaagaatgcatgtccctgtcttgttatttatcttaaggggagtaatcagtctttcaccataaagtataatgttaactgtgggtttcttgtagatcatctttatcaggttgcggaagttctcttatattgctagtttgttgagtgtttttatcatgaaggagtattgattttgtcaaatgatttttctgtgtcaattgagatgatcatgttattttttccatatatatatatatataaacatatatatataaacatatatatatatacacacacacacatatatataaacattgatggattgttatatgttgaatcacttttgctttcccagaataaatcccacttggccttttgggatcctttttatgtgttcttaagttcagtttgctagcatgttgttgaggatttttatgcttatatttgtaagatatattgatatatagtttttttgtgatgtcttcgtctactttgggtgtctaggtttcttagaataagttggatagcgtttcctcctttcctattttttgaagagtttatgaagaattggtggtaattattctctaaatgtttggtagaatttgccagtgaagccatctgctcttagagtttgctttgtggaaagttttttcattactaagtcaatctctttatttattataggtctatttcacttttcccattttagtttcagtagtttgtggttttttttagaaactcgtccattttatctagattatctaatttgttggcatataatttttcatcataatcacttataatcttttttacttctataaggttgatagttctctatttcctggctataataatttgagtcccccttctcacactcttgctcttgcacactctcacttttgcactcttgatctctcactcgcactatctcgttcttgctctttttttttggaaaatttttttagttaggctacctaaaaatatttctatgttttttatcctttttgtcttttttaatcttttcaaagaaccaacttttgcttttgttgatttttctctatttctagtcttttttttaattatattttaagttttagggtacgtgtgcacaatgtgcaggttagttacataggtatacatgtgccatgctggtgtgctgcacccattaactcatcatttagcattaggtatatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcagttagaattatttctagtctttatcactttctgctcgcacaaagctggaagattagctggagataagagcttaggtcttttctgttctttcctaagaatacatacaactgtgagtatacataaagccatatgcatgtagttggccttctgggttcccaggaatatgtcacagtttttcaaagcccccacttttcttttaacactttgttagcgtattgtttggcccaactgctatccactgccttggatagccacatgttcaacaactgcctctgattgttttcaacaaacaccacaggggaaaaggctgtttacaccagaggagctctgtgtcaagtcaaataaagacagtcttgtgagaggagtcttccagggaaccactagacaagtcaaataacaacaattatttgggaatggggctttgctggagttccaaccccaatctgttccattcagtagctactaggtactggtttccactgtaattgctagatgttggtttctttcttttttctctctctctctcttttttttttttttttttttttaatgatagagtctcactctgttgcccaggctggagtgcagtggcatgatcttggctcactgcaacctccacctcccaggttcaagcgattctcctgtctcagcctcacgagtagctgggattacaggtgtgcaccaccatgccctgctattttttctttattgtatttttagtagatactgggtttcaccatgtcggccaggctggttatgaactcctgacctcaagtgatccacccacctcggcctcccaaagtgctaggattacaggcatgagccaccgcacccggcctagatgttggtttttaaggctactgtgaaactggggaggggggtgggaatagggcaatttaaaatgccacagagcttactggttttactgagattcagccattttattaaataaatgctacctgaattgctgtaagctattggttaatttccagagttctaaagttgattccgatgacttttgtcagtgttcttgttgcttttatagaggagagcatttttagaagttcttactctgccatttttactacatcccctcctagtatggcttcttgcatgggaaaatgattcagtaaaaactaagcttgacatcaaacagtgtactagattaggcaagaaattggcatagttaatatacaaatctatatgaaaggtatgaaagtataaaaatgagcaatggacatgaaaggattaatcacagaagagaaaatacaggttgatgttaaagtctgaaaaagaaagttcaacctcaaagaaattaaaattaaaacaatgagctaccatttttcactatcaaatcaataaagatgattatagttattacgattcacaatattggcaaagatgcagtgaaataaacatttaaacactattggtcagaaatataaattggtattttctttcaggaatttaatttggcaataatatgaagtcttttaaaaataccatgtgaccaaacaatttcatttctaggtatgtgtcctgagaaaaaagtatagttggatgaaaatttatataaaaaagataaccattgcagcattatatgtaatagtaaaaaatttgaattaacctaaatgtccaacaatagtagaatggttaaataatttatattagatccaccttagatttttttagtcattaaaaatactgttttagaagaatatttagtggcattgaatattactatatagtgctaagcaaaaaaataaagatttagtacacagtgtgatacaaattttaggagaaaaaggaagaaaaaactgcagaaaaatatatcaacttgttaacagtttatttctgggtacataggatacaagaggttttattttctcattcatacttttccattctctccaaattctatccattaaggatttattactttataataagggatgtggcaatgtatataaaagtaatgatctgacatttgtatgcaagataggtaagaagcagcagcaagttagagtggtagtgggaatgggaaggaaaaagcaaatccgaaagacgttttataagaagaaactctaggatatgaaacagatgcagcagatagagggttttcagcataatcaaaactaggataggtaagaagaatcctacttgataggggaaagaagatattcagttttggacaaaattgaggatgattcatatctgagggctatttctttataggtagttggaaatacagatgaagttcgttttctttcgttttagtatgtctttgaaaattatgtaggcttttttcagattagtgataattaaggtttttcactcttcgaaattagagaggttttgcttattatgttctgtatttattatattactgcttcacttttcttgaatgttactttataaaataactgattatcaaatgttagcctgacttcaccttgttttgccttggactggctcagagttctcatgtttccactgttattacactattattactctcagttgttcttgttgctgtcaaaaactattatgtttgaagaagtataattattacttgagcaatatttgctttttaatactgttttctatgaattttaggcaatgaatattttgacttcagtgctgcttctatatgcaaaagaggaagaagctttttggcttctggttgctgtatgtgaacgaatgttgcctgattattttaatcgtcgaattattggtaaaagaaaaaccacacacacacatatgcatacacacacagagatgtatatttcctttctaaacaatttcagtgtctcttgtctaattactaataaagtagaaggactgatggattatgttgtggtataaaatgcaagcaatatcaaaatgtcacattcactgacattctcaaaagaagagctttttgtactgaatgtatagtcagaaagattgtttaatatgttgcttttaaaaataaaatacctggtctgtttcttaacaaaaatggaagcattaagtttataaactctatgttgctaaaacaatggtgatctcaagtatccacagctactggtgaatttttgtagttttttgatgggagggagatttcaatctgcttaaaatctccatatttgtatgaattatatagatatttgcaagatttcaaagaaggatcgagttcttagtttgttaattgtataatttttattttattttattttattttattgagacggagtcttgctctgtcgcccaggctggagtgcggcctcggcttactgcaagctccacctcctgggttcacgccattctcctgcctcagcctcccgagtagctgggactacaggcacccgccaccacgcctggctaattttttttttttttgtatttttagtagagacggggtttcaccgtgttagccaggatggtctcaatctcctgacctcgtgatccacccacctcggcctcccaaagtgctgggattacaggtgtgagccaccgcgcctggccaatattttctttaatcatcaaatatttacagatctgtgaccacttaccttaaaacttatgaatggtctctttgtaccgtaataggctttcaggattgtggttaggtcatcgattttactgtctttcattataattatttgtgtattttttttttttttttttttttaggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatgaatttgaattgtgtttctgaagtacatgacactactagcagttagatgtataaaatacagaagaggttctgaaagagttcataatttaaggaagaagaatgagatacatcagcatgctaatagaagtggggaggtatggaaacaagtccttttgaaaaatgtttatttttaaacttcttttgatattctgtaggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggtattgtaagaaccataacatttaaatctggaggagatttgagagatgatgttgttcaatcccctattttacagaggaaactgagccctagaaatttcagtttgtccgagattacaaaaccacttgaatgaaagagctacacctaaagtccagtcctctatctccagaaaaaatatagcaagaataaatcactttgaagtgaaccactaaattatgtacacatttacactaatattgttgattcagtatgctaggactttcatattcccagtttgagctataaagtgtctatgtagaattagttcaagcaggaaaagcatagttgataatgttaaatatccagtggccgggaagttattctggtttctatgtggtttcaggtgggttgaactttattttcctagtagcttctgtatgaatgctattttgtattggagcacatgtgttgtatgtgtgtgtatgtgtatatgcacacatttgtatatgctaaatgaataaatttgagtgggcaactatcataatgccacatgaaatcccattatgtacagaataaaatacaaacatcttactctggcattcagaactctgtggtaagggctcagtgtacctttcttcacttatttccccctatatgcttctacataccctatattccactcttactgagctgtgtggtatttgccaagtactctctgagcctgtttgcttccttcaaaaccccaaaatgattcctacactatcccatttccctcacccatgccctcctaatgctcaaccatcttcaaactccacttcttgaccgggtgcggtggctcatgcctgtaatcccagcactttcggaggccgaggcaggtggatcacctgaggtcaggagttcaagaccagcctggccaacatggcaaaacctcgtctcgactaaaaatacaaaaattagccaggcgtggtggtgaacacctgtaatcccagctacttgggaggccgaggcagaataattgtttgaaatcaggaggcggaggttgtagtgagccaagattgtgccattgcattccagcctggatgacagatcaagactccatctcaaaaacaaaaaacaagttccacttctttttttgttattattatactttaagttttagggtacatgtgcacaacgtgcaggtttgttacatatgtatacatgtgccatgttggtgtgctgcacccattaactcatcatttaacattaggtatatctcctaatgctatccctctcccctcccccaccccacaacagtccccagtgtgtgatgttccccttcctgtgtccatgtgttctcattgctcaattcccacctatgagtgagaacatgcgatgtttcattttttgtccttgcgatattttgctgagaatgatggtttccagtttcatccatgtccctacaaaggacatgaactcatcattttttatggctgcatagtattccatggtgtacatgtgccacattttcttaatccagtctatcgttgttggacatttggggtggttccaactctttgctattgtgaatagtgccgctataaacatatgtgtgcatgtgtctttatagcagcatgatttataatcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagtacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcacatgcctatgtcctgaatggtattgcctaggttttcttctagggtttttatggttttaggtctaacatgtaagtctgtaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgtttttgttactgtagccctgtagcctggtagtatagtttgaagtcaggtagcatgatgcctccagctttgttcttttgccttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacctatgagcatggaatgttcttctatttgtttgtatcctcttttatttccttgagcagtggtttgtagttctccttgaagaggtccttcacatcccttgtaagttggattcctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcatctgcaaacagcaacaaagttccacttcttcataagaccttcccttgtcctctcagttgaaagtaacctctaactaactagggagaaattatgtgtcatttctctgctttaataatggtagttccactaattcttgtattactatcacttttcaataggttctttgacaatgtcactaataaggatagtccattgccttcaaatgttcagcaaggttcaaatgtgagtgatgaaaaaaccagtcatactagagtggatattacagatttgattagagaatcaaatgaggtaagttttttcatgccataaatatattagctagcatatttaaaatgattgaactatggtctatctctaatggtatattaagtgtaagataataatgcaagtagacatacaacttaaaatccaacttaacttttaaaatgagttctgtgaactgttctaggttgtgtaacctcctctgcctcaatttgtttttcattaaatgaaattaaattcacttgctttcacaaataatgaccactttaaacatctatcactggattaaaaggtgaattattctcattattattattcacttcttagagattaagaattttacctatatttttgtacttagtctattcacatagtagatggaattctctccagtgaatatatttaaaaactgaaacgtgggaggtaaaaatttgcaaaatcattgaacaagtcaggaaattccctagaaatagaatcaaggcctccaagaattcagtctgataaaactgaattgtaaaagaaaaagtggatgtttattatgagtgagtagccactgaaatcatatctcttgcagaaatatggtaatattcgctatgaagatatacatagtatgcgctgtcgaaataggttgtatgtgatacagaccctagaggaaacaacaaaacagaatgtggtaagtatgcaaccaatgaggaaaaaccagttggagtaattttttttttctataactttctttagaaattatcttctgggcgaataaaatgaaaaggactaaacttttgagctagatccttgccaaggtttaccctatggtaaattcttttttagagaaaatacattattttcttctggttgaattatgttgctttctccaacatgttttgtactatttgaccttcaagaccactgagacagggtctcgttctgttgcccaggctggagtgcagtggcatgatcgcagctcactgtagcctctacctcatgggctcaagagatccttcttcctcagcctaccgaggagctgggactacatgcacacaccaccatgcctggctaatttttaaattttttttttagagatagggtctcagtatgtttcccaggctgtctcaaacccatgggctcaagagatcctccttgcctaggcctcccaaagggttaggattacaggcgtgagctaccacacctagcctgcagctcagtgttgaatgctatcatgttggcatttaagcataacatatttgtgatgtgctgcatcagtaagaacagccgatctacatagtagtcagtgctccaatgaatattattatccttggatacctaaagtaaatactatgttttaaatacttgtctttttaatatttggatggctccataagcaactgttaatattggttgcctttggtgaatcggattaatagattgctggtcagaaggaggagagttttactttgctgtttatattcttctgtactgtttgagcttttatcatgaccatgtgttgtttttgtaaacctacttgcttaaaggccaaggtcctcagagatacaaatctgggaagattaatgtttctgaagattccaggtttagatttcaattgaataattcagtgaggttactgtgacatagttagcatagggccccttgttttagtttttatatgttagcatttttaaaaatttactgaagtaatacatgctcactgtaaataatttaagcattacataaatgtaaaaagtagattccccaccccagaagtaaccatcttaaaataatttggcatatatcctttcagatcttttatctaggtgtctgcacacatgcatgtgtattggaaggatatagtttttgaaatgagatcataccagtcactttgctctgcaacttttttcattcagaaatagatcatggttattgaatatcagtaaatatagatctacctcactcttcctaatgcattgaatagtatgccataatatggatatgctataatttattcactgctgatgtacatttaatatgtctcccttttttgctcttacaaataatactttatgtaaacattcttgtatatctattctttgcaagatagatatctggaagtggaagctgggtaaaagggtatgcccatttaaaatttgacaggtccctgccaaattatgcttcaaaagattttgccaaattgtaatcccaccagcagcctgtaagaatgcccctttccccacattctcactaacaccagatatttaaaatcttgaatttgttggccaggcatggtggcacacactcgtagtcccagctactcaggaagctgcgacgggaggatcaccttgagcctgggagttccaggctacagtaagctataatcatgccactgcactccagcctgggcaacagagctagaccttgtctctaaaacaaacaaaacaaaacaaaatcttcaatttgtgccaatgtgatagatcaaatacttttaaggtttcaattcactgatcacatatgtttattagcctttttaatttcttctcttaattgcctattcatagcctttgcttatttttctatgagattgtcttaagtattgatttgtagaagctcttttgactattagtagtaccagttctttgtcagctatatttgtggcctaatattttcccctagtcttattatttctttcattatctttataatgtctttcagattatacaagttacaaattttcttgaagtctttctcttttttattacatgatatctgggtttcatatcaaacttagcaggctttccctatttaaaattatataaattataaaaatattttttcatattggcctatagtactggtattgcttttttaacatttagaactttaatatacctagagtatatttttttattatgtaatattatgtttttccaaccaaaatcactcattttctaaaaaccaattattaaatagtttatcctcacagtactctactttcttcatatgctaaattcttatatacatacatgggctttatttttggactctctttttttgttactacaacagtaccacactctttcaattaccatagtttgtctactttgaaatctggtaaggcttttattcattttaacagtctgtctttttaaatgttctttagtaagcattttaattttcatcatctaggtcttacacatttcttattgggtttattctacccctatatattttatggttttgctgctaatatgaatgagatcatttttcctttacattgcctaattctttattggctgtgtgtgtaaaagttattgatttgggtatgttgcttttctaagtggtcgcattattgactctcattaattgtactattttttttagttgacctcgaattttctgaatagacaagcatgtcatttccagtcttagaattttgacccttcctaacatttatacctcttttcttttttctgtgttattgcattaagtaggatcttcagagaattattgaataatagcagtagaagcaggcttctttgtcttattctttttgttttttttgagactgagtctcactgtcgcccaggctggagtgcagtggcacaatctctgctcactgtaacctccacctcctgggttcaagcaattctcctgcctcagcctcccgagtagctgggattacaggtgcctgtcaccatgcccagctaatttttgtatttttagtagagatgggatttcaccatgttgactaggctggtctcaaactcctgacctcaggtgatccacccgcctcagcctcccgaagtgctgggtttgcaggcatggccaccacacccagccgcaggtttgttatataggtaaattatgtgtcacagggtttcgtgtacagattatctcatcacacaggtaataatggtactcaataggtagttttttgatcttcaccctcctcccaccctccatactcatgtaggcccctgtttctattgtttccctctttgtgtccatgtgtactcaatgtttagctcccacttataagtgagaacatgcagtatttggttttcttttcctctgttagttcacttaggataacggtctccagctccatccatgttgctccaaagaacataatattattcttttttatggctgcataatattccatggtgtatattgaccacattttctttatccagtctactgttgatgggcatctaagttgattccatgtctttgctattgcaaataatgctgtgacatacatacacatacatgtgtctttatggtagaataatttatattcctttaggtatatgcccagtaatgggatttctgagttgaatggtagttctctgttaagttctttgtgatatcttcaaactgctttccacagtggctgacttaatttacatttccaccagcagtgtattagcattccctttactccacaacctcaccagcatcttgttattttttgactttttaataatcatcattctgattgtgtgagacggtatctcattgtgattttgatttgcatttctctaatatttagtgatgttgatcatgtgcttgttggctgcatgtaggtcttcttttgaaaagtgtctgtccatgtcctttgcccacttttttatggagttgtttgatttttgggttttgttttttgtttttgttttgagacagagtcttgctgtgtcacccaggctggagtgcagtggtgcgatcttggctcactgcaagctccgcctcccaggttcacgccattctcctgcctcagcctcctgaatagctggaactacaggcatccgccaccatgcccagctaattttttgtatttttagtagagacggggtttcaccacattagccaggatggtctcaatctcctgaccttgtgatccacccgcctcagcctcccaaagtgctgggattataggcatgagccaccacacctggcctggtttttaattttttaacttcctatggattctggatattagacctttgtcagatgcatagtttgcaaatattttttcccactctgtaggttgtctgtttactctgttgatagttttactgtgcaaatgctccttagtttaattagtcccatttgtcaaattttatttttgttgcaattgcttttggcatttttgttgtgaaatctttgccaccgcctatatctagaatggtactccctaggttttcttcaaggctttttatagttgtaggttttacatttaagtctttaatccatcttgagttgatttttgtatatggtggaaggtagggatctagtttcaatcttctacctgtggttagccagttatcccagcaccatttattgaataggttgtcctttccccattgcttgttattgttgactttgttaaagatcagatggttataggtgtgcagctttatttctgggcactccattctgttccgttagactatgtgtgtttttgtacctgtaccatgctgttttggttactgtagccttgtagtatagtttgaaggtgaataacgtgatacctctagctttgttcattttgcttagtattgctttggctatttgggctcctttctggttccatatgaattttctagaatagttttttctaattctgtgaagaatgtcattggtagtttgataggaatagcactgaatctttaaattgctttggttggtatggcctttttaacaatattgattcttcctatccatgagaatggaatgtttttcatttgcttgtgtcacctctgatttctttgagaaatgttttgtaatccccattgtagagacctttcacctccatagttagctgtattcctaggtattttactctttttttggctattgtgagtaggattgagttcttgatttggctctcagcttggactttgttggtacatagaaatgctactgatttttgtattctgaaactttgccaaagttgtttactaaatctaggagcttttgggctgagactttggggttttctacatatagaatcatatcatctgcaaatagaaatagtttgacttcctctcttcctatttggatgccttttatttctttctcttgcctgattgttcgggctaggactgtctgtactatgttgaaccagagtggtgagagtgggcatccttgtcttctggttctcaaggggaatgcttccagcttttacccattcagtatgattttggttgtggatttgtcataaatggctcttattattttgagatacagttcttcaatgcctagtttgttgaggctttttaacacgaagtgatgttgaatcttactgaaagctttttctgcatctattgagacgatcgtgtggtttttgttttagttcgtttttgtgatgaattgcattaattgatttgtgtatgttgaaccaaccttgtatcccagggataaagcatacttgctcatggtgtgttagcattttgatgtgctgctagatttggtttgctagtagtttgttgaggatttttgcatctgttctcctcaaggatattggcctgaagttttctcttttttttgttgtgtctctgccagttattggtagcagaatgacactggcctaaaagaatgcgttaaggaggagtcatttctcctcaattttttgcaatagtttcagtaggaatggtaccagctcttctttatatgtctggtagaatttggctgtgaatccatctggtactgggctttttatgattggtgtgtgtgtgtgtgtgtgtgtgtgtgtgtgtgtgtgtgtgtgtgtttctgattcaattttagaacttgtttttggtctgttcagggtttcaatttcttcctggtccaatcttggcaagttgtgtgtttccaggaatttatcatttcttctaggttttctagtttgtgtacatagaggtgttcatagtagtctctgagggtattttttgtatttctgtggggtcagtggtaatgtctctttgtcatttctgattgtgtctatttgtatcgtctcttttttctttgttagtttagctagtggtctatcagtcttatttattcttttaaatagccaactcatggattcattgatcttttgtatgggttttcatgtcttgatttcattcagatcagctctgattttggtaatttcttgtcttctgctagctttgggattggtttgttcttgttttcctagttcctctaggtgtgatgttaggttgttaatttcagatctttctaacttttttatgtaagcatttatgctgtaaacttccttcttaacactgctttaactgtgtaccagagattctgatatgttgtatctttattctcattagttttaaatatttcttgatttattccttagtttcattgcttacccaaaagtcattcaggagcagattgtttaatttttatgtgattatatggttttgagcaatcttcttagtatttattttcatttttattatgctatggtccaaagagtatagttgttatgattttgggttttttgaatttgctgaggattgttttatgtctgattgtgtggttaattttagagtatgtgccatgtgcagacgagaagaatatgttctgttgttttggggggaaaagttctgtagatatctgttaggtccgtttggtcaagtgttgagttcaggtcccgaatatctttgttagttttctgccttgatgatatgactaatactgtcagtggggtgttgaagtcccccactattattgtgtagttatctaagtctctttataggcctctaagaacctgtttcatgaatctgagtgctcctgtgttgactgcatatatatttaagatagatgtcttcttgttgacttgaatcctttaccattatataattccttttttgttttgttttgttgttgttgttggcctaaagtctgttttgtctgaaatcagaatagcaagccctgcttttttctgttttccatttgcttggtagattcttcctcaaccttttactttgagcctttggatgtcattgcatgtgagataggtctcttgaagacatcattcagttgcatctcactatcttatccaacttgccactctgtgccttttaattagggcagtctagttacattctggttagcctgtttacattcaaggttaatattaatatgtgtagatttgatcctgatatcatgttgttagctgattattatgcaaaactgattgtgtagttgctttattgtgtcaatagtctatgtacttaagtgtgtttttgtagtggctgataatcgtctttcctttccatatttagcactcctttcaagatctcttgtaaggcagatctaatgaacatgaattcccttagcacttgcttgtctgagaaggatcttatttctcctttgcttatgaagcttagtttggctgaatacgaaattattggctggagtttcttttctttaagaatgctgaatataggccttcaatcttttttggcttgtagcatttctgctgaatagtacactgttaggctaatgggatttcctttttaggtgacctgctccttatctctagctgcctttaatattttttctttcatgttgaccttggagaatctgatgactgtgtggcttggggatggtaatcttatatagtatcttgcaggggttctctgcatttccagaatttaatgttgtcctgtctagcaaagttggggaaatgttcatttatttttgtctaagttaattcagagaaccagtcttcgagttctgagattccttcctcagcttggtctattctgttgttaatgcttgtgatagtattatgaaattcttgtagtaagtttttcagccctatcagatcagtttgattctttcttaaaatggtcattttgtctttcacctcttgtatccttttattgtattccttagattccttggattgggtttcaacattctcctgaatctcaatgatcttcatttctatgtagattctgaattatatgtctgtcatttcagccatttcagcctggctaagaaccactgctggggaactagtgcagttgtttggaggtaaggtgacactctggttttttgagttgccagagttcttgtgctggttctttctcatctgcgtgagctgatattcctttaatctctgaagttgttttcctttggatgggtttttttttgttttttttttttttttttttttttttgcttttatcttctttgatgcccttgggggtttgattgtggattcagttgactggctttgattttgaagatttcagatggccaaggctcacctgagctctcctgagatgagtgtgctacctctgcggggctggtaccagacccccagctttgttctctgggccctcggggctaggaacctgctctgccagagaggccaaggtgttcccagtccactggcctcaacactacaatggaggtgctagccaaaacacttagtcggggtggtggcggtggaatccatgcttgctcgtgcatgccagcatccgtggcagcgtggcagcatacacatgcattggctcaggctgggtgctcgtaggagcctttaccttagttttcacaggtggtgtatactggcagaatattttagtgttgtcttttgggctgcgatccagtaggtggcgcttaagagtgttagccagcagatagcttcttgctctgctgcatggctccagggtaatggtctgtgaatggggacagggagatggcccattcacctagtccacccctgggccttggaggaaccccttctgattactggcttcatgcccgcatttcttttgttgggtgctctggtccacagggctccctcaggtaggagccacagttggcaaacaggtcttatccttactgggtcggccctgtggagggaggcacacaccacccctctatcaagctgcgaacctgggtgtctcatctctcagtgatgcttgggcaccacctaagtcagaaagtcccgcccaactgggagctgcgggagtgagtagtgtcacctaatctgctgtccaagtgcatcctgagggtaccaggggttgcaactgccagcagagtttaggcagaagctggaccactggactggaagctctaacaggcattgcccacctggctaccagtggtggagcgtggtggggtcacctgccctgcctgttgggtgtttccagtgacaacaggatgttgcagccactggctaagttcaggcagaagcgggacatctgggctggaagctccagcaggtgttgctcgcctggctaccagtgacaggagcaggtggggtcgtccgccctgccgtgtaggtgtttcatgggacaacaggaggctgcagcctctggccgatttcaggcagaagcggtagtgctgggctggaagctggcaccaagccttgtctggtgaggagggtggaccaatcctactgctcccaggcaccatgactttggcctctattggggctgtggcgctggtgttggtctgttccaggatccgaggcttgtagaggtccccttggacttaagagttgcctctgcaaaccgtctgggtggctctctgcctcagtttagaggtgaggtgggaggatgagagtggcaagtagggggttagggcaggggaattctcccactcccagccttacacagatccccatggagagtgtgaattaccctctcccgtattggggagcttctcctgactccgcattgatgccagataggctgctgcccagcttccctcctctctgctctctgtgtccccttgctgctttgatggttcccagtgtggtttcttagatgattggcttttagggtcagtgttcactaaaccctttgtttcccctccataagagagcagcacccatgatctgcttctagtttgtcatattggcccctcccatgctgggcaccttttttttttttttttttttttttttgagacagtctcactctgtcgcccaggctggaatacagtggcatgatctcggctcactgcaacctctgcctcccgggttcaagtgattcttgtgcctcagtctcctgagtagctgcgattataggcatacgccaccacacctggctaatttttgtatttttagtagagacagggtttcaccaagttggccaggctggtcttgaactcctggcctcaagtgatctgcctgccttggcctcccaagtgctgggattacaggcatgagccaccattcctctgctgggcactttaaatgacttctgtatccatgcttaaattatccacttctcgatgatagtcatttgtgatttctttcatctcacttgccagaaatgtgtctatcttattgattttttcaataaaccaactcttaattttatttactgagtctaccgggtttttttaattttctgtatttcatcaattctagcttttttctttacctttgctttcaaatttcttagatatcataatgattgtatcattagtccttcttcttcatggaataggataaaagtacatattttctaagcttattacttcttggattatgttttttggcatagagagggaatgtacatctcccaatgcctttgaagtatttaatagcaacctcacatgatgactagatatgctgcttatgtggcaagagaggaatatatggaataggacttagaatactgttacttatatttatagacattaagtggctgttctttggcagtgatttctgagtatgaagagatgaatatcaaagtacatattagagtagaattgaactagtctactactactttttaaaaggaaaaatagataataactttataatataataacttataataactttttattattcatttaagaagttaaaacacaaatattttcttctagcagagagagactctaaggtaattcaaagagaatttctttactgcaatgttaaaatctgtgtactaaattgcttttaatctttttaaagttgcgtgttgtatcacaagatgtgaaattgagccttcaagaattggatgaactttatgtcatctttaaggtactgttgttcttctttaaatgaaaaataatgcttttttttagcagaattgtatcacagccattctaattatttttatctttattttagcagacatggtttttaaaatcttccaaaattactttttctaattagtaactttccttttttatttatttttaatagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattggtaagatgatttttttaagcaaaaaaaaaaggtgctcctagaaatacttagtactgcctattattgccaatttagtcagattatatcaccatgggttacagtgtgtttagctttagtaataaatggacccttttctgcatttgttgctaaatctaagtattttgatattattttccccaaccctttcagaaaagcaagctgttagatgtgagtgttttaagggttaacataaggaagataacgtcccaattttcccacactcagatgcatgggtactaccgaaggacttcccccaccccaccgacctccccgtaaaaattcaaccacatagcctagaagagtggtagataaatacccagcaaacatgttgtacctacagatagtcaagatgttgtacctgtagatattgttcatttgcttttccagataccccagcatgctttcttatcagggatcaccccttgaagaacagttctctcctgcacaggcctcattcaaaagaaaagagaaatctgagattggggggaaggagctaggaaagagaacattttacttttttgataaagagtattttgcttatacagttatacacttgaaggagagcatctgattgactaggtggttgtttaattgttagcttaagtaacaggtttctaaatcctaatttttgactaatgtctatatcttaattaatctttgttgctgaaattgattgaatgttctttagatacatgattatttacaattgaattttattgaacagacataatgtacaatggaagttttactgagaagcttaagctgctttttaagctacatattcctccaggtaagagtttaccagtctttaacgatgtacagcaggaatttattccattttagcaagtataattacagatttttttaacaactaaactaattttcaacatgatataagatcgttgcttcactgtggccctcaaattatattatgactactttttgctgatatagatacagtgatcttctatggaagagattctgtgtaacatatgggcccacaagtttccttcctgttagtagtcaatttaatgataagtagtttgtatataagaatcacatatcatttgattgttggtataatgttgaattgttgttgttgtcattagagtggaaattaactttagacaaactgccaaacctgcgaaatactacaaattattcagaaaaatgggacaaggaagcagggatattaaatattttaaaaaggaagcacaataaacgctatcatttattaagcacctgctctgtcaagacattaactttacatgcatttttaaaatttaattctcataatatccatgataggtggcattatccttccaattttgatgataaggaaactgagagctggaaagataaaaatttgccaaagatcacatcgctaataaattgcatagcaaactgaagtctgactccaaagctcacatttctttatattcttccgtactacctcaaaattaccacaccattcagtttacttgtttttcccactgacctgaagaggatgccttgccaaagcctgatccctactttgtgaaaacagtcttaggctttaaactgaaggagcattgcaaaaagtaccttttagccgagatggggtagttcacaaaaacaaacagcacctcataatttgtttaaagctacacctgggatcccttttcagcttttctcaggatagccgggaaacattctttaccacaccaacaaggtaaaggccatctttaacccttcacacactcaaatcacaaacacatcattaaaagcaaaagacaaatcacctaaaaatttaattataaaaggagtttccattgtcaaatcaggctactgttagaatgtttaatattgtcatcaactatgcttttaacagagggataaaaaaataggaaaaacattatgtacctgttaaagcacaagtaggaagtaaaccaaagcacccaactttctgttttccttattattgaggatgttttttaaatggctgaggtcacattttcagagatttctaaatgccagatttaaacaatttcaacttttaatagctcttggaaaaccattaaaaaaacaagtaggaaaaaaatagaactcaaaatgatcaactacttcttgtatttactatattttatatatattacatatattacagtataattactatatattacagtagagtagaaccacttctgtatttcttcacttacatctttcttatacagaaactctttaacacccagttcccagatatacctgacccattatgaacctcatctctgcccctggttgttaataaatgtaatttgggttatttatatgttttcagcttacactgaagtgaaatctaaggatgcttcaaaaggagatgaactttccaaggaagaattactttatttcagtcagctgcatggtaaatacctgtttaaaatgttaactgttttgatgattagccacccataaagatcttgctgacttagatatactttacccaactaaaattgggcttcattttaacttatacttcttttgtattaccacagcacttagcatggtccataaatgtttgaccggttaaccaaattgcattttggtgctttgatttgtggaatttcttgcttattggagactcaataatgtattttgtttctacttacgttgcagaaatttctaaaatgtattagaccattttcatgccttgataaaatacaatagaatctttgatgattaaaggccatagctatttttcaaacagtgaatacttattataaatcactgtaggtgtaggagacagggatgagtctgtctccaagacaaaatttaaagtgatatgagtttatttttgtgtcctttagtttattttcataaatattcaatgtcctatagagggatgaaccctgattaatgtatatttgtggttattatatgttaaagtgtttgaacattaagtttgaagggaccttacaaatcatctagtcaagtctcttccttttatagataaaggcactaaggcccagagagaagtgacttgtgcaaggtttcacagtgagttgttgccacagtcagggctttgtagcacactcttctgacgtccagtatgtgctttttttctcctgataataaaagtaatataactttatttaaagaaagtcacaaagaagaaaataccacccagaaataaatacttaatatttggtatgcttccttctaagattttttaaaatacggattttcccccaatgttctttttactgtgaaagttttggaatattttgtcttctgatgataggtcaagtcagctaaaatttgtttgcagaattgaataaaataatgtgcttatacgtctatatgaaacattattttgctttcaaagagtatttgttaaacatcttacagaatgcaattacatcttttcttatagtttccaagcctgcaaatgagaaggaagcagaatcagcaaaacacagccctgaaaaaggtactatgatctaggagttatcatttaatttatttagttatttttatgtaaataaggatagctacaaagggggaaaaggtggattccttttaaaggctattgatgtctcagaaattatagaaaatatgatagtaaatgacccatattcatttaattttattatttttaaaagatttgtttttaattacaaaagtaatagataattcttagaaaagaaattcagacagtacataagtccttttgtcttcactcaaccctacccgaaaacatttttgtctatatccttttcagatctattcctatgtatacacaatatatgcagacatctctcttttttaaaaaaatattccataagtactgttttataatttcctttttggattttgcagtatatcatggacatcttttaatgtcagtacatttgtatcttaaactctttgaatgaataagtagtgtttcaaatttttgaaaaagagctactaaagaccactttgttttgtttgttttgagatggagtcttgctctgtcgcccaggctggagtgcagtggcatgatctcagctcactgcaacctctgcctcctggattcaagccattctcctgcctcagcatcccgagtagctgggactacaggcgcccaccaccacacccggctaattttcatatttttagtagagacagggtttcaccatgttggccaggctgatctcgaactcctggcctcaggtgatctgcccacctcggcctcccaaagccctgggattacaggcgtgagccaccgtgcccagcccactttggaacaatatatgcatattaagaacataatatagaagctgttttaaacttaatagtatacatgagaatgactacataaaatttgcattattaagtcggggtgtattgttttaatctaaatatgtcctttctccctctctcgccacatattccctagttcccaactttcctaaagtaaacgttttagtctaaacagaaatgggaaaagtattctgagagccagtgggtgaaatgaaaggtaatttcagatcatttcctggattaaaaaaatgggatcttatatctcagtgaaataccttttaatcataattattatttttgaattttgggaaagtatagtgggctgttccttatgaaatggttttactccctttcttcaggcaaagggaaaattgatattcaagcatatctaagtcaatggcaagatgagcttttcaaaaaagaagaaaacattaaggatttaccaagaatgaatcaggtatagcatttttaaaaagaaaattctaagttcttgcttttttgtatggatgtgggtgtaacctctaaaatagctaacatgctattcccaaaatagttaaataatctatctattagctctctaagtttcagatgagcatggaagagtgggaagaaattttttaatgatttttttatttttaacactcaaatgtgtccagtgtttcagagaattcttctgctgtgacatgtacctatagaaaaaaagtatgtgtagtatatttccaactttattggaaatgttcatttattcagtaaacatttgtttactgtataccagataccaaacccaatgctaggtactgggaatgataaattactgagatgggtcacaccctggttcctactgatcttatatctgaacataattttaagttcatctctttcttatacactgcctaatcaaaatatgttcttctttttgtaattaaaatctggttagtacagatactgaggatcccgagaactttaccaaaatgaaaactatcaaataacttcatatttctcagtggactatatcatttgacaattgaataagtactttctaaaatgagtcagtatgacatatttattctagaattactataaatgaacagtactattgtttagggaaaaattctctcaaactgccttttttcctctactctcacaccatgacaataacaatcatcaacatagaagaaaatgtctgtggccaaatgtgtgggggttttccccccaaccaagcagcagataccagctgagtgtcctccaattaaattccaacactatctacctagaaatagtatgagatcccacaggttgagtgttcagtccccaagactgctccctcctttcccccagtaacaagtctgagcctcctgaacttctggctgaccaacttcaagttggggttcccactatcccttctttgagttcgattaatttgctacagagagacttacagaactcagagaaatagttatatttactggtttactaagaaggatattttaaagaatacaaataaacagccagaagaagagatacacagggcgaggtctggaagggtcccaagcgcaggagcttctctccacgtggagttggggtgcaccaccctcccggcatgaggatgagttcttctttaccttcctcctgtcagcctccatgcattcagctatcagaagctccctgaacccagttatcttgggtttttatggaagcttcatgatgtcagcattccttcccctaagggtatgaggtaagaccctttctagggagggttttaagaccgactatcagaaagctactctggaggatgaggcaggagaatcacttgaacctgggaggtggtggttgcagtgagccgagactgcaccattgcactccagcctgggcgagctgagatttaaccattgcactccaacctgggtgagctgagatttcaccactgcactcaagcctgggtgacaagagcgaaactctgtcaaaaagaaagaaggaaggggaggggagggggagggggaaggaaggggaaggggagggaaaggggagagaagggaagggaagaaaagactgtaacaaaggactatgggagttgtgaactaggaacccagaaaaatatttatatatatatatatatatatatatatatatatggaattcaggattaaacatcttaaacaattcttaaacaaaagcctatgattctaatgtcagtgacttttcattccatggaagcaggtcaaagtgcagcctaatttatgcataattttaactatatttctgtccagaattcttgttcaccctctgaggacagcttcaaagggactttgcctaattagaagtaccacctggccaggcgcagtggctcatgcctgtaatctgagtgctttgggaggccaaagtaggagaggagcacttgaggctaggagtttgagatcagcccaggcaacatagtaagatcctgtctctacaaaaaatgtgaaaattagccaggcatggtggcatgtgcctatagtcctagctacttgggaagctgaggtgtgaggatcacttgagcccagcagttggaagctgcagtgagctatgattgcaccatggtactcaagcctggacaacacagcaaggccttgtctaaggaaaaaaaaatagcacctaacatttaagtaatgctggcaggcaaacagtccaggaattagtctggataaaatgtactattaggcaataagtgagagcacttaaatgaaattttcttccatggttcatactcatctttttttttaagatggagtttctctcttgttgcccaggctggagtgcaatggcacgatctcggctcactgcaacctctgcctccatggttcaggcgattctcctgcctcagcctcccaagtagctgggattacaggtgcctgccaccacgcccagctaattttttgtatttttagtagaggtttcaccacgttggccaggctggtctcgaactcctgaccccagatgatccacccgcctcggcctcccaaagtgctgggattacaggcatgtgccaccgcgcctggcccatactcacctttctagaaccaatatgtattttggggttaatcaccagttcttataacttctagggtgaagcttctatggtacaaatcctatataggagactattcacttctaagttctctttatatttgctaagtctaatattcaaacgtgatattttcaacttgtgtcttctagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttggagggagttggtacagtcagcctttgggaagaatccactgtgaacaaagcttaacacatggggcttcatcgctcatagaatatgttattttcaaagaagttcaagaattttcaagttgagcctttgaaaatcccataaattggttttagctaaacacttactagtagtgtctttaaattatttaatcaaccttgtcttttcaaggaaattaccacttaaagagatagttggtaaataaacatctatgccttttctcagaaatgatttgctgaactatgtccatattttacagcttagataatagtttatatggaaactattatacatctgctattgtgcaatgattgttaaattatactgaagtagctctagaaagacacatgtatacaaggcactattgtacacactttgctgaatattttgtcagttgtatttacaaagaaaggtactttcttaagagcatatatgttattaatatttgatatgattttaaagtcagaatagtacagattgctgagtattatactttaggctagattaattaaaattgaatactgaaagagattttttgagttgcaaaaagtttataaatgcaaagcaaaaagaaaacatttattttctgagtctgcaggagaaacaaactaaacattatagttttatagctgctatcttgttaaccaaacaggttgttcataatattaaaaatcttacgtagttgtgttaaactgaaccagttcattataccttatgcattaaattaaatatgttataaggtggctttacttgtctttataaaaataaatatatctactaaacatg

SEQ ID NO: 3550 - DNA, 27378 bp, human
gggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggtcaaggctacagtgagccgtaatagggccactgcactccagcctgggcaacagagggagactctgtctcaaaaagaaaaaaaaaattaaaatagattttatagtcccgtgttacagcctcaggaatagtcttataatttattttcgttcctcatactaaaactgtgttcctttaagtaggtaaatcaaattcttgaaaatataatcactgtaatgtagtattgcatgttttttttaacttgttgcaagtttccttttttttttttttttttttttgtttgagacaggatctctcactctgtcacccaggctggagggcagtgatagtgatgtgattatagctcacagcagcctggaactcctgggctcaagtgatcttcccacctcagcctccggagtagctagggcttcaggtacaagccactaagcctggctaatttctttttttttttttaagagacaggctgtgttgcccaggcatgatcttgaacacctggccttaggatcctcccactttggtctcccaaaggactgggattgggattaaaggaatgagccacctcacccagcctgacatgctttcttcttaaagcatggaccaactgcactagtttacctctatcctgcccactccatttactagtccccatagtctagaataagagaaatttgtctgaagaaataaactaagatttctaccacatatatatgttgtgactagtgatatccacacttatttagtggtcagtttataactcttcatgattattttatctgtggtattgacaagatgcttgaaattaccacatgagagctaccactgtaattccatgtaaattaaacaaaatggataagaaagaaacaaagaggtgcttttaaggttcatttggttctttttggtccagagcataagtgtgtgctgattttcctagctgctcaattactgtattcttacttaaaatcatgaagccaaaagctttgttgtgctttaccacaaatccacatttggattagctctcacaggagcttgactgtgtgccagcataagtttgcctctgttcactttgtttgctaaaatccagtgttatgtgttatccctttaaaagattagtttatgcattttgtttaatgaagaaatgataatgatcatctagaaaccttagtggttatactttaagatttcatttctttgccatatgataattggtggtaatcaccagcaatgtaatgactcttaagtgtggacttgataaagttagttgactccatttttttctaataatggaatagcagcaacagagaactcaaggattattaaaacaagagatgagtttgtaagttagaattctgaggtacctcttttaaattgttgaaacacttctagtggatatctgatagattactgaccatttgcctaactttatcttaattgttctggctcacagcaggatggaatatcttgtggaaatttttggtatacataagcggttttatagataaagcgattttccttcatttagagaaataattcacccttctggattttacggtccccttatgttatctcttgcttctcctagctaataatgacttttctatgacacctacatttagcacctggttttaaagagttaaaactaatttatgcatatttgtcttattaagcacaaatcaatttgctttgcttggcagatgggaactactacacgaatggagctatggggctacattctactaagtactctagtatatgggatttaggaaggtctgccaatcaggaagccttcatataggtagtttttaaagagtattttagtcttgaattttccatatctgaatagtgtaagcaggttcttcagtgttagattgataagctccctcagtagaccttttttgtgtggtgtagaacaaagctacgaagtaaaacttattaaaatggagaatttttagacattctgtttctgatttcctttttcatcttggtaccattactttgaaattaaattgtctgtaaaaaccagaatatgataatatttgaaataagcttttcattttatgatatttatatagactgagcaaatcactgtgtaaacaatttgtcataaacccatacataataaacaataaggtaacctttttaaaacctcttagtgaccatcccttgaaaatataaagcttctttcccctatttcctcaccccagactcaaggagtccaactctgaaaatgtgcgccttagttattagcaaaatatccctgcatttcatgcttacaaaggacatatctgataaaaaaattttggccttctaagtacctgtctactgagatgagggtgcccaagtgccaagcatgacatttcatttaaggtaaggaaagatctacccgcccccccccatacacacacacacaaacacacacacacaaaattaataagttaacattttggcttattaaaaagaaaatcccatggggcaacccctagagagggcagatcacgctttgtgctcccatccctctctggaacatcttggtccctgtgaaatcaagttaaagattacttttaaagatctctgaatgagaaagagcaactttgtaggaggttttgagtaatgaaggatgatcagtgttaccctcacctttttttttttttttttttggaatagtggaaagattattgactgcatacctaagtagaaaactaatatttggtttcaagtagatttaattctaatgaaagaaaaaacaagactgaaaagtcatgacattgaccgtcctttatttctcaaaatctcctacaaggctgccctttcttattcaaagagatctttaaaggtaattttttacttgatttcagagaacgaaatgttccagggagggagaggaaaacagtgtgatttgccctccctaggtattgccctatgggattttaaaaaaataaaaaataaataaaccaggctgggcacagtggctcacgcctgtaatcccagtactttgggaggccaaggcgggcggatcatttgaggtcaggagtttgagactaccctggccaacacgttgaaaccccatctctactaaaaatacaaaaattagccggacttggtggcgggtgcctgtagtcccagctactgatgaggctaaggcaggagaatcacttgaacccaggaagtggaggctgcagtgaaccgagatcgcactgttgtactccagcctaggtgacacagggagactccatctcaaataataataataacaataataataataataaataaaccaactacaagccaacatccacaaatatatgaatataacaccaagttcagtgattccacttgccccattaaccctgtttcttttatcttccttgattttttgatagttttatgtctctattcagctataattattttataaaggcttagtttcctcatctgtaaaatggggataaaaacttgtctttcctacctcacagcattttttatgtgggtcaaatgagttttgaaacttgtgagcaactatacaaatacttgacatttatctattaatgaaagagaaagacgttaaaatgccattttctgggcctgaagaacaaaggggttatatatttatgccattttccctagtaattactttccccatgttgtatatagaaattgatttggagtggtaacatagattatatctgatatgcaatgatatcactacaaaaacaaaacactgatagttactaattgaagaatttgggcatgatagtgattatgcatttatggtttataatcagaataatgtacaagaattagaataacttatcatgacatcatttccttttgatctgtcatcgcccaaaacctggaagttctcaaacagtgcttccgtagatatcagcatcacttgtcttgctgagtggtgataaagagtacatataacattggttaccttagtagtatttttcaaaacaatacttaaaaaataattattcaactggtgaaaactcatgctgtttgtgaacagttgtggaaggcttatggctataaggtaagctaaaaataaaaaataaaaagcagtcaggcatggtggtgcacacctgtagtcccagctacttaggaggctggggcgggaggattgcttgagcccaggagttcgaggccagcctaggcaatatagtgagataaaaaatattttaaaaagtaaaaggcattataatgtttgccacattgctgtacagctatgacagattttatattgcctttattttagaacatttgcccagttttccaccttttgctactgctatgtaagcacaaaaggtaagattaaatcctaaatgtgatggtatacaatgctttaattcaacagatatttaccgagtgccttttaaaaaacaagcactgttttaagtgctggagataaagcaatgaaaaaaaacaaagtccctactctcatggggctaataccgtagttgggggaggcaaataaacaaatagtatatgatatgactggtgctgataagcaatatgaagaaaaataaagtaaggtatcatgatagagaggggagggggttggtatattagagaaattggtctgggaaggcctcttaggatgagctgtggacagagacttgtggtactagaatatatgagccaaacaaatatttgggaacagagtgaatacatataattttttctagaagttttttctgtgaagggaaagagagaaatagggtggtagctggcccttgtcctgggtgttgagtatacagtggtgaataagacaggaatagttctggccaggcgcagtggctcacacctgtaatcccagtgctttgggaggccgaggcagatgtatcacctgaggtcaagagttcgagaccagcctggtcaacatggtgaaaccccatctctacaaaaaatacaaaaattagctgggcgtggtggcacacacctgtaatcccagctacttgggaggctgaggcaggagaatcactggaacccacgaggcggaggttgcagtgagccgagatcacgccaccgcactccagcctgggtaacaagagtgagactccgtctcaaaaaaaaaaaaaaaaaaaagacagaaatagttccaacccttacggagtttatcatgtgatggctcagacagttgataaataagtaagcaaaccaatacaattgctagtgtagtcaataataatagcagccttgttctgttggcttagaaatctccataatgcagggaaaccctcaaagcaattttccaaggccagctgtcttataaagtatgcttatctgaagtcctgttaaagatacaaatatttcctaaaagcagtgattaataataggtggtgtactggtggcaaagttccagtgtggcatctgtgaagcatcttgccaaaaaccagtttggggtgttttcaaattaaatcatccatctatgagcactaacaatatctgagaggtggtttggtagaagtggtgggaggaggggggacgttctaagtaggaggaataatgtgatagtgcaaaagcaaaagataacagttgttggggacacagcaaatattctagattcatttacgtggagttgaaaatatgagactcaatatataatgcacttagcgactagaaaaaggttattaaagagcaatgtcttaatctataccagaggaaaacctgagatagagaattaaagggacctaataattaaacctttgttttttgtgtccactgttctttcagtggacataaaacagcctatgtataacaaaaatttccacaagatattccatcctgctctgagccagaacaattaagtaagataaaattaggcaaatagtcagtaatctatcagatatccactagaagtgtttcaactcataagccaaataaattaacattttggcttattaaaaggaaaatcacgtagagcaacccctagagagggcagatcacactgtgtgctcccctccctccctggaacatcttggtccctgtgaaatcaagtaaaaaattacctttaaacatctctgaatgagaaagggcaaccttgtaggaggttttgaaaaatgaaggatgattagtgttacccccccacttttttggtagcagtggaaagattattaactgcatacctaagtagaaaactaatatttcctgtcaagtagatttcattctaatggaaaaagaagaaagaaaaaaagaaaaagaaaaaacaagactgaaaagtcatgacattggccatactttatttctcaaaatctcctataaggctgccctttcttatgcaaagagatctttaaaggtaattttttacttgatttcagagaataaaatgttccagggagggagaggaatacacattgtgatatgcccctttttccccctcccttactacactataaagaactgaagttttaaaacaaggtatagggctgggcacggtgacccatgcctgtaatctcagcactttgggaggccaaggcaggagaattgcttgagcccgggagttggagaccagcctcggccacacagtaagaccttgtgtctacaaaaaataaacaaaattagcaggacgtggtggtatgcgcctgtagtcccagctacacggaaggctggggtgggtgggagatcgtttgagccagggatgtggaggctccagtgagctgagattgcatcactacactccaggcagggtgacagagtgagaccttgtctcaaaataaataaataaaacaaggtgtaatcacattttctgattattattataatattagttgctctcttgttttaaactaaccaaaatgatgggcctggtttagttcttctaaataatgtttaaaagtactacactgtataccagtttattcatttgctatcatatttgctttcttctttgtacctagaaattcaggtgttgcaatttatttgcttttctgagggttactctttttgtgcattggtgtataggtcttgaagagtaagaagtggctgtaaatatagtaccaattctcatattttcctgtgtctctatctttagaaatgtttctgggtttgattaataattcatctattctttttttcccagaagacattgtaatctgttgtttgttatatcaattgcttccctaaaaaattctaaatcctttaatgaaaaaaagatttcagttagggaaggaaatgagtgcttatatatatatattcagttttcaagtaagtccctttaaaagaatgcagggagagagaaaacaggaccaaagaagaattatttttattaactgttttccgaagctcttaatataaagttggcagctttcaaaatgccaactgtggctattgaattattccaaaataagcattcatagtgtcattttaaggacttacatctggtagcaaagtaatagaatcaggaaaatccacaaactttattgagcacactaccttctcttatttgaatatatttcctgctaagtgtattggcagtttactaattagtttgtttattaacatataatgaaactaagttcagtaaagttgtacttgtttgactttgtaagcatgacaacttatgacaagataaagaatccactgtaagtttccagtaatcattaccgtggaaaaaattataattgaacattttacttagaatggaaataaatcttgtttgtaattaggaagttcattacatggctcttctgcagctagagcagtattcacttacacagtgccctcaatccagtttacaaacagaaagagcaacttgtcaaactaaaggacattttagtttgtgtactaaactagcacattgataatgagtatcattttcaagctgtggctgttttactggtctttcctctagcactcagcccattgccctacctgttcatcattaccattgacctaatacaaaaaaagaaatgtttatgaaatttgcaggtgtctaaatattggaaggggcaattaataccatagatcaatgtgctcaatattggccacaggttagattcaaatgaggaccttttatttttatttatttattcatttatttatttatttttgagatgagtctcactctgttgcccaggtgggggtgcagcggcgcaatctcagctcactccaagtgatgcaacctccgcctcccgagttcaagagactctcctacctcagccttctgagtagctgggattacaggcacctgccaccatgcccagctaatttttgtatttttaatagagacagggcttcaccatattggtcaggctggtctgaaactcctgacctcaggtgattcacccgcctcggcctcccaaagtgctgggattaaaggcgtgagtcaccaagcccagcctctgaggaccttttaaaataaactaaaagatactggatattcatggatgaaatgatacaatgtctagaatttactttaaaatactccaggagggagtatttagaacccagaaattggtacatattaatttctgaatgacttgcagggacttgatgatgattacagcttaatgagctggaagagttccccaagtgactagaaatgtagtctagcactagtttccaaattatttcttgcatagttttatactaactgcctgatttcacacttaacaaaactgagcaattttctttctacatagtacaaggcgcttataatcttgtgaacatttctgctgccaaaaagtgacctttcttgccagtgattttgactactcctctcacatccacatagccaccattaatctttcaacagtatcttcaaaaagatagttatcttttatctttatctgttatctgctaaagctatcctgtattcaataaagtgccttcatttgaaattctaattcctttattttgacaaatttgacaacttatgtttatttatatacacacacatttatgtacttaattctgtttttcaacatagtgatagctcttttggttgtcttttgcgactactcttttatccctttttttagtattttcacattcctatcttcaaattgaaaacattctcctcttctctatttcctcagtaatttttttttattattacactttaagttttagggtacatgtgcacaatgtgcaggttagttacatatgtatacatgtgccatgctggtctgctgcacccattaacgcgtcatttagcattaggtatatctcttaatgctatccctcccccctcccgccaccccacaacaggccccagagtgtgatgttccccttcgtatgttcatgtgttctcattgttcaattcccatctatgagtctgaacatgcggtgtttggttttttgtccttgcaatagtttactgagaatgatgatttccaattttatccatgtccctacaaaggacatgaactcatcattttttatggctgtatagtattccatggtgtatatgtgccacattttcttaatccagtctatcattgatggacatttggcttggttccaagtctttgctattgtgaatagtgccgcaataaacatacgtgtgcatgtgtctttatagcagcatgatttatagtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcgccattctaactggtgtgagatggcatctcatagtggttttgatttgcatttctctgatggccagtgatgatgagcattttttcatgtgttttttggctgcataaatgtcttcttttgagaagtgtctgttcatatcctttgcccactttttgatggggttgtttgtttttttcttctaaatttgtttgagttcattgtaaattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcccattcctatgtcctgaatggtaatgccaaggttttcttctagggtttttatggttttaggtctaatgtttaagtctttaatccaccttgaattaatttttgtataaggtgtaaggaagggatccagtttcagctttttacatatggctagccagttttcccagcaccatttattagatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccgtgtagtatagtttgaagtcaggtagtgtgatgcctccagcttttttcttttgccttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgatcttccatttgtttgtatcctcttttatttcattgagcagtggtttgtagttctccttgaagaggtccttcacatcccctgtaagttggattcctaactgttagaaccaaagacaaaaaccacatgattatctcaatagatgcagaaaaggcctttgacaaaattcaacaacgcttcatgctaaaacctctcaataaattaggtattgatgggtcgtatcttaaaataataagagctatctatgacaaacccacagccaatatcatactgaatgggcaaaaactggaagcattccctttgaaaactggcacaagacagggatgccctctctcaccagtcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctaagcccaaaatctccttaagctgataagcaactttagcagagtctcaggatacaaaatcaatgtacaaaaatcacaagcattcttatacaccaataacaaacagagagccaaatcatgagtgaactcccattcacaattgcttcaaagagaataaaatgctcagtaattttaatcacatagttctgaagacactatctgcatattttggctcctacttttctttctttttactttaccaaatctccaatttctcatagtcactatttcaatgctaaaagtgatagaattatttttccttttatccccaaacccatcagtaattccctcctcattagttgaaatataattattttctgtttccctcatcctcattcccattgtcttttccccaatactttctctttcataatatttgtcagttttctcatttctattttttaaaagcttcaattcatacttgaactttttttcatatcagataacttcttatctctataatctgcacatactgccattgccaaaatcttctttcttgaactttgccctatcaaaatcctcagaaaatttctaattgatgctatgctgcatttgtgactcctgtttttactttttatcaattcctgtatctactctcctatcctttcctttcagctaagccaaatttctctttatgtctttgtcttatctcctactcttctagtttacctccttctatgcatgtaacttcctaatgtgataggaagtgatgtgaggcaaatgtgagcatctgccaatctatctatattctcattcaaaccttgcttaaaatctcaattctttttaagtgggtcaaaataggaagagagccaaaagcctggtttataattgaattaaatttttcttaaaaatctgtattctaaattaaagggaaatgcctcataaagcaaaaccaacactcaaccaatcagagcttccagaaaaggaaggtaaatttatatatttcagccatcccattgatatggttaaatcaacaaactatatccttattgtgcagcaatatgttgaaagttatggatataaacacagagacagaagacatggttattgtcctcagaggacaaataatctagataaagagacaaaaattatatacatgaagctcttagaaagtagttataataaccagcctaatatatgctaggttgtgtagtacaggttaaacatcactaatctaaaaatgaaaaatctgaaatgttccaaaatccgaaacattgattgctgacatgatgccgcaaatggaaaatttccacacctgacctcatgtgacaggttgcagtcaaaactcatgcataaaattatttaaaatattgtataaaattatcttcgggctatatgtataaggtatatatgaaacaaataagtttcatgttcagacctgggtcccatccccaagatatctcagtatgtgtatgcacttaatccaaaacctgaaaaaatctgaaatctgaaacacttctggtcacaagcatttcatataagggatactcaacctgtatagactctaagtcctatgaatattcagagaaaatggaaagtattattgcttgggatagccagtgaggatttcataggggaagtgggtcttgaagaaaatgtagaattcagattagttggactggactagaagactttcattaggatttctttttttttcattagcatttctaggtaaaatgataattgcttagcaaagaccctatgggagaaattaactggttgtttaagaaaacagtgaactttgttctaggaaatagtaggaaatataattagattattaaactggaactaattgatcaagaaccttgaattcctaattgaggaattaagaattgttgaaaagaaaatccctgtacagaagcattttatttaatcaaggttttatcttgtttaaatatctaagattttcttaaataataatagtattaactaatatcgggtgttttactgtgtgctaagcattgctctaagtgcgttaaatgtaacaactcatttaatctttacaacagccctttgtagtaggatctgttttaaccttattttacaaatgaggatgcagaaagggtaagtactttaacttgctcaagttgacacaagcgacagagccagaatttaaacccagttagtctatagtactatattctacattcttatctaatatacatacaaccttatgaacgagatacataagtgctgcagatacattttgagatttggacaattgaagctgacttaactcttttattgaaagataattttctcagatactactcacattggcatactgtaatctctctttatcccaaatgtattttttctttaagaaaaatctctgtaaggactctatgggctagaaaagttttaaaataaatttattagtttgttatatgaagtgatacagatttgatttatctcttgtaaagtccttatttcaacaatctttctattacaacagggcttctggttgggactcttgattcagtcttggactctactgctaaagtagctccatttcgcatcctacaccagacaccagattctcaagtttacttgtcaattgcatgtggtgagtatgatttttaaaacataattcaaattaaataagggtactacaaagctgagtattcatatttatttatagtctgtagttgctttgagatttaaaaacaaattaaatgtgcaactttactttgagagaatagcaagacctctatttttaaaggatatgggttattaagttttttttttttttttaatccattggtgtgagggacctgaagcatgtggtctagcagggctgattctgcacagattttggtcagtgttactgctatataactcctttcttcaacttctgctttatccaactgctgggaagatgagaacttctccatgaaataaattgtttcattactaataactcaaatgagaagaatctgaagttatctgtgaacccaaaacataatgactcctaaggaagtataagcctggaaaattaaaccttttttattcattcccaccttctcagaaaaagcatcatatccttgaaatatgaaggaatgtcttacagttaatgttacatattcattcatgccagggtggttcagatgcttcaacatatatattatgggtagaaaaggaattaggataatcctttctaataaagcaagtcaaaataaatttttaaaaagctgcattgacagtttcttacttccttttatgatgccattataatgttggtctaaattagaatcccagatttctagcctttttgatattgaaaaactgcctttcttcttatccccctctcttctaaagtagatatattataattttttaaaaagaacaaaagcacatgagtttctggaacattcatatgtgtgaacatatagcatacaattaattttttaggttgtgtggcttgttttttatatttccgcctaaatttcttttagtgttgccagtgagtctttcctcctggccctcttaaagtgaatgtcacttaacctaaatgaggttgacattatacctgctgacatcacgagaattctgtaatctcaactctaaatctggttagtaaaaattattttttttaaaaaaaggcctttctacttaaataaagatgattgtataacttatttcccccaaattaacctgatgcagaaatagtgtagttacctactaatgaagcttccttataccaaaagaatcaaacttaaggccttaacatttcccccatggcttttatttgtggtccattaaagacagttattactcttgctatggtgacttagtagcatgaataaaattctgattgaattgtaggaaataggccatttgcaatgtcaacaaattttttaatatgccagtctccatatattataaaatatactaaaaagtcagcatatttcttttgaatatttatataatccatagtgctgagaagactttaatggtatgtgagtgataggaagagattgatagatactgaaatattcttcaagtcaaagcaactagggctaataatgtttaatctcaccctcagcaaacctcttaacactgattcagcgggtcacatggatttaaccttgctacagaatttctaacctcctgtatgaaatttctgtaagtttactaggtcttttgatgaatggggttgctctgagcaaaggttttgtggcttctgaaataagtagagtggccacagttaaaatctacatttacttagcatgcataggattgtcacatacatgctgttttcagccacacatattatagacacagcactaactgcattatttggagaccaaggattgaattacacattatgtattttctggtactctacatattttcttaaaagatactggttattctttaggcaccagttactagcatcttgttttcagaattttatatattttctcatgagctggatttactttactcccctttcattaaatgttttgttctttctatttatgagaagtactgttcatgcccacatagagggataaagtaggaataaatgtaaatattttactcctttatgaccatcattttttaaagtgaaaatgttatttctttttaaactatgcttttaaataacaagagcagttttattgtggagttttccttaagtgttttattttcttgtgttattaatcaggagccaacagagaagaaataaccaagcattgggattggttggaacaaaatattatgaagaccttatctgtatttgattcaaatgaagatattactaattttgtacaaggaaaaataagagtaagtggcacggatatatcttgtagatggagtgccaaaacctttgactctcatgtatgaggatcaaagtttgcatggaaggtcattgtttcactggcacctttcaggattggtagaaacgaacatatgaatttcagaatcagtgtgctaaagaaaactgtaaagtctttagcacagggggagattgatagatattgaaatattctcttaaaacatactggttattctttaggtaccaattactgacatattgttttcagaattttatatattttctcatgagctggatttacttttttcccctttcattaaatgtttgtctttggtgcccttgtgaatgcttttaggggcatttttgtttcaatatctcttgagttttgagttgaataaaccatttgttcattcaaaaaaatatatttagcacttgtatttgtagtagttccttatgaggcattcagaaaaaaacctaagcacaaaactgaagaaaatttgcttacctctgtcctaagagaattatctatgtacacacatatgatatatgtacctgtatagatatatacagtcgtccctaggtatctatggggattggttctggccgccgctgtagataccaaaattcacagatgctcaagtctcctaatataaaatggcatagtatttgcatataacctatgcacatctgcctatatacctaaagtcatctctagactattcattcctaatacaatgcctatgcatcacttcatttgagtggactctgcatagtcttcggtgcatggcaaattcaagttttgctttttggaactttgtagaatttttttcccaaatattttcaatccctggttggttgaatccatggatgaggaacccatggatatggagggctgactgtacaattgtattcaatcaactgtttgaatgtatgaaatatatttttgttggtaggtgatgaattttcagaaaatattttgtctcctttagggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaagtaagtggtttctattgcttactatggccttgaatttgctgtctgacctaccaactctaatgatgttaggttgtaaataaaataataggattgatattaaaggtaattaaactgtacaataaaaagtttatttcatctagggaaagaactcttttaagactggttgcttaacataaaaccattagaagtgtatatagaatgccttgcatatcgtgggaagtgagtcagtattaaatgatgatctggcatatgactgctttcaattccttgttatgaactacctacatgctttagtctgtgttttaatctattttaaacatacaatttgaatatagtggccatagtacctaatggcccacatctcactttgtagctacaaagaagaatcaaacagtgctatttatagcatacaaacagcttttacattggtagttatataattatgtaattatataaagagatagatttaaatatcaaatcagaatcattttttttaaaaattatctaaaattaaattgggcacagtggctcacgcctataatcctagcactttgggaggccaaggcaggaggatcacttgagcccaggagttcaagacgaacctgagcaatatagtgagactctgtctctacaaaaaaaaaaaaaaaaattacattagctgggcatggtggcacatgcctgtagtcccagctacttggggggactacttgggatgtgagaatcacttgaacccgggaggtcaaggctgtaatgagccatgatcatgtcacctcactccagtctgagcaacagagtgagactctatctcaaaagaaattatttaaaattagatctcttcctggaatcaccaattcttgcacgttcatgttgatgcttcaaatttttaactaatcttgaactctaaactattttagctgtttatagtatttttcaagggattaactattgtttcagaagaactgattaataaacataaatcactatgaaaatttaatcatacctgcttatacctcttatttgcagtaaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaaggtattcaaagcttaatttttagttttcaaagtattgtttgaccataagaatgaagatagtattgcttaccattaaaagttaactcttctatattatatgatagggttttttttggagttgattgtgggtgtgtgtgtgttttgtgagtttattcatatgcattacataaatagtacccttctctccaggaaatttaattgtaagaaataatagaagttagatttgaaaattatttcttgagattcagataggacttgccctggaatgcttttagaaatgcagagatttttatgtgtggttagtctaactctaaatttctctatgaatagtctagacagtttgggtctgaaattgttaaacatattgtttattttttaaaataacttacagaaaacattttttaatgaagaggcaagttcgtggagtcagtggagcatggactttagaatgaaagtagaacaacccttagacaagtcatatctctcaggacctcagtttcctcatctgtcatttctacctcagagggcacttatgaggaatgggcatgatatgtgtgaaagcactttgtaaaatataaaatatgaggcaaatattaatcattattagtgcctccttcagaagtatgtgtctgatagctgtttgccattatatttggtttgttgaaactgaccagatatcttttatcctgctgaacattctgaacagttgactaaaatgagcatgccaaaggggaaaaggagaggagatgatccagaaatagctagtgaaagcagcttctggcaaggaggatgtcagtatagactatatgggaaagtataagaggaacctaagccaaagtcctatggatagaccagaacaagtgacctagaaggttgtatgatcactacatagccctcattgggtacagttgttcctcttacctgttcctaaactattcctaaaattgatatacatgaggatttgtttgtgagcctccctgcttttatggaaattagatcagcaaggtaaattttttatacttcagtaccaaaactaggtctcagtatgcatgatttataaatagaattctataaggattaagaatcctgtttgtattatattataggtgggcgtttgtttttgtatttcatttctttattggcaaccataaacaaactgttttgccattttatttcccttaaaatacagtctaaaaggctatcaatgagttattcatcaccaaatcggtatttaattaagatataataaatccatttttgtctgtgtgcatttttaggagagcccattgaaaatcgtacatatctacatctttttttctagtaagttaaaaagaacagtaatttattgggacttagtctccaaatggcttttttataaaatggaatatctttattgctctgcttattgtttttacaaatatgtattacttttatagtttaaacaatacagaagcacagtaatgatagttaagtttagcgtatatccttctaggctttttaatgcatgaatttataaatatttgcaaaaataggtctggacatcacacattgttctacaatctgctttttttctcttgtatcatggacaactttctattcacataaatggactttattttatttaaataatagtgaacccacaaaattgcaatttatttgttttattagctttcccagtttgaaaaaaataccatttaactgaggtaaaaattaacatggttgtgtttttctgttcatgtttatccgaagtattttgaaagacatgatgaactaccacatatttaaatagtatatgcaggaagaatgaatttagttttagctttgttggatttgagttagaacttgcattatttacttattatcccagatggcattgctgcttaatgcaattgtttcgtgtgcctagaaaaaattatactatttaaagcaattgctttttacacaaaggctacatttgtctatcagttaataagccctctgtatttattgacacctatcctgtgcccaacatagtacaagcagtattattttatcatacttctactttagattttttaaaacattcatttaaaattttacttcacttaatttttaatatcgtctttaatagactactctttccctctaaatttttatgccacaaattttcattattttattttacttgaactgggtaactcgcttgattttctggtaaccagataggaacattgttgtcttccaggattgattttaaccatagtcacatattatgcctatatgataatataatagtcttctaggaaatcaccccttagagatagtttgaagacctacatgatctctaacttttgtgcattttaatctactaataaaatgaaattggaagaaaagaacaaacaaaaggagtttgcaaggaatcagtgtatttttttctatttcagaatttgttgaaaaatatagcatttttagtgtttaatctgtgtgcacagtgtatgtagattagtcaatataggcatatgtataccttagaattcatttctaaaaattcatttgtgccttatcccattttttctttcctacagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtaatgtaaatttggttacatatcagtttttagtttgaaaatgttatccttcacagagtaaaatgtcctttaattctataaattattaaaacctcaagatgcaatatccttttagtaatttaaaataattattcttcagaataagagtacagccttctgagatattctcagttccatttagtaaagtctttttttattattatactttaagttttagggtacatgtgcacaatgtgcaggttagttacatatgtatacatgtgccatgttggtgtgctgcacccattaactcgtcacaacattaggtatatctcctaatgctatccctcccccctccccccaccccacaacaggccctggtgtgtgatgttccccttcctgtgtccatgtgttctcattgttcagttcccacctgtgagtgagaacatgcggtgtttggtttttttgtccttgcgatagtttgctgagaatgtcatacatttttgaatgatcaagctccattttgcattaacctaaatgcttatcttgtttttaaattttaaagttttaaaattttcactttcagtaagagctgtaagactttactaaatggtaaagttagactatcacttttgatgtactctgtcagaaaaaaataacattgacatcttttacgtaagtcagaaataaattgttggtatttgatactgaatttttacatttgtactgtcatttttaaaggatacatgttagacctttttcttgagaagtgaaataacttgcactgaggttaattgtatgattggtgcaactagtacccaaagtctatttcttaataagtcatactatagaccaaaacttttggccacaaaagagtaagccaaacacattttacttgaaggtgtcaacaataaaggaaaatttaattgacctctatgtttttcaccccctaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatattagagaggacagagaaatcaggaaagatccaaaattgacaccctaacatcacaattaaaagaactagaaaagcaagagcaaacactttcaaaagctagcagaaggcaagaaataactaaaatcagagcagaactgaaggaaatagagacacaaaaaacccttcaaaaaattaacgaatccacaagctggttttttgaaaggatcaacaaaattgatagaccactagcaagactaataaagaaaaaaagagagaagaatcaaatacacgcaataaaaaatgataaaggggatatcacgaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaacaacgaaaaagagcccaggaccagatggattcacagccgaattctaccagaggtacaaggaggaactggtaccattccttctgaaactattccaatcaatagaaaaagagggaatcctccctaacccattttatgaggccagcatcatcctgataccaaagccgggcagagacacaactaaaaaagagaattttggaccaatatccttgatgaacattgatgcaaaaatcctcaataaaatactggcaagccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaatcataagagctatctatgacaaacccacagccaatatcatactgaatgggcaaaaactggaagcattcccttttgaaaactggcacaagacagggatgccctctctcaccactcctattcaacatagtgttggaagttctggccagggcaattaggcaggagaaggaaataaagagtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatagaatacctaggaatccaacttacaagggatgtgaaggacctcttcaaggagaactacaaaccactactcaaggaaataaaagaggatacaaacaaatagaagaaaattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcgttaccattcagtacataggcatgggcaaggacttcatgtctaaaacaccaaaagcaatggcaacaaaagccaaaattgacaaatgggatctaattaaactaaagagcttctgcacagcaaaagaaacaaccatcagagtgaacaggcaacctacaaaatgggagaaatttttctcaacctacttatctgacaaagggctaatatccagaatctacaatgaactc

SEQ ID NO: 3551 - DNA, 71304 bp, human
ggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggtcaaggctacagtgagccgtaatagggccactgcactccagcctgggcaacagagggagactctgtctcaaaaagaaaaaaaaaattaaaatagattttatagtcccgtgttacagcctcaggaatagtcttataatttattttcgttcctcatactaaaactgtgttcctttaagtaggtaaatcaaattcttgaaaatataatcactgtaatgtagtattgcatgttttttttaacttgttgcaagtttccttttttttttttttttttttttgtttgagacaggatctctcactctgtcacccaggctggagggcagtgatagtgatgtgattatagctcacagcagcctggaactcctgggctcaagtgatcttcccacctcagcctccggagtagctagggcttcaggtacaagccactaagcctggctaatttctttttttttttttaagagacaggctgtgttgcccaggcatgatcttgaacacctggccttaggatcctcccactttggtctcccaaaggactgggattgggattaaaggaatgagccacctcacccagcctgacatgctttcttcttaaagcatggaccaactgcactagtttacctctatcctgcccactccatttactagtccccatagtctagaataagagaaatttgtctgaagaaataaactaagatttctaccacatatatatgttgtgactagtgatatccacacttatttagtggtcagtttataactcttcatgattattttatctgtggtattgacaagatgcttgaaattaccacatgagagctaccactgtaattccatgtaaattaaacaaaatggataagaaagaaacaaagaggtgcttttaaggttcatttggttctttttggtccagagcataagtgtgtgctgattttcctagctgctcaattactgtattcttacttaaaatcatgaagccaaaagctttgttgtgctttaccacaaatccacatttggattagctctcacaggagcttgactgtgtgccagcataagtttgcctctgttcactttgtttgctaaaatccagtgttatgtgttatccctttaaaagattagtttatgcattttgtttaatgaagaaatgataatgatcatctagaaaccttagtggttatactttaagatttcatttctttgccatatgataattggtggtaatcaccagcaatgtaatgactcttaagtgtggacttgataaagttagttgactccatttttttctaataatggaatagcagcaacagagaactcaaggattattaaaacaagagatgagtttgtaagttagaattctgaggtacctcttttaaattgttgaaacacttctagtggatatctgatagattactgaccatttgcctaactttatcttaattgttctggctcacagcaggatggaatatcttgtggaaatttttggtatacataagcggttttatagataaagcgattttccttcatttagagaaataattcacccttctggattttacggtccccttatgttatctcttgcttctcctagctaataatgacttttctatgacacctacatttagcacctggttttaaagagttaaaactaatttatgcatatttgtcttattaagcacaaatcaatttgctttgcttggcagatgggaactactacacgaatggagctatggggctacattctactaagtactctagtatatgggatttaggaaggtctgccaatcaggaagccttcatataggtagtttttaaagagtattttagtcttgaattttccatatctgaatagtgtaagcaggttcttcagtgttagattgataagctccctcagtagaccttttttgtgtggtgtagaacaaagctacgaagtaaaacttattaaaatggagaatttttagacattctgtttctgatttcctttttcatcttggtaccattactttgaaattaaattgtctgtaaaaaccagaatatgataatatttgaaataagcttttcattttatgatatttatatagactgagcaaatcactgtgtaaacaatttgtcataaacccatacataataaacaataaggtaacctttttaaaacctcttagtgaccatcccttgaaaatataaagcttctttcccctatttcctcaccccagactcaaggagtccaactctgaaaatgtgcgccttagttattagcaaaatatccctgcatttcatgcttacaaaggacatatctgataaaaaaattttggccttctaagtacctgtctactgagatgagggtgcccaagtgccaagcatgacatttcatttaaggtaaggaaagatctacccgcccccccccatacacacacacacaaacacacacacacaaaattaataagttaacattttggcttattaaaaagaaaatcccatggggcaacccctagagagggcagatcacgctttgtgctcccatccctctctggaacatcttggtccctgtgaaatcaagttaaagattacttttaaagatctctgaatgagaaagagcaactttgtaggaggttttgagtaatgaaggatgatcagtgttaccctcacctttttttttttttttttttggaatagtggaaagattattgactgcatacctaagtagaaaactaatatttggtttcaagtagatttaattctaatgaaagaaaaaacaagactgaaaagtcatgacattgaccgtcctttatttctcaaaatctcctacaaggctgccctttcttattcaaagagatctttaaaggtaattttttacttgatttcagagaacgaaatgttccagggagggagaggaaaacagtgtgatttgccctccctaggtattgccctatgggattttaaaaaaataaaaaataaataaaccaggctgggcacagtggctcacgcctgtaatcccagtactttgggaggccaaggcgggcggatcatttgaggtcaggagtttgagactaccctggccaacacgttgaaaccccatctctactaaaaatacaaaaattagccggacttggtggcgggtgcctgtagtcccagctactgatgaggctaaggcaggagaatcacttgaacccaggaagtggaggctgcagtgaaccgagatcgcactgttgtactccagcctaggtgacacagggagactccatctcaaataataataataacaataataataataataaataaaccaactacaagccaacatccacaaatatatgaatataacaccaagttcagtgattccacttgccccattaaccctgtttcttttatcttccttgattttttgatagttttatgtctctattcagctataattattttataaaggcttagtttcctcatctgtaaaatggggataaaaacttgtctttcctacctcacagcattttttatgtgggtcaaatgagttttgaaacttgtgagcaactatacaaatacttgacatttatctattaatgaaagagaaagacgttaaaatgccattttctgggcctgaagaacaaaggggttatatatttatgccattttccctagtaattactttccccatgttgtatatagaaattgatttggagtggtaacatagattatatctgatatgcaatgatatcactacaaaaacaaaacactgatagttactaattgaagaatttgggcatgatagtgattatgcatttatggtttataatcagaataatgtacaagaattagaataacttatcatgacatcatttccttttgatctgtcatcgcccaaaacctggaagttctcaaacagtgcttccgtagatatcagcatcacttgtcttgctgagtggtgataaagagtacatataacattggttaccttagtagtatttttcaaaacaatacttaaaaaataattattcaactggtgaaaactcatgctgtttgtgaacagttgtggaaggcttatggctataaggtaagctaaaaataaaaaataaaaagcagtcaggcatggtggtgcacacctgtagtcccagctacttaggaggctggggcgggaggattgcttgagcccaggagttcgaggccagcctaggcaatatagtgagataaaaaatattttaaaaagtaaaaggcattataatgtttgccacattgctgtacagctatgacagattttatattgcctttattttagaacatttgcccagttttccaccttttgctactgctatgtaagcacaaaaggtaagattaaatcctaaatgtgatggtatacaatgctttaattcaacagatatttaccgagtgccttttaaaaaacaagcactgttttaagtgctggagataaagcaatgaaaaaaaacaaagtccctactctcatggggctaataccgtagttgggggaggcaaataaacaaatagtatatgatatgactggtgctgataagcaatatgaagaaaaataaagtaaggtatcatgatagagaggggagggggttggtatattagagaaattggtctgggaaggcctcttaggatgagctgtggacagagacttgtggtactagaatatatgagccaaacaaatatttgggaacagagtgaatacatataattttttctagaagttttttctgtgaagggaaagagagaaatagggtggtagctggcccttgtcctgggtgttgagtatacagtggtgaataagacaggaatagttctggccaggcgcagtggctcacacctgtaatcccagtgctttgggaggccgaggcagatgtatcacctgaggtcaagagttcgagaccagcctggtcaacatggtgaaaccccatctctacaaaaaatacaaaaattagctgggcgtggtggcacacacctgtaatcccagctacttgggaggctgaggcaggagaatcactggaacccacgaggcggaggttgcagtgagccgagatcacgccaccgcactccagcctgggtaacaagagtgagactccgtctcaaaaaaaaaaaaaaaaaaaagacagaaatagttccaacccttacggagtttatcatgtgatggctcagacagttgataaataagtaagcaaaccaatacaattgctagtgtagtcaataataatagcagccttgttctgttggcttagaaatctccataatgcagggaaaccctcaaagcaattttccaaggccagctgtcttataaagtatgcttatctgaagtcctgttaaagatacaaatatttcctaaaagcagtgattaataataggtggtgtactggtggcaaagttccagtgtggcatctgtgaagcatcttgccaaaaaccagtttggggtgttttcaaattaaatcatccatctatgagcactaacaatatctgagaggtggtttggtagaagtggtgggaggaggggggacgttctaagtaggaggaataatgtgatagtgcaaaagcaaaagataacagttgttggggacacagcaaatattctagattcatttacgtggagttgaaaatatgagactcaatatataatgcacttagcgactagaaaaaggttattaaagagcaatgtcttaatctataccagaggaaaacctgagatagagaattaaagggacctaataattaaacctttgttttttgtgtccactgttctttcagtggacataaaacagcctatgtataacaaaaatttccacaagatattccatcctgctctgagccagaacaattaagtaagataaaattaggcaaatagtcagtaatctatcagatatccactagaagtgtttcaactcataagccaaataaattaacattttggcttattaaaaggaaaatcacgtagagcaacccctagagagggcagatcacactgtgtgctcccctccctccctggaacatcttggtccctgtgaaatcaagtaaaaaattacctttaaacatctctgaatgagaaagggcaaccttgtaggaggttttgaaaaatgaaggatgattagtgttacccccccacttttttggtagcagtggaaagattattaactgcatacctaagtagaaaactaatatttcctgtcaagtagatttcattctaatggaaaaagaagaaagaaaaaaagaaaaagaaaaaacaagactgaaaagtcatgacattggccatactttatttctcaaaatctcctataaggctgccctttcttatgcaaagagatctttaaaggtaattttttacttgatttcagagaataaaatgttccagggagggagaggaatacacattgtgatatgcccctttttccccctcccttactacactataaagaactgaagttttaaaacaaggtatagggctgggcacggtgacccatgcctgtaatctcagcactttgggaggccaaggcaggagaattgcttgagcccgggagttggagaccagcctcggccacacagtaagaccttgtgtctacaaaaaataaacaaaattagcaggacgtggtggtatgcgcctgtagtcccagctacacggaaggctggggtgggtgggagatcgtttgagccagggatgtggaggctccagtgagctgagattgcatcactacactccaggcagggtgacagagtgagaccttgtctcaaaataaataaataaaacaaggtgtaatcacattttctgattattattataatattagttgctctcttgttttaaactaaccaaaatgatgggcctggtttagttcttctaaataatgtttaaaagtactacactgtataccagtttattcatttgctatcatatttgctttcttctttgtacctagaaattcaggtgttgcaatttatttgcttttctgagggttactctttttgtgcattggtgtataggtcttgaagagtaagaagtggctgtaaatatagtaccaattctcatattttcctgtgtctctatctttagaaatgtttctgggtttgattaataattcatctattctttttttcccagaagacattgtaatctgttgtttgttatatcaattgcttccctaaaaaattctaaatcctttaatgaaaaaaagatttcagttagggaaggaaatgagtgcttatatatatatattcagttttcaagtaagtccctttaaaagaatgcagggagagagaaaacaggaccaaagaagaattatttttattaactgttttccgaagctcttaatataaagttggcagctttcaaaatgccaactgtggctattgaattattccaaaataagcattcatagtgtcattttaaggacttacatctggtagcaaagtaatagaatcaggaaaatccacaaactttattgagcacactaccttctcttatttgaatatatttcctgctaagtgtattggcagtttactaattagtttgtttattaacatataatgaaactaagttcagtaaagttgtacttgtttgactttgtaagcatgacaacttatgacaagataaagaatccactgtaagtttccagtaatcattaccgtggaaaaaattataattgaacattttacttagaatggaaataaatcttgtttgtaattaggaagttcattacatggctcttctgcagctagagcagtattcacttacacagtgccctcaatccagtttacaaacagaaagagcaacttgtcaaactaaaggacattttagtttgtgtactaaactagcacattgataatgagtatcattttcaagctgtggctgttttactggtctttcctctagcactcagcccattgccctacctgttcatcattaccattgacctaatacaaaaaaagaaatgtttatgaaatttgcaggtgtctaaatattggaaggggcaattaataccatagatcaatgtgctcaatattggccacaggttagattcaaatgaggaccttttatttttatttatttattcatttatttatttatttttgagatgagtctcactctgttgcccaggtgggggtgcagcggcgcaatctcagctcactccaagtgatgcaacctccgcctcccgagttcaagagactctcctacctcagccttctgagtagctgggattacaggcacctgccaccatgcccagctaatttttgtatttttaatagagacagggcttcaccatattggtcaggctggtctgaaactcctgacctcaggtgattcacccgcctcggcctcccaaagtgctgggattaaaggcgtgagtcaccaagcccagcctctgaggaccttttaaaataaactaaaagatactggatattcatggatgaaatgatacaatgtctagaatttactttaaaatactccaggagggagtatttagaacccagaaattggtacatattaatttctgaatgacttgcagggacttgatgatgattacagcttaatgagctggaagagttccccaagtgactagaaatgtagtctagcactagtttccaaattatttcttgcatagttttatactaactgcctgatttcacacttaacaaaactgagcaattttctttctacatagtacaaggcgcttataatcttgtgaacatttctgctgccaaaaagtgacctttcttgccagtgattttgactactcctctcacatccacatagccaccattaatctttcaacagtatcttcaaaaagatagttatcttttatctttatctgttatctgctaaagctatcctgtattcaataaagtgccttcatttgaaattctaattcctttattttgacaaatttgacaacttatgtttatttatatacacacacatttatgtacttaattctgtttttcaacatagtgatagctcttttggttgtcttttgcgactactcttttatccctttttttagtattttcacattcctatcttcaaattgaaaacattctcctcttctctatttcctcagtaatttttttttattattacactttaagttttagggtacatgtgcacaatgtgcaggttagttacatatgtatacatgtgccatgctggtctgctgcacccattaacgcgtcatttagcattaggtatatctcttaatgctatccctcccccctcccgccaccccacaacaggccccagagtgtgatgttccccttcgtatgttcatgtgttctcattgttcaattcccatctatgagtctgaacatgcggtgtttggttttttgtccttgcaatagtttactgagaatgatgatttccaattttatccatgtccctacaaaggacatgaactcatcattttttatggctgtatagtattccatggtgtatatgtgccacattttcttaatccagtctatcattgatggacatttggcttggttccaagtctttgctattgtgaatagtgccgcaataaacatacgtgtgcatgtgtctttatagcagcatgatttatagtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcgccattctaactggtgtgagatggcatctcatagtggttttgatttgcatttctctgatggccagtgatgatgagcattttttcatgtgttttttggctgcataaatgtcttcttttgagaagtgtctgttcatatcctttgcccactttttgatggggttgtttgtttttttcttctaaatttgtttgagttcattgtaaattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcccattcctatgtcctgaatggtaatgccaaggttttcttctagggtttttatggttttaggtctaatgtttaagtctttaatccaccttgaattaatttttgtataaggtgtaaggaagggatccagtttcagctttttacatatggctagccagttttcccagcaccatttattagatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccgtgtagtatagtttgaagtcaggtagtgtgatgcctccagcttttttcttttgccttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgatcttccatttgtttgtatcctcttttatttcattgagcagtggtttgtagttctccttgaagaggtccttcacatcccctgtaagttggattcctaactgttagaaccaaagacaaaaaccacatgattatctcaatagatgcagaaaaggcctttgacaaaattcaacaacgcttcatgctaaaacctctcaataaattaggtattgatgggtcgtatcttaaaataataagagctatctatgacaaacccacagccaatatcatactgaatgggcaaaaactggaagcattccctttgaaaactggcacaagacagggatgccctctctcaccagtcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctaagcccaaaatctccttaagctgataagcaactttagcagagtctcaggatacaaaatcaatgtacaaaaatcacaagcattcttatacaccaataacaaacagagagccaaatcatgagtgaactcccattcacaattgcttcaaagagaataaaatgctcagtaattttaatcacatagttctgaagacactatctgcatattttggctcctacttttctttctttttactttaccaaatctccaatttctcatagtcactatttcaatgctaaaagtgatagaattatttttccttttatccccaaacccatcagtaattccctcctcattagttgaaatataattattttctgtttccctcatcctcattcccattgtcttttccccaatactttctctttcataatatttgtcagttttctcatttctattttttaaaagcttcaattcatacttgaactttttttcatatcagataacttcttatctctataatctgcacatactgccattgccaaaatcttctttcttgaactttgccctatcaaaatcctcagaaaatttctaattgatgctatgctgcatttgtgactcctgtttttactttttatcaattcctgtatctactctcctatcctttcctttcagctaagccaaatttctctttatgtctttgtcttatctcctactcttctagtttacctccttctatgcatgtaacttcctaatgtgataggaagtgatgtgaggcaaatgtgagcatctgccaatctatctatattctcattcaaaccttgcttaaaatctcaattctttttaagtgggtcaaaataggaagagagccaaaagcctggtttataattgaattaaatttttcttaaaaatctgtattctaaattaaagggaaatgcctcataaagcaaaaccaacactcaaccaatcagagcttccagaaaaggaaggtaaatttatatatttcagccatcccattgatatggttaaatcaacaaactatatccttattgtgcagcaatatgttgaaagttatggatataaacacagagacagaagacatggttattgtcctcagaggacaaataatctagataaagagacaaaaattatatacatgaagctcttagaaagtagttataataaccagcctaatatatgctaggttgtgtagtacaggttaaacatcactaatctaaaaatgaaaaatctgaaatgttccaaaatccgaaacattgattgctgacatgatgccgcaaatggaaaatttccacacctgacctcatgtgacaggttgcagtcaaaactcatgcataaaattatttaaaatattgtataaaattatcttcgggctatatgtataaggtatatatgaaacaaataagtttcatgttcagacctgggtcccatccccaagatatctcagtatgtgtatgcacttaatccaaaacctgaaaaaatctgaaatctgaaacacttctggtcacaagcatttcatataagggatactcaacctgtatagactctaagtcctatgaatattcagagaaaatggaaagtattattgcttgggatagccagtgaggatttcataggggaagtgggtcttgaagaaaatgtagaattcagattagttggactggactagaagactttcattaggatttctttttttttcattagcatttctaggtaaaatgataattgcttagcaaagaccctatgggagaaattaactggttgtttaagaaaacagtgaactttgttctaggaaatagtaggaaatataattagattattaaactggaactaattgatcaagaaccttgaattcctaattgaggaattaagaattgttgaaaagaaaatccctgtacagaagcattttatttaatcaaggttttatcttgtttaaatatctaagattttcttaaataataatagtattaactaatatcgggtgttttactgtgtgctaagcattgctctaagtgcgttaaatgtaacaactcatttaatctttacaacagccctttgtagtaggatctgttttaaccttattttacaaatgaggatgcagaaagggtaagtactttaacttgctcaagttgacacaagcgacagagccagaatttaaacccagttagtctatagtactatattctacattcttatctaatatacatacaaccttatgaacgagatacataagtgctgcagatacattttgagatttggacaattgaagctgacttaactcttttattgaaagataattttctcagatactactcacattggcatactgtaatctctctttatcccaaatgtattttttctttaagaaaaatctctgtaaggactctatgggctagaaaagttttaaaataaatttattagtttgttatatgaagtgatacagatttgatttatctcttgtaaagtccttatttcaacaatctttctattacaacagggcttctggttgggactcttgattcagtcttggactctactgctaaagtagctccatttcgcatcctacaccagacaccagattctcaagtttacttgtcaattgcatgtggtgagtatgatttttaaaacataattcaaattaaataagggtactacaaagctgagtattcatatttatttatagtctgtagttgctttgagatttaaaaacaaattaaatgtgcaactttactttgagagaatagcaagacctctatttttaaaggatatgggttattaagttttttttttttttttaatccattggtgtgagggacctgaagcatgtggtctagcagggctgattctgcacagattttggtcagtgttactgctatataactcctttcttcaacttctgctttatccaactgctgggaagatgagaacttctccatgaaataaattgtttcattactaataactcaaatgagaagaatctgaagttatctgtgaacccaaaacataatgactcctaaggaagtataagcctggaaaattaaaccttttttattcattcccaccttctcagaaaaagcatcatatccttgaaatatgaaggaatgtcttacagttaatgttacatattcattcatgccagggtggttcagatgcttcaacatatatattatgggtagaaaaggaattaggataatcctttctaataaagcaagtcaaaataaatttttaaaaagctgcattgacagtttcttacttccttttatgatgccattataatgttggtctaaattagaatcccagatttctagcctttttgatattgaaaaactgcctttcttcttatccccctctcttctaaagtagatatattataattttttaaaaagaacaaaagcacatgagtttctggaacattcatatgtgtgaacatatagcatacaattaattttttaggttgtgtggcttgttttttatatttccgcctaaatttcttttagtgttgccagtgagtctttcctcctggccctcttaaagtgaatgtcacttaacctaaatgaggttgacattatacctgctgacatcacgagaattctgtaatctcaactctaaatctggttagtaaaaattattttttttaaaaaaaggcctttctacttaaataaagatgattgtataacttatttcccccaaattaacctgatgcagaaatagtgtagttacctactaatgaagcttccttataccaaaagaatcaaacttaaggccttaacatttcccccatggcttttatttgtggtccattaaagacagttattactcttgctatggtgacttagtagcatgaataaaattctgattgaattgtaggaaataggccatttgcaatgtcaacaaattttttaatatgccagtctccatatattataaaatatactaaaaagtcagcatatttcttttgaatatttatataatccatagtgctgagaagactttaatggtatgtgagtgataggaagagattgatagatactgaaatattcttcaagtcaaagcaactagggctaataatgtttaatctcaccctcagcaaacctcttaacactgattcagcgggtcacatggatttaaccttgctacagaatttctaacctcctgtatgaaatttctgtaagtttactaggtcttttgatgaatggggttgctctgagcaaaggttttgtggcttctgaaataagtagagtggccacagttaaaatctacatttacttagcatgcataggattgtcacatacatgctgttttcagccacacatattatagacacagcactaactgcattatttggagaccaaggattgaattacacattatgtattttctggtactctacatattttcttaaaagatactggttattctttaggcaccagttactagcatcttgttttcagaattttatatattttctcatgagctggatttactttactcccctttcattaaatgttttgttctttctatttatgagaagtactgttcatgcccacatagagggataaagtaggaataaatgtaaatattttactcctttatgaccatcattttttaaagtgaaaatgttatttctttttaaactatgcttttaaataacaagagcagttttattgtggagttttccttaagtgttttattttcttgtgttattaatcaggagccaacagagaagaaataaccaagcattgggattggttggaacaaaatattatgaagaccttatctgtatttgattcaaatgaagatattactaattttgtacaaggaaaaataagagtaagtggcacggatatatcttgtagatggagtgccaaaacctttgactctcatgtatgaggatcaaagtttgcatggaaggtcattgtttcactggcacctttcaggattggtagaaacgaacatatgaatttcagaatcagtgtgctaaagaaaactgtaaagtctttagcacagggggagattgatagatattgaaatattctcttaaaacatactggttattctttaggtaccaattactgacatattgttttcagaattttatatattttctcatgagctggatttacttttttcccctttcattaaatgtttgtctttggtgcccttgtgaatgcttttaggggcatttttgtttcaatatctcttgagttttgagttgaataaaccatttgttcattcaaaaaaatatatttagcacttgtatttgtagtagttccttatgaggcattcagaaaaaaacctaagcacaaaactgaagaaaatttgcttacctctgtcctaagagaattatctatgtacacacatatgatatatgtacctgtatagatatatacagtcgtccctaggtatctatggggattggttctggccgccgctgtagataccaaaattcacagatgctcaagtctcctaatataaaatggcatagtatttgcatataacctatgcacatctgcctatatacctaaagtcatctctagactattcattcctaatacaatgcctatgcatcacttcatttgagtggactctgcatagtcttcggtgcatggcaaattcaagttttgctttttggaactttgtagaatttttttcccaaatattttcaatccctggttggttgaatccatggatgaggaacccatggatatggagggctgactgtacaattgtattcaatcaactgtttgaatgtatgaaatatatttttgttggtaggtgatgaattttcagaaaatattttgtctcctttagggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaagtaagtggtttctattgcttactatggccttgaatttgctgtctgacctaccaactctaatgatgttaggttgtaaataaaataataggattgatattaaaggtaattaaactgtacaataaaaagtttatttcatctagggaaagaactcttttaagactggttgcttaacataaaaccattagaagtgtatatagaatgccttgcatatcgtgggaagtgagtcagtattaaatgatgatctggcatatgactgctttcaattccttgttatgaactacctacatgctttagtctgtgttttaatctattttaaacatacaatttgaatatagtggccatagtacctaatggcccacatctcactttgtagctacaaagaagaatcaaacagtgctatttatagcatacaaacagcttttacattggtagttatataattatgtaattatataaagagatagatttaaatatcaaatcagaatcattttttttaaaaattatctaaaattaaattgggcacagtggctcacgcctataatcctagcactttgggaggccaaggcaggaggatcacttgagcccaggagttcaagacgaacctgagcaatatagtgagactctgtctctacaaaaaaaaaaaaaaaaattacattagctgggcatggtggcacatgcctgtagtcccagctacttggggggactacttgggatgtgagaatcacttgaacccgggaggtcaaggctgtaatgagccatgatcatgtcacctcactccagtctgagcaacagagtgagactctatctcaaaagaaattatttaaaattagatctcttcctggaatcaccaattcttgcacgttcatgttgatgcttcaaatttttaactaatcttgaactctaaactattttagctgtttatagtatttttcaagggattaactattgtttcagaagaactgattaataaacataaatcactatgaaaatttaatcatacctgcttatacctcttatttgcagtaaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaaggtattcaaagcttaatttttagttttcaaagtattgtttgaccataagaatgaagatagtattgcttaccattaaaagttaactcttctatattatatgatagggttttttttggagttgattgtgggtgtgtgtgtgttttgtgagtttattcatatgcattacataaatagtacccttctctccaggaaatttaattgtaagaaataatagaagttagatttgaaaattatttcttgagattcagataggacttgccctggaatgcttttagaaatgcagagatttttatgtgtggttagtctaactctaaatttctctatgaatagtctagacagtttgggtctgaaattgttaaacatattgtttattttttaaaataacttacagaaaacattttttaatgaagaggcaagttcgtggagtcagtggagcatggactttagaatgaaagtagaacaacccttagacaagtcatatctctcaggacctcagtttcctcatctgtcatttctacctcagagggcacttatgaggaatgggcatgatatgtgtgaaagcactttgtaaaatataaaatatgaggcaaatattaatcattattagtgcctccttcagaagtatgtgtctgatagctgtttgccattatatttggtttgttgaaactgaccagatatcttttatcctgctgaacattctgaacagttgactaaaatgagcatgccaaaggggaaaaggagaggagatgatccagaaatagctagtgaaagcagcttctggcaaggaggatgtcagtatagactatatgggaaagtataagaggaacctaagccaaagtcctatggatagaccagaacaagtgacctagaaggttgtatgatcactacatagccctcattgggtacagttgttcctcttacctgttcctaaactattcctaaaattgatatacatgaggatttgtttgtgagcctccctgcttttatggaaattagatcagcaaggtaaattttttatacttcagtaccaaaactaggtctcagtatgcatgatttataaatagaattctataaggattaagaatcctgtttgtattatattataggtgggcgtttgtttttgtatttcatttctttattggcaaccataaacaaactgttttgccattttatttcccttaaaatacagtctaaaaggctatcaatgagttattcatcaccaaatcggtatttaattaagatataataaatccatttttgtctgtgtgcatttttaggagagcccattgaaaatcgtacatatctacatctttttttctagtaagttaaaaagaacagtaatttattgggacttagtctccaaatggcttttttataaaatggaatatctttattgctctgcttattgtttttacaaatatgtattacttttatagtttaaacaatacagaagcacagtaatgatagttaagtttagcgtatatccttctaggctttttaatgcatgaatttataaatatttgcaaaaataggtctggacatcacacattgttctacaatctgctttttttctcttgtatcatggacaactttctattcacataaatggactttattttatttaaataatagtgaacccacaaaattgcaatttatttgttttattagctttcccagtttgaaaaaaataccatttaactgaggtaaaaattaacatggttgtgtttttctgttcatgtttatccgaagtattttgaaagacatgatgaactaccacatatttaaatagtatatgcaggaagaatgaatttagttttagctttgttggatttgagttagaacttgcattatttacttattatcccagatggcattgctgcttaatgcaattgtttcgtgtgcctagaaaaaattatactatttaaagcaattgctttttacacaaaggctacatttgtctatcagttaataagccctctgtatttattgacacctatcctgtgcccaacatagtacaagcagtattattttatcatacttctactttagattttttaaaacattcatttaaaattttacttcacttaatttttaatatcgtctttaatagactactctttccctctaaatttttatgccacaaattttcattattttattttacttgaactgggtaactcgcttgattttctggtaaccagataggaacattgttgtcttccaggattgattttaaccatagtcacatattatgcctatatgataatataatagtcttctaggaaatcaccccttagagatagtttgaagacctacatgatctctaacttttgtgcattttaatctactaataaaatgaaattggaagaaaagaacaaacaaaaggagtttgcaaggaatcagtgtatttttttctatttcagaatttgttgaaaaatatagcatttttagtgtttaatctgtgtgcacagtgtatgtagattagtcaatataggcatatgtataccttagaattcatttctaaaaattcatttgtgccttatcccattttttctttcctacagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtaatgtaaatttggttacatatcagtttttagtttgaaaatgttatccttcacagagtaaaatgtcctttaattctataaattattaaaacctcaagatgcaatatccttttagtaatttaaaataattattcttcagaataagagtacagccttctgagatattctcagttccatttagtaaagtctttttttattattatactttaagttttagggtacatgtgcacaatgtgcaggttagttacatatgtatacatgtgccatgttggtgtgctgcacccattaactcgtcacaacattaggtatatctcctaatgctatccctcccccctccccccaccccacaacaggccctggtgtgtgatgttccccttcctgtgtccatgtgttctcattgttcagttcccacctgtgagtgagaacatgcggtgtttggtttttttgtccttgcgatagtttgctgagaatgtcatacatttttgaatgatcaagctccattttgcattaacctaaatgcttatcttgtttttaaattttaaagttttaaaattttcactttcagtaagagctgtaagactttactaaatggtaaagttagactatcacttttgatgtactctgtcagaaaaaaataacattgacatcttttacgtaagtcagaaataaattgttggtatttgatactgaatttttacatttgtactgtcatttttaaaggatacatgttagacctttttcttgagaagtgaaataacttgcactgaggttaattgtatgattggtgcaactagtacccaaagtctatttcttaataagtcatactatagaccaaaacttttggccacaaaagagtaagccaaacacattttacttgaaggtgtcaacaataaaggaaaatttaattgacctctatgtttttcaccccctaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatattagagaggacagagaaatcaggaaagatccaaaattgacaccctaacatcacaattaaaagaactagaaaagcaagagcaaacactttcaaaagctagcagaaggcaagaaataactaaaatcagagcagaactgaaggaaatagagacacaaaaaacccttcaaaaaattaacgaatccacaagctggttttttgaaaggatcaacaaaattgatagaccactagcaagactaataaagaaaaaaagagagaagaatcaaatacacgcaataaaaaatgataaaggggatatcacgaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaacaacgaaaaagagcccaggaccagatggattcacagccgaattctaccagaggtacaaggaggaactggtaccattccttctgaaactattccaatcaatagaaaaagagggaatcctccctaacccattttatgaggccagcatcatcctgataccaaagccgggcagagacacaactaaaaaagagaattttggaccaatatccttgatgaacattgatgcaaaaatcctcaataaaatactggcaagccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaatcataagagctatctatgacaaacccacagccaatatcatactgaatgggcaaaaactggaagcattcccttttgaaaactggcacaagacagggatgccctctctcaccactcctattcaacatagtgttggaagttctggccagggcaattaggcaggagaaggaaataaagagtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatagaatacctaggaatccaacttacaagggatgtgaaggacctcttcaaggagaactacaaaccactactcaaggaaataaaagaggatacaaacaaatagaagaaaattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcgttaccattcagtacataggcatgggcaaggacttcatgtctaaaacaccaaaagcaatggcaacaaaagccaaaattgacaaatgggatctaattaaactaaagagcttctgcacagcaaaagaaacaaccatcagagtgaacaggcaacctacaaaatgggagaaatttttctcaacctacttatctgacaaagggctaatatccagaatctacaatgaactcaaacaaatttataagaaaaaaacaaacaaccccatcaaaaagtgggcgagggatatgaacagacacttctcaaaagaagacatttatgcagccaaagaacacatgaaaaaatgctcaccatcactggccatcagagaaatgcaaatcaaaaccacaatgagataccatctcacaccagttagaatggcgatcattaaaaagtcaggaaacagcaggtgctggaggggatgtggagaaataggaacacttttacactgttggtgggactgtaaactagttcaaccattgtggaagtcagtgtggcgattcctcagggatctagaactagtcataccatttgacccagccatcccattactgggtatatacccaaaggactataaatcatgctgctataaagacacatgcacacatatgtttactgcggcattattcacaatagccaagacttggaaccaagccaaatgtccaacaatgatagactggactaagaaaatatggcacatatacaccatggaatactatgcagccttaaaaaatgatgagttcatgtcctttgtagggacatggatgaaattggaaaccatcattctcagtaaactatcgcaaggacaaaaaaccaaacaccgcatattctcactcataggtgggaattgaactatgagaacacatggacacaggaaggggaacatcacactctggcgactgtggtggggtggggggaggggggagggatagcattgggagatatacctaatgctagaggacgtgttagtgggtgcagcgcaccagcatggcacatgtatacatatgtaactaacctgcacattgtgcacatgtaccctaaaacttaaagtataataataataaataaataaataaataaataaataaataaaatattagagaggacaaggaggattttgatgtttaatatgtctctcatggaaatgcagacaggtcaaattcaaatgaattttcttttacaatgtccaggaaccccaagttttaatagattgatacaacttatcaaattatagctatttgtattttaattaaaattcaaagaaaaactaaatgtgtctttattggctatattattttatttgaattggagtatagagccttttactgctatctccagagtagagattgaaaataatatgctaagtcaattataatgcagtattgataaaactaattttccctttgataattaaaaagcacaatgaaaacatgtaattaaatttttttttccatctcaattccagacgcagaatttctacattggccatcaagggttttccttgccccaactttattatctctcattctcttttagtatgtacccaggatattccttagtttgatgtgggaatacaagtaaaatctgaccagccttagtagttttctctcccaatgctcccaaattcttacttatatcatgttttccttgttctgttctatttcacattcagtccacgtgttagcttcaaagctcaacatatctttctttttcctttaatttgcttttccaaaacctgaagagctgtaactgttccccttaaaactttcatgtgcttttagtagctgaatatgctcagttgtcaagaaaggattttgtttcaaaatgagtttaccatctttccaaatatgcatcagaattctacagttttctagtttctcactcgtttttagaggttttaataaatatatgtacaaaataccagctagtatactatctgcttggaaatatgtatttttaaattgccataatattctgttttcacttaagatttttatcttatcaatgatgaagaatattgacccattttagtatctgtatatatctagttttaataatagtacacgtaaaaacttagtaaagagaaagctttttaaacaagagctagttccatttgatttctaagtaacagaaattatagctatattcttttataactacacttttactaaaacgaagagaaaaattgcattctataattttaataaacctggtgacttttgtacaaacagcaagactttttattttaaatctccaagagtctaaatcaacaagtctaaatatgaatacaggaagtactttaggaaatctttcctgtgagaatgtcaaagacattatacaaagaacaagtcctaccagaagtaattgaaattatgcatgagtaccagttctatccaagtttttatatgggtatatatttaaatgttccacattttaataagttatactaaaatctgggcatataaagagatttagtaaaattctaataaactgcttggaaaaatacatgaatcttttactttcattgacacatataatcaagaactattactagataaggtaatttttcaaaactactcaatgaaagaaaaatgggccctcttaggttagttttaagcaaagtggcctaagaatggaaagcactactgaagatcccttgcctgatgcttttaaactacattatgaatgaattgtagaaactatggaatgtcaagaaaggtagtaattgagtttatgccttaaagtttttagatgggcaaataagtatcttctacatattatcacagaatatgtaaacataacttgtttcatatagttagtaagatagttactaactgtatgtaatatagttattatcttaataagatagtttcataaccaggactatcttactaagtttttaaatagaagtaatgggtttcctacatgataatgtagatcaaaattgtagtttaaccaacataactgattttttcttgccttgataagaataaggtgcttcctatgaccataatataaatttggaaaatgatttttagctgtgggggtagatttatttctaagttgggaaaccagaaactattaaaaatgaaattcacaccctttaaattgtggactatgaacaggatcctatttaagataagcttctgatatttgagaaaagcatttgtttatatttttttgttttaattattggttttacaggtcaactctggcccccaaaccaccatttattataccgagtttatgaagtattctaatttaaatatagtattttgtagaaatttacacataaagaaatgttaatctttgctttgtctttccttcacttttagagccatatgataattgtaaaatcaatgtcagataataaaaatgaaacagattaagaatacctgctatagagttaacaatctatgttgctttctagatgtgattggattttgctcaggcactaaaagtctgatgagtgccaagtttatttgtcgtaagtgtgaacacccaaataaatggagagaaatatagatatttatccaagtatatatataaaacaccatgggtaaaagtttccattcaaaagagccagagcaaaaatgttcaaaaactttaagtttagttccttgaataatctactttattacactcttcaaaatttcaaacattaaactaccatctttgaaggtaaatgttttttattttatttcttttgtcatttttttaaattttctaaccacctactgcctgttgatgaaggtgaaggttttaacgtgactttatgaatacttaagaggcaataatggatagaactgacatacttgtcatcactcttataaatttatgtttagggtttcattgcttaagaggttatttttttccctctgggatacttttcctgtagtttagaacaatagataaactgatgattcagtcatttaaattaaaggaatgtgctgtgcttgagatccagactacaaccatgaattttccaacctgtatttgcaaaaatgtaactcctcgttcaaacagctaaacttaatattaagttgtcaagtatgtgatttgtcaaaataagcatttaaaaaaaaaaagaagggaattgttgcaatttgagacctatactctctaatcattaatttttcctttattggcttcttctaccttaccctttcatttacacattgatttgaatactccttaactttccttgaatcctatctatactcatctgttctcacgctgctatgatgaaatacccaagactgggtaatttataaagaaaagaggtttaattgactcacagttctgcgtggctggggaggcctcaggaaacttacaatcatggtggaaggcacctcttcacagggtggcaggagagaaaatgagtgctgagcgaagggggaagccccttataaaaccatcagatctcatgagaactcactcactatcatgagaacagcatgggagaaactgcccatgattcaattatctccacctagtcctgcccttgacacgtggggattattacaattcaaggtgagatttgggtggtgacacagagccaaaccatatcattccacccctggcccctcccaaatctcatgtcatgtcctcatatttcaaaacacactcatgccctaccaacagccccctaaagtcttaattcattcccatattaacccaaagtctgggtccaaaggctcatctgagataaagcaagtcccatccacctataagcctgtaaaatcaaaagcaagttagttacttcctagagacaatgggggtacaggcattggataaatacactattccaaatgggagaaattggccaaaacaaaggggctacaggccccatacaagtctgaaatccagcggggcagccaaatcataaagccctgaaatggtctcctttgactccatgtctcatatctaggtcacactgatgtgagaggtgggctgccacagccttgggcagttccacccctgtagctttgcagggtacagcccccctcctggctgctttcacaggctagcattgaatgcctgcagcttttccaagtgcaaggtgcaagctgtcagtggatctaccattctggggtctgaaggatggtggccctcttctcatagctccactaggcaatgctccaatggggactctatgtgggggctccgaccccacattttccttccatactgctctagcagaggttcccccatgaggactccacccctgcagcaaacttctgcctggacatccaggcatttccatacatcctctgaaatctaggcagaggtttccaaacctcagttcttgacttctgtgcacctgtgacttctgtgcatctgtagcccaacaccatgtgtaagccactaaggcttggggcttgcaccctctgaagcaatggcccgaactgaaccttggcctcttttagccacagctggagctgaagcagctgggatgcaggggaccatgtcctgaggctgcatagagcaggggggccctgggccaggttcacgaaaccatttttccctcctaggcttccaggcctgtgatgggaggggctgacgtgaagatctctgacatgccctggagacatccaaatttggtgattaacattcggctcctgttgcttacacaaatctctgtggctggcttgaatttctccccagaaaatgagtttttcttttccgtcacatcatcagtctacagattttccaaactttttgctctgcttcctcttgaacactttgctgtttagaaatttcttccatcagatatcctaaatcatctctctcaagttcaaagttccacagatctctagggcaggagcaaaatgccaccagtcttttcactaaagctccatttcccaagaagttcctcatctccatctgagaccacctcaacctggacttcattatccatattactatcagcattttggtcaaagccattcaacaagtctatagaagtccattgtccatattactatcagcattttggtcaaagccattcaacaagtctataggaagttccagactttcccacatctttctgtcttcttctgagacctccaaactgttccaacctctgcctgttacccagttccaaagttgcttccacatttctgggtatctttacagcagcgccccactacctggtaccaatttactatattagtcctttcttacactggtatgaagaaatacccaagactgggtaataaagcaaagaggtttaattgactcacaattccacatggctgggaaggcctcaggaaacttactatcatggcagaaggcacctcttcacagggtggaaggagagagaatgagtactgagtgaagggggaagccccttataaaaccatcagatctcttgagaactcactcactatcatgagaacagcatgaggtaaaccgtccccatgattcagttatctccatctggtcccatgcttgacacatggggattattacaattcaagatgagatttgggtggggactcagagccaatcttaatgtccagccctgctagggcttgtactggcttcttggatttcaaactaaagtaccactggattggtccaccctaagctgctacttttcctctgcctcagtcatgggcattctttatcttacttaagctactaaggtttactaaagtttaagggatgaacttaagtgagtcttttcttcttttttttttttagcactcctagtaataacttgcaatagctggtgtagttataatccatagaagctgggtaactgatatgttttaagagtaaaactttggtgttcataaagttttatgtggaaatacaaaagactcagagtaactaaaacagtattgacaaggaaaaacaaagttggaagactcatgctttccaatttcaaaacttattatacagctatagtaaacaagacattgtgatactggcataaggggagacatgtagatcaatgtaatatagttgagactctagaaatacattcttacatttatggtcagttaattttcaacaagaaggccaagctaactcaatgggggaaagaactattttcaacaaatggtgctgaaacaatggacagcaacatactccccacccccaaaaagatgttgtactcttttcttaaaacatacacaaaaattaaattaaaatggatcaaagaccaaaatgtaagagctgaaactatgaaactctcagagaacacataggagttaatcttcatgatcttgaattaggcaattgtttatagatatgacaacaaaagcatgtgaccttaaagaaaaaataggtaaattggattacatcaaaattaaaaacttttgtgctacaaatgatatcatcaagaaagtgaaaagacaacccacagaatggaggaaatatttgccaattatatgtctggtaagggactgctgtctagaatgtatgaagaactcttacaactaaataataaaaggcaaacaacccaattttaaaaatggttaaaggatttgaatagacttttctccaaagaaaataaagaaatggccaataagcacattaaaagatttttcatatcattagtcaatagagaaatgcaaatcaaaagcataatgagataccatttcatacccactagggtggctataattaaaaagaaatataatactgttgaggagaatgtgaagaattgaaactctcatgtattgctgttgggaatgtaaaatggtacaaccctcccaccccatactttctgtcctctaataaccatcattccactctatacttttatgagctcaactttttacctccttcatatgagtgagaacatatggtatttatctttctgtgcctgacttatttcacttaacataatgttctccatgttcatccatgtcgctgcaaatgaaaatgtttcattcttttttgggctgaatagtattccattgtaaaaatttatcacattctctgtatccatccatctgttggtggacatttaggttgatttcatatcttggctattttgagtagtgctgcaagaaacataggggtataatttatatatttgtgcttatttaacattgcatgcctgtatcaacacatcctcataagcaattggtattttcaatgttttgggttttaataggtgtgtaatgttgttttaatttgcaattacccagtgacatctgatgttgaacctctttcatatgattatttgccatttatatcttccttggtgaggtatctatttagatcttttgcccactttttaatgggtcctttatttttttaaacatagttttaattctttgaatatatttataatagctactttatagtctttatttacaaaatccaacaagtgggccccctcaagacactttctattggttgcttttttaagttcttgtttctatttttaagcctgacttccttggatcaccccctgaatcagtataatttagtggttattcagtgatgggttagatttccttaaatgccttatgctaccaaatattctacctttttctcaaggatatctgtgtgaaggtatatgtcaaacttcaggcaattttcacatcagctttagcttttattccctgctttcaaagatagccagagttgagtgactggggctttcttctgtcccatttctttcctaggcatgttcacagccctgtacatgtattcattcttctagatccccaagaatatgttgcagcccttcaaagttccacatcatcatctggtttttcaggtcttccttttaaatctttagccaggctcttgtttgctctagctgaaatcatagccttggacagctgggttgttaccaaccaattgctattgttttctataataccctgggaacagagttttttcaccaagctgagctgtgaataaaatcaaatgataacaacaccctgggaatagagattttccagggagttgcaagtttggtcaaatattgtctatgccctagggatagggcttttaatgaaactccaaaagatccactggttgccatactgctggctttcatttctgagcttgggcaggtggatagagttaaaagacccacagactcttctggtcttactcaggcaggctcattagtttttctcgaataggtgcttttcagtttattgcatgcctttggttaattccagtgttctgaaatggtttattttgaatgttttgccactattttgttgcttttgttggggagtgtgttcacaggggttctgagcttgccattctagaagtcaggttgttgacatatctaattttgataggtatgtctctgagatattgctttaatatttgttatgtatacagattgtggcttataaataacagtaaacattagaacttttttttcttgtagaaacgtaagcatgcatctgggacaactacattctttctttttcagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatggtaggaaaacaaaatatttaaacctatgggctgaaacatttggtgaaaagtaaaaatcttaaaagcagactagaaggtatcacaactgaaaactcttcttttgggacttgaaaagttttccagcaggtactactgtgtaacttatttagttccactgtacacaaggactattatcaggaatgaagataaaagataaaagttggacattggggatttttacagatacataatagtcgtacatatttattgacattgggttttatttgcatggatttctaatccttacatagatgtgatttggggagaatgatggtttaaagctttgcctcccaagtataacacttttaccatttttatatgagtttagctaagaattaaaatagtaaattaagctgctatgctcacatgagtttaaaagattttcatgatgacaaggattcagtgtttcacccctgggtgaatactgattttggttttctatgttcttaatttctatagatgttgtttcaaggtaaagagagtgggaaagttattttgcagaagttaatttctcactaaatttagttgttttgatttttctgtcattacagttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtattacgtttattcattgtatttatttaatagacattaactatgcctttctaggagttatgccctaagctaaagcaaaagaattacaaagatggttaatacaaagtcttactcatcttgagttcggactagtcaaagaaagaaaggtaagtagttatctataccttacctatctatccacacatccagcatctgagcacattagtttattaggcaagatatgtatactgggggaatctttagtgtcaacagtcagttaagggggaaaaaagctcatgaaattggtattctgttggataaattagtagcttgacatagattctagtgtaaagctcttttctgtttgtgctcagaaatcacttaagcataaggctaaatatcaaggtaatgaaatccaattatttatgtatatatggaaatagcttcattatatccaccttctgttgtatgttaatgtaataatcttcacaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggtatgacttaactatgagcccaactgtgtgtatgttccaaataaaatcacatcaaatccaattccactaatttggaagtggcgattataaggaaagagatgggggtgagatagatagagcatagtattaatgtaagtaggatggtagtgggaatacttaggagaattgatatttcattatttttctttttcacttaacaaatgtttattgaacttctgctctataaaagatactctgctaggtacttaaggctatataaagatgtatcagataagggtcctcccttaaaagtatgtagaccaggagacattaaagcatattcattaagaaacaaaaatcaagtgagaaaaactgttagagaaatataaattcctgtcatgatttataacaaggagaaactatttttcatctggaggagtcagagaaggcttcgtggaaaaggtagcatttgcaagtcttaaaaattggtgaattttggacatatggaaatggaatgaaaagaacatgccaggtgatggaatccatgtaaccgaacataggtagaggtaaacgtaaagtatgtataggaccatgtttgtttagtttggtagaaacatagggtggatgaagtgaagtagttggagaaaaaaaatcaataaggtagattgggatagagctggagtttgaattttattttataggcagtggaggaatcattggaaaaaaattatttaggagcacacaatcaattaggataggctagactgctaacacaaacacagataatagatgaaacagtataattttatttcttgaaggaataaacaaaggagattgactcttcaggtcagtaggcagctctcctccatgagattattcaggaacttagactgtagactgacagcagactgtcattttcaaaacaaaccttcccgagtacattttcatcaccattagcactcacaggaacagggaaagagcatggagaaacaactgtgaaagattttatgggctaggcttgaaaggggcaaatatcacttcatgcacattctattggatgatcttagtcacgtggatacacctattcacaaggaagtctgtggagtatagcgtggctgagcagacatgagcagctactatggaagaagaggagattggaatgtcatggataggtagcactctgtgccatacgtttatttataatgggttgaatacctgtaattgttacatgtcaatactacctatccactgtaacttgtcaatagagattttttttttttgaaaaactgtttaagtgaatggaacatctaaatggcaaggatttttagcatattttaggatctctgaaaggtacaaaagaagcataatgcttcttttctcaaagagcttatactcacagaccctgtgatattgtctataagcagtagtttagagatagcttcaaaataggcagcacttaatattgacttctaaaagatgagagcaaagttagaaacatggagggcaggaggaaagttatttggggctaaagtatgagtgataccattcaggtgagaataagcccaccttgggagataagattggctaggttcacattggaataaaaaagtaaatttgtatggcacaagatcatgaagaatctttcaagcctgggaaaagaatttaaacttaatatggtagacagattttgttggttttgatcaaaaacccacgtgagacacatggctggctagcttgctctatctatctatctatctatctatctatctatctatctatctatctatctattctgtctctctaatcttttctatcatctgtctccatctatctatctaatgttgatatataattcacttaccacaaacgtcacccctttagtggtctctcatatattcacaaagttgtgcaaaccttcaccattatctaattccagaacattttcatcaccctaaaaagaagccccatatccattagcagttactccccatttctcctactaccaacccaagcaatcactgatctactttctagctctatgaatatgcctattgtgcacattttatataaattgagtgatacaatatgtgatcttttgtgcctgccttcttttacttagcatatcattttcaaagttcatccatgttgtagcatgtatcaggacttctttcttatgatttaataatattccattatatggatatataccacattttgtttattcaatgttaatagttatttgagatgttttcttgttttggctgttgtgaataatgctgctatgaatattcatgtacaagttttttatggacattgctttattattcttgtgggtaaatatcttgaagtgaaatttctgggttatatgataactgtctgtttaacattttggcgcactgtcaaactattttccaaagagactgcaccattttatattccctccagcaatgtatgagggttctattttttctttgtctttattttattttatttttttaccaaatctccccttcattgtatgtacaaggattctaatttctgcacatccttgacaacacttcttaattgtctttctttttgattgcagccattccggtgagcgtgaagtggtgccttggcactcttgttgaaaattagttgaccataaatgttagagtttatttctggactctcaattctattccattgatttatacttctacccttataccagtgccacattgtcttgattactgcatctgtgtagtaagttttgcaatcaggaagtgtgagttctttaactttgttcttttctaagattgttttggctcttttagttccttgtatttccatacaaattttaggatcaacttgtcaatctctgcaaacaagaaaaaaaaaaggcagctgggattttgatagtcatcatattgaatctgtagatcaatttcgggagtatttcatattaacaatattaactcttccaacccataaacacaagatgtctttccttttcatttatttaatcattctttaatctgtctcatccaaagatgttttatagttttcagtgttcaaggcttgtacttcctttgttaattttatttctaagtattttaattttttgttattatagtaaattgaattgttttcttgatttcatgttttgattgtttgttgccagcatatagaaatacaactgataactgatcttgtgttctgtaagtttgctaagcttatttattagttctagtagatttttttgtggattaattaggattttctatatacaaaatcatggcatctgaatagtgttacttttacttctcttattccagtatggatgtctttttttcccttattcttgcctagttgaccaggctagaaccttcggtacaatgttgaatagaagtggtaagaatgcatgtccctgtcttgttatttatcttaaggggagtaatcagtctttcaccataaagtataatgttaactgtgggtttcttgtagatcatctttatcaggttgcggaagttctcttatattgctagtttgttgagtgtttttatcatgaaggagtattgattttgtcaaatgatttttctgtgtcaattgagatgatcatgttattttttccatatatatatatatataaacatatatatataaacatatatatatatacacacacacacatatatataaacattgatggattgttatatgttgaatcacttttgctttcccagaataaatcccacttggccttttgggatcctttttatgtgttcttaagttcagtttgctagcatgttgttgaggatttttatgcttatatttgtaagatatattgatatatagtttttttgtgatgtcttcgtctactttgggtgtctaggtttcttagaataagttggatagcgtttcctcctttcctattttttgaagagtttatgaagaattggtggtaattattctctaaatgtttggtagaatttgccagtgaagccatctgctcttagagtttgctttgtggaaagttttttcattactaagtcaatctctttatttattataggtctatttcacttttcccattttagtttcagtagtttgtggttttttttagaaactcgtccattttatctagattatctaatttgttggcatataatttttcatcataatcacttataatcttttttacttctataaggttgatagttctctatttcctggctataataatttgagtcccccttctcacactcttgctcttgcacactctcacttttgcactcttgatctctcactcgcactatctcgttcttgctctttttttttggaaaatttttttagttaggctacctaaaaatatttctatgttttttatcctttttgtcttttttaatcttttcaaagaaccaacttttgcttttgttgatttttctctatttctagtcttttttttaattatattttaagttttagggtacgtgtgcacaatgtgcaggttagttacataggtatacatgtgccatgctggtgtgctgcacccattaactcatcatttagcattaggtatatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcagttagaattatttctagtctttatcactttctgctcgcacaaagctggaagattagctggagataagagcttaggtcttttctgttctttcctaagaatacatacaactgtgagtatacataaagccatatgcatgtagttggccttctgggttcccaggaatatgtcacagtttttcaaagcccccacttttcttttaacactttgttagcgtattgtttggcccaactgctatccactgccttggatagccacatgttcaacaactgcctctgattgttttcaacaaacaccacaggggaaaaggctgtttacaccagaggagctctgtgtcaagtcaaataaagacagtcttgtgagaggagtcttccagggaaccactagacaagtcaaataacaacaattatttgggaatggggctttgctggagttccaaccccaatctgttccattcagtagctactaggtactggtttccactgtaattgctagatgttggtttctttcttttttctctctctctctcttttttttttttttttttttttaatgatagagtctcactctgttgcccaggctggagtgcagtggcatgatcttggctcactgcaacctccacctcccaggttcaagcgattctcctgtctcagcctcacgagtagctgggattacaggtgtgcaccaccatgccctgctattttttctttattgtatttttagtagatactgggtttcaccatgtcggccaggctggttatgaactcctgacctcaagtgatccacccacctcggcctcccaaagtgctaggattacaggcatgagccaccgcacccggcctagatgttggtttttaaggctactgtgaaactggggaggggggtgggaatagggcaatttaaaatgccacagagcttactggttttactgagattcagccattttattaaataaatgctacctgaattgctgtaagctattggttaatttccagagttctaaagttgattccgatgacttttgtcagtgttcttgttgcttttatagaggagagcatttttagaagttcttactctgccatttttactacatcccctcctagtatggcttcttgcatgggaaaatgattcagtaaaaactaagcttgacatcaaacagtgtactagattaggcaagaaattggcatagttaatatacaaatctatatgaaaggtatgaaagtataaaaatgagcaatggacatgaaaggattaatcacagaagagaaaatacaggttgatgttaaagtctgaaaaagaaagttcaacctcaaagaaattaaaattaaaacaatgagctaccatttttcactatcaaatcaataaagatgattatagttattacgattcacaatattggcaaagatgcagtgaaataaacatttaaacactattggtcagaaatataaattggtattttctttcaggaatttaatttggcaataatatgaagtcttttaaaaataccatgtgaccaaacaatttcatttctaggtatgtgtcctgagaaaaaagtatagttggatgaaaatttatataaaaaagataaccattgcagcattatatgtaatagtaaaaaatttgaattaacctaaatgtccaacaatagtagaatggttaaataatttatattagatccaccttagatttttttagtcattaaaaatactgttttagaagaatatttagtggcattgaatattactatatagtgctaagcaaaaaaataaagatttagtacacagtgtgatacaaattttaggagaaaaaggaagaaaaaactgcagaaaaatatatcaacttgttaacagtttatttctgggtacataggatacaagaggttttattttctcattcatacttttccattctctccaaattctatccattaaggatttattactttataataagggatgtggcaatgtatataaaagtaatgatctgacatttgtatgcaagataggtaagaagcagcagcaagttagagtggtagtgggaatgggaaggaaaaagcaaatccgaaagacgttttataagaagaaactctaggatatgaaacagatgcagcagatagagggttttcagcataatcaaaactaggataggtaagaagaatcctacttgataggggaaagaagatattcagttttggacaaaattgaggatgattcatatctgagggctatttctttataggtagttggaaatacagatgaagttcgttttctttcgttttagtatgtctttgaaaattatgtaggcttttttcagattagtgataattaaggtttttcactcttcgaaattagagaggttttgcttattatgttctgtatttattatattactgcttcacttttcttgaatgttactttataaaataactgattatcaaatgttagcctgacttcaccttgttttgccttggactggctcagagttctcatgtttccactgttattacactattattactctcagttgttcttgttgctgtcaaaaactattatgtttgaagaagtataattattacttgagcaatatttgctttttaatactgttttctatgaattttaggcaatgaatattttgacttcagtgctgcttctatatgcaaaagaggaagaagctttttggcttctggttgctgtatgtgaacgaatgttgcctgattattttaatcgtcgaattattggtaaaagaaaaaccacacacacacatatgcatacacacacagagatgtatatttcctttctaaacaatttcagtgtctcttgtctaattactaataaagtagaaggactgatggattatgttgtggtataaaatgcaagcaatatcaaaatgtcacattcactgacattctcaaaagaagagctttttgtactgaatgtatagtcagaaagattgtttaatatgttgcttttaaaaataaaatacctggtctgtttcttaacaaaaatggaagcattaagtttataaactctatgttgctaaaacaatggtgatctcaagtatccacagctactggtgaatttttgtagttttttgatgggagggagatttcaatctgcttaaaatctccatatttgtatgaattatatagatatttgcaagatttcaaagaaggatcgagttcttagtttgttaattgtataatttttattttattttattttattttattgagacggagtcttgctctgtcgcccaggctggagtgcggcctcggcttactgcaagctccacctcctgggttcacgccattctcctgcctcagcctcccgagtagctgggactacaggcacccgccaccacgcctggctaattttttttttttttgtatttttagtagagacggggtttcaccgtgttagccaggatggtctcaatctcctgacctcgtgatccacccacctcggcctcccaaagtgctgggattacaggtgtgagccaccgcgcctggccaatattttctttaatcatcaaatatttacagatctgtgaccacttaccttaaaacttatgaatggtctctttgtaccgtaataggctttcaggattgtggttaggtcatcgattttactgtctttcattataattatttgtgtattttttttttttttttttttttaggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatgaatttgaattgtgtttctgaagtacatgacactactagcagttagatgtataaaatacagaagaggttctgaaagagttcataatttaaggaagaagaatgagatacatcagcatgctaatagaagtggggaggtatggaaacaagtccttttgaaaaatgtttatttttaaacttcttttgatattctgtaggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggtattgtaagaaccataacatttaaatctggaggagatttgagagatgatgttgttcaatcccctattttacagaggaaactgagccctagaaatttcagtttgtccgagattacaaaaccacttgaatgaaagagctacacctaaagtccagtcctctatctccagaaaaaatatagcaagaataaatcactttgaagtgaaccactaaattatgtacacatttacactaatattgttgattcagtatgctaggactttcatattcccagtttgagctataaagtgtctatgtagaattagttcaagcaggaaaagcatagttgataatgttaaatatccagtggccgggaagttattctggtttctatgtggtttcaggtgggttgaactttattttcctagtagcttctgtatgaatgctattttgtattggagcacatgtgttgtatgtgtgtgtatgtgtatatgcacacatttgtatatgctaaatgaataaatttgagtgggcaactatcataatgccacatgaaatcccattatgtacagaataaaatacaaacatcttactctggcattcagaactctgtggtaagggctcagtgtacctttcttcacttatttccccctatatgcttctacataccctatattccactcttactgagctgtgtggtatttgccaagtactctctgagcctgtttgcttccttcaaaaccccaaaatgattcctacactatcccatttccctcacccatgccctcctaatgctcaaccatcttcaaactccacttcttgaccgggtgcggtggctcatgcctgtaatcccagcactttcggaggccgaggcaggtggatcacctgaggtcaggagttcaagaccagcctggccaacatggcaaaacctcgtctcgactaaaaatacaaaaattagccaggcgtggtggtgaacacctgtaatcccagctacttgggaggccgaggcagaataattgtttgaaatcaggaggcggaggttgtagtgagccaagattgtgccattgcattccagcctggatgacagatcaagactccatctcaaaaacaaaaaacaagttccacttctttttttgttattattatactttaagttttagggtacatgtgcacaacgtgcaggtttgttacatatgtatacatgtgccatgttggtgtgctgcacccattaactcatcatttaacattaggtatatctcctaatgctatccctctcccctcccccaccccacaacagtccccagtgtgtgatgttccccttcctgtgtccatgtgttctcattgctcaattcccacctatgagtgagaacatgcgatgtttcattttttgtccttgcgatattttgctgagaatgatggtttccagtttcatccatgtccctacaaaggacatgaactcatcattttttatggctgcatagtattccatggtgtacatgtgccacattttcttaatccagtctatcgttgttggacatttggggtggttccaactctttgctattgtgaatagtgccgctataaacatatgtgtgcatgtgtctttatagcagcatgatttataatcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagtacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcacatgcctatgtcctgaatggtattgcctaggttttcttctagggtttttatggttttaggtctaacatgtaagtctgtaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgtttttgttactgtagccctgtagcctggtagtatagtttgaagtcaggtagcatgatgcctccagctttgttcttttgccttaggattgacttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacctatgagcatggaatgttcttctatttgtttgtatcctcttttatttccttgagcagtggtttgtagttctccttgaagaggtccttcacatcccttgtaagttggattcctaggtattttattctctttgaagcaattgtaaatgggagttcactcatgatttggctctctgtttgtctgttattggtgtataagaatgcttgtgatttttgtacattgattttgtatcctgagactttgctgaagttgcttatcagcttgaggagattttgggctgagacgatggggttttctagatatacaatcatgtcatctgcaaacagcaacaaagttccacttcttcataagaccttcccttgtcctctcagttgaaagtaacctctaactaactagggagaaattatgtgtcatttctctgctttaataatggtagttccactaattcttgtattactatcacttttcaataggttctttgacaatgtcactaataaggatagtccattgccttcaaatgttcagcaaggttcaaatgtgagtgatgaaaaaaccagtcatactagagtggatattacagatttgattagagaatcaaatgaggtaagttttttcatgccataaatatattagctagcatatttaaaatgattgaactatggtctatctctaatggtatattaagtgtaagataataatgcaagtagacatacaacttaaaatccaacttaacttttaaaatgagttctgtgaactgttctaggttgtgtaacctcctctgcctcaatttgtttttcattaaatgaaattaaattcacttgctttcacaaataatgaccactttaaacatctatcactggattaaaaggtgaattattctcattattattattcacttcttagagattaagaattttacctatatttttgtacttagtctattcacatagtagatggaattctctccagtgaatatatttaaaaactgaaacgtgggaggtaaaaatttgcaaaatcattgaacaagtcaggaaattccctagaaatagaatcaaggcctccaagaattcagtctgataaaactgaattgtaaaagaaaaagtggatgtttattatgagtgagtagccactgaaatcatatctcttgcagaaatatggtaatattcgctatgaagatatacatagtatgcgctgtcgaaataggttgtatgtgatacagaccctagaggaaacaacaaaacagaatgtggtaagtatgcaaccaatgaggaaaaaccagttggagtaattttttttttctataactttctttagaaattatcttctgggcgaataaaatgaaaaggactaaacttttgagctagatccttgccaaggtttaccctatggtaaattcttttttagagaaaatacattattttcttctggttgaattatgttgctttctccaacatgttttgtactatttgaccttcaagaccactgagacagggtctcgttctgttgcccaggctggagtgcagtggcatgatcgcagctcactgtagcctctacctcatgggctcaagagatccttcttcctcagcctaccgaggagctgggactacatgcacacaccaccatgcctggctaatttttaaattttttttttagagatagggtctcagtatgtttcccaggctgtctcaaacccatgggctcaagagatcctccttgcctaggcctcccaaagggttaggattacaggcgtgagctaccacacctagcctgcagctcagtgttgaatgctatcatgttggcatttaagcataacatatttgtgatgtgctgcatcagtaagaacagccgatctacatagtagtcagtgctccaatgaatattattatccttggatacctaaagtaaatactatgttttaaatacttgtctttttaatatttggatggctccataagcaactgttaatattggttgcctttggtgaatcggattaatagattgctggtcagaaggaggagagttttactttgctgtttatattcttctgtactgtttgagcttttatcatgaccatgtgttgtttttgtaaacctacttgcttaaaggccaaggtcctcagagatacaaatctgggaagattaatgtttctgaagattccaggtttagatttcaattgaataattcagtgaggttactgtgacatagttagcatagggccccttgttttagtttttatatgttagcatttttaaaaatttactgaagtaatacatgctcactgtaaataatttaagcattacataaatgtaaaaagtagattccccaccccagaagtaaccatcttaaaataatttggcatatatcctttcagatcttttatctaggtgtctgcacacatgcatgtgtattggaaggatatagtttttgaaatgagatcataccagtcactttgctctgcaacttttttcattcagaaatagatcatggttattgaatatcagtaaatatagatctacctcactcttcctaatgcattgaatagtatgccataatatggatatgctataatttattcactgctgatgtacatttaatatgtctcccttttttgctcttacaaataatactttatgtaaacattcttgtatatctattctttgcaagatagatatctggaagtggaagctgggtaaaagggtatgcccatttaaaatttgacaggtccctgccaaattatgcttcaaaagattttgccaaattgtaatcccaccagcagcctgtaagaatgcccctttccccacattctcactaacaccagatatttaaaatcttgaatttgttggccaggcatggtggcacacactcgtagtcccagctactcaggaagctgcgacgggaggatcaccttgagcctgggagttccaggctacagtaagctataatcatgccactgcactccagcctgggcaacagagctagaccttgtctctaaaacaaacaaaacaaaacaaaatcttcaatttgtgccaatgtgatagatcaaatacttttaaggtttcaattcactgatcacatatgtttattagcctttttaatttcttctcttaattgcctattcatagcctttgcttatttttctatgagattgtcttaagtattgatttgtagaagctcttttgactattagtagtaccagttctttgtcagctatatttgtggcctaatattttcccctagtcttattatttctttcattatctttataatgtctttcagattatacaagttacaaattttcttgaagtctttctcttttttattacatgatatctgggtttcatatcaaacttagcaggctttccctatttaaaattatataaattataaaaatattttttcatattggcctatagtactggtattgcttttttaacatttagaactttaatatacctagagtatatttttttattatgtaatattatgtttttccaaccaaaatcactcattttctaaaaaccaattattaaatagtttatcctcacagtactctactttcttcatatgctaaattcttatatacatacatgggctttatttttggactctctttttttgttactacaacagtaccacactctttcaattaccatagtttgtctactttgaaatctggtaaggcttttattcattttaacagtctgtctttttaaatgttctttagtaagcattttaattttcatcatctaggtcttacacatttcttattgggtttattctacccctatatattttatggttttgctgctaatatgaatgagatcatttttcctttacattgcctaattctttattggctgtgtgtgtaaaagttattgatttgggtatgttgcttttctaagtggtcgcattattgactctcattaattgtactattttttttagttgacctcgaattttctgaatagacaagcatgtcatttccagtcttagaattttgacccttcctaacatttatacctcttttcttttttctgtgttattgcattaagtaggatcttcagagaattattgaataatagcagtagaagcaggcttctttgtcttattctttttgttttttttgagactgagtctcactgtcgcccaggctggagtgcagtggcacaatctctgctcactgtaacctccacctcctgggttcaagcaattctcctgcctcagcctcccgagtagctgggattacaggtgcctgtcaccatgcccagctaatttttgtatttttagtagagatgggatttcaccatgttgactaggctggtctcaaactcctgacctcaggtgatccacccgcctcagcctcccgaagtgctgggtttgcaggcatggccaccacacccagccgcaggtttgttatataggtaaattatgtgtcacagggtttcgtgtacagattatctcatcacacaggtaataatggtactcaataggtagttttttgatcttcaccctcctcccaccctccatactcatgtaggcccctgtttctattgtttccctctttgtgtccatgtgtactcaatgtttagctcccacttataagtgagaacatgcagtatttggttttcttttcctctgttagttcacttaggataacggtctccagctccatccatgttgctccaaagaacataatattattcttttttatggctgcataatattccatggtgtatattgaccacattttctttatccagtctactgttgatgggcatctaagttgattccatgtctttgctattgcaaataatgctgtgacatacatacacatacatgtgtctttatggtagaataatttatattcctttaggtatatgcccagtaatgggatttctgagttgaatggtagttctctgttaagttctttgtgatatcttcaaactgctttccacagtggctgacttaatttacatttccaccagcagtgtattagcattccctttactccacaacctcaccagcatcttgttattttttgactttttaataatcatcattctgattgtgtgagacggtatctcattgtgattttgatttgcatttctctaatatttagtgatgttgatcatgtgcttgttggctgcatgtaggtcttcttttgaaaagtgtctgtccatgtcctttgcccacttttttatggagttgtttgatttttgggttttgttttttgtttttgttttgagacagagtcttgctgtgtcacccaggctggagtgcagtggtgcgatcttggctcactgcaagctccgcctcccaggttcacgccattctcctgcctcagcctcctgaatagctggaactacaggcatccgccaccatgcccagctaattttttgtatttttagtagagacggggtttcaccacattagccaggatggtctcaatctcctgaccttgtgatccacccgcctcagcctcccaaagtgctgggattataggcatgagccaccacacctggcctggtttttaattttttaacttcctatggattctggatattagacctttgtcagatgcatagtttgcaaatattttttcccactctgtaggttgtctgtttactctgttgatagttttactgtgcaaatgctccttagtttaattagtcccatttgtcaaattttatttttgttgcaattgcttttggcatttttgttgtgaaatctttgccaccgcctatatctagaatggtactccctaggttttcttcaaggctttttatagttgtaggttttacatttaagtctttaatccatcttgagttgatttttgtatatggtggaaggtagggatctagtttcaatcttctacctgtggttagccagttatcccagcaccatttattgaataggttgtcctttccccattgcttgttattgttgactttgttaaagatcagatggttataggtgtgcagctttatttctgggcactccattctgttccgttagactatgtgtgtttttgtacctgtaccatgctgttttggttactgtagccttgtagtatagtttgaaggtgaataacgtgatacctctagctttgttcattttgcttagtattgctttggctatttgggctcctttctggttccatatgaattttctagaatagttttttctaattctgtgaagaatgtcattggtagtttgataggaatagcactgaatctttaaattgctttggttggtatggcctttttaacaatattgattcttcctatccatgagaatggaatgtttttcatttgcttgtgtcacctctgatttctttgagaaatgttttgtaatccccattgtagagacctttcacctccatagttagctgtattcctaggtattttactctttttttggctattgtgagtaggattgagttcttgatttggctctcagcttggactttgttggtacatagaaatgctactgatttttgtattctgaaactttgccaaagttgtttactaaatctaggagcttttgggctgagactttggggttttctacatatagaatcatatcatctgcaaatagaaatagtttgacttcctctcttcctatttggatgccttttatttctttctcttgcctgattgttcgggctaggactgtctgtactatgttgaaccagagtggtgagagtgggcatccttgtcttctggttctcaaggggaatgcttccagcttttacccattcagtatgattttggttgtggatttgtcataaatggctcttattattttgagatacagttcttcaatgcctagtttgttgaggctttttaacacgaagtgatgttgaatcttactgaaagctttttctgcatctattgagacgatcgtgtggtttttgttttagttcgtttttgtgatgaattgcattaattgatttgtgtatgttgaaccaaccttgtatcccagggataaagcatacttgctcatggtgtgttagcattttgatgtgctgctagatttggtttgctagtagtttgttgaggatttttgcatctgttctcctcaaggatattggcctgaagttttctcttttttttgttgtgtctctgccagttattggtagcagaatgacactggcctaaaagaatgcgttaaggaggagtcatttctcctcaattttttgcaatagtttcagtaggaatggtaccagctcttctttatatgtctggtagaatttggctgtgaatccatctggtactgggctttttatgattggtgtgtgtgtgtgtgtgtgtgtgtgtgtgtgtgtgtgtgtgtgtgtttctgattcaattttagaacttgtttttggtctgttcagggtttcaatttcttcctggtccaatcttggcaagttgtgtgtttccaggaatttatcatttcttctaggttttctagtttgtgtacatagaggtgttcatagtagtctctgagggtattttttgtatttctgtggggtcagtggtaatgtctctttgtcatttctgattgtgtctatttgtatcgtctcttttttctttgttagtttagctagtggtctatcagtcttatttattcttttaaatagccaactcatggattcattgatcttttgtatgggttttcatgtcttgatttcattcagatcagctctgattttggtaatttcttgtcttctgctagctttgggattggtttgttcttgttttcctagttcctctaggtgtgatgttaggttgttaatttcagatctttctaacttttttatgtaagcatttatgctgtaaacttccttcttaacactgctttaactgtgtaccagagattctgatatgttgtatctttattctcattagttttaaatatttcttgatttattccttagtttcattgcttacccaaaagtcattcaggagcagattgtttaatttttatgtgattatatggttttgagcaatcttcttagtatttattttcatttttattatgctatggtccaaagagtatagttgttatgattttgggttttttgaatttgctgaggattgttttatgtctgattgtgtggttaattttagagtatgtgccatgtgcagacgagaagaatatgttctgttgttttggggggaaaagttctgtagatatctgttaggtccgtttggtcaagtgttgagttcaggtcccgaatatctttgttagttttctgccttgatgatatgactaatactgtcagtggggtgttgaagtcccccactattattgtgtagttatctaagtctctttataggcctctaagaacctgtttcatgaatctgagtgctcctgtgttgactgcatatatatttaagatagatgtcttcttgttgacttgaatcctttaccattatataattccttttttgttttgttttgttgttgttgttggcctaaagtctgttttgtctgaaatcagaatagcaagccctgcttttttctgttttccatttgcttggtagattcttcctcaaccttttactttgagcctttggatgtcattgcatgtgagataggtctcttgaagacatcattcagttgcatctcactatcttatccaacttgccactctgtgccttttaattagggcagtctagttacattctggttagcctgtttacattcaaggttaatattaatatgtgtagatttgatcctgatatcatgttgttagctgattattatgcaaaactgattgtgtagttgctttattgtgtcaatagtctatgtacttaagtgtgtttttgtagtggctgataatcgtctttcctttccatatttagcactcctttcaagatctcttgtaaggcagatctaatgaacatgaattcccttagcacttgcttgtctgagaaggatcttatttctcctttgcttatgaagcttagtttggctgaatacgaaattattggctggagtttcttttctttaagaatgctgaatataggccttcaatcttttttggcttgtagcatttctgctgaatagtacactgttaggctaatgggatttcctttttaggtgacctgctccttatctctagctgcctttaatattttttctttcatgttgaccttggagaatctgatgactgtgtggcttggggatggtaatcttatatagtatcttgcaggggttctctgcatttccagaatttaatgttgtcctgtctagcaaagttggggaaatgttcatttatttttgtctaagttaattcagagaaccagtcttcgagttctgagattccttcctcagcttggtctattctgttgttaatgcttgtgatagtattatgaaattcttgtagtaagtttttcagccctatcagatcagtttgattctttcttaaaatggtcattttgtctttcacctcttgtatccttttattgtattccttagattccttggattgggtttcaacattctcctgaatctcaatgatcttcatttctatgtagattctgaattatatgtctgtcatttcagccatttcagcctggctaagaaccactgctggggaactagtgcagttgtttggaggtaaggtgacactctggttttttgagttgccagagttcttgtgctggttctttctcatctgcgtgagctgatattcctttaatctctgaagttgttttcctttggatgggtttttttttgttttttttttttttttttttttttttgcttttatcttctttgatgcccttgggggtttgattgtggattcagttgactggctttgattttgaagatttcagatggccaaggctcacctgagctctcctgagatgagtgtgctacctctgcggggctggtaccagacccccagctttgttctctgggccctcggggctaggaacctgctctgccagagaggccaaggtgttcccagtccactggcctcaacactacaatggaggtgctagccaaaacacttagtcggggtggtggcggtggaatccatgcttgctcgtgcatgccagcatccgtggcagcgtggcagcatacacatgcattggctcaggctgggtgctcgtaggagcctttaccttagttttcacaggtggtgtatactggcagaatattttagtgttgtcttttgggctgcgatccagtaggtggcgcttaagagtgttagccagcagatagcttcttgctctgctgcatggctccagggtaatggtctgtgaatggggacagggagatggcccattcacctagtccacccctgggccttggaggaaccccttctgattactggcttcatgcccgcatttcttttgttgggtgctctggtccacagggctccctcaggtaggagccacagttggcaaacaggtcttatccttactgggtcggccctgtggagggaggcacacaccacccctctatcaagctgcgaacctgggtgtctcatctctcagtgatgcttgggcaccacctaagtcagaaagtcccgcccaactgggagctgcgggagtgagtagtgtcacctaatctgctgtccaagtgcatcctgagggtaccaggggttgcaactgccagcagagtttaggcagaagctggaccactggactggaagctctaacaggcattgcccacctggctaccagtggtggagcgtggtggggtcacctgccctgcctgttgggtgtttccagtgacaacaggatgttgcagccactggctaagttcaggcagaagcgggacatctgggctggaagctccagcaggtgttgctcgcctggctaccagtgacaggagcaggtggggtcgtccgccctgccgtgtaggtgtttcatgggacaacaggaggctgcagcctctggccgatttcaggcagaagcggtagtgctgggctggaagctggcaccaagccttgtctggtgaggagggtggaccaatcctactgctcccaggcaccatgactttggcctctattggggctgtggcgctggtgttggtctgttccaggatccgaggcttgtagaggtccccttggacttaagagttgcctctgcaaaccgtctgggtggctctctgcctcagtttagaggtgaggtgggaggatgagagtggcaagtagggggttagggcaggggaattctcccactcccagccttacacagatccccatggagagtgtgaattaccctctcccgtattggggagcttctcctgactccgcattgatgccagataggctgctgcccagcttccctcctctctgctctctgtgtccccttgctgctttgatggttcccagtgtggtttcttagatgattggcttttagggtcagtgttcactaaaccctttgtttcccctccataagagagcagcacccatgatctgcttctagtttgtcatattggcccctcccatgctgggcaccttttttttttttttttttttttttttgagacagtctcactctgtcgcccaggctggaatacagtggcatgatctcggctcactgcaacctctgcctcccgggttcaagtgattcttgtgcctcagtctcctgagtagctgcgattataggcatacgccaccacacctggctaatttttgtatttttagtagagacagggtttcaccaagttggccaggctggtcttgaactcctggcctcaagtgatctgcctgccttggcctcccaagtgctgggattacaggcatgagccaccattcctctgctgggcactttaaatgacttctgtatccatgcttaaattatccacttctcgatgatagtcatttgtgatttctttcatctcacttgccagaaatgtgtctatcttattgattttttcaataaaccaactcttaattttatttactgagtctaccgggtttttttaattttctgtatttcatcaattctagcttttttctttacctttgctttcaaatttcttagatatcataatgattgtatcattagtccttcttcttcatggaataggataaaagtacatattttctaagcttattacttcttggattatgttttttggcatagagagggaatgtacatctcccaatgcctttgaagtatttaatagcaacctcacatgatgactagatatgctgcttatgtggcaagagaggaatatatggaataggacttagaatactgttacttatatttatagacattaagtggctgttctttggcagtgatttctgagtatgaagagatgaatatcaaagtacatattagagtagaattgaactagtctactactactttttaaaaggaaaaatagataataactttataatataataacttataataactttttattattcatttaagaagttaaaacacaaatattttcttctagcagagagagactctaaggtaattcaaagagaatttctttactgcaatgttaaaatctgtgtactaaattgcttttaatctttttaaagttgcgtgttgtatcacaagatgtgaaattgagccttcaagaattggatgaactttatgtcatctttaaggtactgttgttcttctttaaatgaaaaataatgcttttttttagcagaattgtatcacagccattctaattatttttatctttattttagcagacatggtttttaaaatcttccaaaattactttttctaattagtaactttccttttttatttatttttaatagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattggtaagatgatttttttaagcaaaaaaaaaaggtgctcctagaaatacttagtactgcctattattgccaatttagtcagattatatcaccatgggttacagtgtgtttagctttagtaataaatggacccttttctgcatttgttgctaaatctaagtattttgatattattttccccaaccctttcagaaaagcaagctgttagatgtgagtgttttaagggttaacataaggaagataacgtcccaattttcccacactcagatgcatgggtactaccgaaggacttcccccaccccaccgacctccccgtaaaaattcaaccacatagcctagaagagtggtagataaatacccagcaaacatgttgtacctacagatagtcaagatgttgtacctgtagatattgttcatttgcttttccagataccccagcatgctttcttatcagggatcaccccttgaagaacagttctctcctgcacaggcctcattcaaaagaaaagagaaatctgagattggggggaaggagctaggaaagagaacattttacttttttgataaagagtattttgcttatacagttatacacttgaaggagagcatctgattgactaggtggttgtttaattgttagcttaagtaacaggtttctaaatcctaatttttgactaatgtctatatcttaattaatctttgttgctgaaattgattgaatgttctttagatacatgattatttacaattgaattttattgaacagacataatgtacaatggaagttttactgagaagcttaagctgctttttaagctacatattcctccaggtaagagtttaccagtctttaacgatgtacagcaggaatttattccattttagcaagtataattacagatttttttaacaactaaactaattttcaacatgatataagatcgttgcttcactgtggccctcaaattatattatgactactttttgctgatatagatacagtgatcttctatggaagagattctgtgtaacatatgggcccacaagtttccttcctgttagtagtcaatttaatgataagtagtttgtatataagaatcacatatcatttgattgttggtataatgttgaattgttgttgttgtcattagagtggaaattaactttagacaaactgccaaacctgcgaaatactacaaattattcagaaaaatgggacaaggaagcagggatattaaatattttaaaaaggaagcacaataaacgctatcatttattaagcacctgctctgtcaagacattaactttacatgcatttttaaaatttaattctcataatatccatgataggtggcattatccttccaattttgatgataaggaaactgagagctggaaagataaaaatttgccaaagatcacatcgctaataaattgcatagcaaactgaagtctgactccaaagctcacatttctttatattcttccgtactacctcaaaattaccacaccattcagtttacttgtttttcccactgacctgaagaggatgccttgccaaagcctgatccctactttgtgaaaacagtcttaggctttaaactgaaggagcattgcaaaaagtaccttttagccgagatggggtagttcacaaaaacaaacagcacctcataatttgtttaaagctacacctgggatcccttttcagcttttctcaggatagccgggaaacattctttaccacaccaacaaggtaaaggccatctttaacccttcacacactcaaatcacaaacacatcattaaaagcaaaagacaaatcacctaaaaatttaattataaaaggagtttccattgtcaaatcaggctactgttagaatgtttaatattgtcatcaactatgcttttaacagagggataaaaaaataggaaaaacattatgtacctgttaaagcacaagtaggaagtaaaccaaagcacccaactttctgttttccttattattgaggatgttttttaaatggctgaggtcacattttcagagatttctaaatgccagatttaaacaatttcaacttttaatagctcttggaaaaccattaaaaaaacaagtaggaaaaaaatagaactcaaaatgatcaactacttcttgtatttactatattttatatatattacatatattacagtataattactatatattacagtagagtagaaccacttctgtatttcttcacttacatctttcttatacagaaactctttaacacccagttcccagatatacctgacccattatgaacctcatctctgcccctggttgttaataaatgtaatttgggttatttatatgttttcagcttacactgaagtgaaatctaaggatgcttcaaaaggagatgaactttccaaggaagaattactttatttcagtcagctgcatggtaaatacctgtttaaaatgttaactgttttgatgattagccacccataaagatcttgctgacttagatatactttacccaactaaaattgggcttcattttaacttatacttcttttgtattaccacagcacttagcatggtccataaatgtttgaccggttaaccaaattgcattttggtgctttgatttgtggaatttcttgcttattggagactcaataatgtattttgtttctacttacgttgcagaaatttctaaaatgtattagaccattttcatgccttgataaaatacaatagaatctttgatgattaaaggccatagctatttttcaaacagtgaatacttattataaatcactgtaggtgtaggagacagggatgagtctgtctccaagacaaaatttaaagtgatatgagtttatttttgtgtcctttagtttattttcataaatattcaatgtcctatagagggatgaaccctgattaatgtatatttgtggttattatatgttaaagtgtttgaacattaagtttgaagggaccttacaaatcatctagtcaagtctcttccttttatagataaaggcactaaggcccagagagaagtgacttgtgcaaggtttcacagtgagttgttgccacagtcagggctttgtagcacactcttctgacgtccagtatgtgctttttttctcctgataataaaagtaatataactttatttaaagaaagtcacaaagaagaaaataccacccagaaataaatacttaatatttggtatgcttccttctaagattttttaaaatacggattttcccccaatgttctttttactgtgaaagttttggaatattttgtcttctgatgataggtcaagtcagctaaaatttgtttgcagaattgaataaaataatgtgcttatacgtctatatgaaacattattttgctttcaaagagtatttgttaaacatcttacagaatgcaattacatcttttcttatagtttccaagcctgcaaatgagaaggaagcagaatcagcaaaacacagccctgaaaaaggtactatgatctaggagttatcatttaatttatttagttatttttatgtaaataaggatagctacaaagggggaaaaggtggattccttttaaaggctattgatgtctcagaaattatagaaaatatgatagtaaatgacccatattcatttaattttattatttttaaaagatttgtttttaattacaaaagtaatagataattcttagaaaagaaattcagacagtacataagtccttttgtcttcactcaaccctacccgaaaacatttttgtctatatccttttcagatctattcctatgtatacacaatatatgcagacatctctcttttttaaaaaaatattccataagtactgttttataatttcctttttggattttgcagtatatcatggacatcttttaatgtcagtacatttgtatcttaaactctttgaatgaataagtagtgtttcaaatttttgaaaaagagctactaaagaccactttgttttgtttgttttgagatggagtcttgctctgtcgcccaggctggagtgcagtggcatgatctcagctcactgcaacctctgcctcctggattcaagccattctcctgcctcagcatcccgagtagctgggactacaggcgcccaccaccacacccggctaattttcatatttttagtagagacagggtttcaccatgttggccaggctgatctcgaactcctggcctcaggtgatctgcccacctcggcctcccaaagccctgggattacaggcgtgagccaccgtgcccagcccactttggaacaatatatgcatattaagaacataatatagaagctgttttaaacttaatagtatacatgagaatgactacataaaatttgcattattaagtcggggtgtattgttttaatctaaatatgtcctttctccctctctcgccacatattccctagttcccaactttcctaaagtaaacgttttagtctaaacagaaatgggaaaagtattctgagagccagtgggtgaaatgaaaggtaatttcagatcatttcctggattaaaaaaatgggatcttatatctcagtgaaataccttttaatcataattattatttttgaattttgggaaagtatagtgggctgttccttatgaaatggttttactccctttcttcaggcaaagggaaaattgatattcaagcatatctaagtcaatggcaagatgagcttttcaaaaaagaagaaaacattaaggatttaccaagaatgaatcaggtatagcatttttaaaaagaaaattctaagttcttgcttttttgtatggatgtgggtgtaacctctaaaatagctaacatgctattcccaaaatagttaaataatctatctattagctctctaagtttcagatgagcatggaagagtgggaagaaattttttaatgatttttttatttttaacactcaaatgtgtccagtgtttcagagaattcttctgctgtgacatgtacctatagaaaaaaagtatgtgtagtatatttccaactttattggaaatgttcatttattcagtaaacatttgtttactgtataccagataccaaacccaatgctaggtactgggaatgataaattactgagatgggtcacaccctggttcctactgatcttatatctgaacataattttaagttcatctctttcttatacactgcctaatcaaaatatgttcttctttttgtaattaaaatctggttagtacagatactgaggatcccgagaactttaccaaaatgaaaactatcaaataacttcatatttctcagtggactatatcatttgacaattgaataagtactttctaaaatgagtcagtatgacatatttattctagaattactataaatgaacagtactattgtttagggaaaaattctctcaaactgccttttttcctctactctcacaccatgacaataacaatcatcaacatagaagaaaatgtctgtggccaaatgtgtgggggttttccccccaaccaagcagcagataccagctgagtgtcctccaattaaattccaacactatctacctagaaatagtatgagatcccacaggttgagtgttcagtccccaagactgctccctcctttcccccagtaacaagtctgagcctcctgaacttctggctgaccaacttcaagttggggttcccactatcccttctttgagttcgattaatttgctacagagagacttacagaactcagagaaatagttatatttactggtttactaagaaggatattttaaagaatacaaataaacagccagaagaagagatacacagggcgaggtctggaagggtcccaagcgcaggagcttctctccacgtggagttggggtgcaccaccctcccggcatgaggatgagttcttctttaccttcctcctgtcagcctccatgcattcagctatcagaagctccctgaacccagttatcttgggtttttatggaagcttcatgatgtcagcattccttcccctaagggtatgaggtaagaccctttctagggagggttttaagaccgactatcagaaagctactctggaggatgaggcaggagaatcacttgaacctgggaggtggtggttgcagtgagccgagactgcaccattgcactccagcctgggcgagctgagatttaaccattgcactccaacctgggtgagctgagatttcaccactgcactcaagcctgggtgacaagagcgaaactctgtcaaaaagaaagaaggaaggggaggggagggggagggggaaggaaggggaaggggagggaaaggggagagaagggaagggaagaaaagactgtaacaaaggactatgggagttgtgaactaggaacccagaaaaatatttatatatatatatatatatatatatatatatatggaattcaggattaaacatcttaaacaattcttaaacaaaagcctatgattctaatgtcagtgacttttcattccatggaagcaggtcaaagtgcagcctaatttatgcataattttaactatatttctgtccagaattcttgttcaccctctgaggacagcttcaaagggactttgcctaattagaagtaccacctggccaggcgcagtggctcatgcctgtaatctgagtgctttgggaggccaaagtaggagaggagcacttgaggctaggagtttgagatcagcccaggcaacatagtaagatcctgtctctacaaaaaatgtgaaaattagccaggcatggtggcatgtgcctatagtcctagctacttgggaagctgaggtgtgaggatcacttgagcccagcagttggaagctgcagtgagctatgattgcaccatggtactcaagcctggacaacacagcaaggccttgtctaaggaaaaaaaaatagcacctaacatttaagtaatgctggcaggcaaacagtccaggaattagtctggataaaatgtactattaggcaataagtgagagcacttaaatgaaattttcttccatggttcatactcatctttttttttaagatggagtttctctcttgttgcccaggctggagtgcaatggcacgatctcggctcactgcaacctctgcctccatggttcaggcgattctcctgcctcagcctcccaagtagctgggattacaggtgcctgccaccacgcccagctaattttttgtatttttagtagaggtttcaccacgttggccaggctggtctcgaactcctgaccccagatgatccacccgcctcggcctcccaaagtgctgggattacaggcatgtgccaccgcgcctggcccatactcacctttctagaaccaatatgtattttggggttaatcaccagttcttataacttctagggtgaagcttctatggtacaaatcctatataggagactattcacttctaagttctctttatatttgctaagtctaatattcaaacgtgatattttcaacttgtgtcttctagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgt

SEQ ID NO: 3552 - DNA, 47142 bp, human
cgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggtcaaggctacagtgagccgtaatagggccactgcactccagcctgggcaacagagggagactctgtctcaaaaagaaaaaaaaaattaaaatagattttatagtcccgtgttacagcctcaggaatagtcttataatttattttcgttcctcatactaaaactgtgttcctttaagtaggtaaatcaaattcttgaaaatataatcactgtaatgtagtattgcatgttttttttaacttgttgcaagtttccttttttttttttttttttttttgtttgagacaggatctctcactctgtcacccaggctggagggcagtgatagtgatgtgattatagctcacagcagcctggaactcctgggctcaagtgatcttcccacctcagcctccggagtagctagggcttcaggtacaagccactaagcctggctaatttctttttttttttttaagagacaggctgtgttgcccaggcatgatcttgaacacctggccttaggatcctcccactttggtctcccaaaggactgggattgggattaaaggaatgagccacctcacccagcctgacatgctttcttcttaaagcatggaccaactgcactagtttacctctatcctgcccactccatttactagtccccatagtctagaataagagaaatttgtctgaagaaataaactaagatttctaccacatatatatgttgtgactagtgatatccacacttatttagtggtcagtttataactcttcatgattattttatctgtggtattgacaagatgcttgaaattaccacatgagagctaccactgtaattccatgtaaattaaacaaaatggataagaaagaaacaaagaggtgcttttaaggttcatttggttctttttggtccagagcataagtgtgtgctgattttcctagctgctcaattactgtattcttacttaaaatcatgaagccaaaagctttgttgtgctttaccacaaatccacatttggattagctctcacaggagcttgactgtgtgccagcataagtttgcctctgttcactttgtttgctaaaatccagtgttatgtgttatccctttaaaagattagtttatgcattttgtttaatgaagaaatgataatgatcatctagaaaccttagtggttatactttaagatttcatttctttgccatatgataattggtggtaatcaccagcaatgtaatgactcttaagtgtggacttgataaagttagttgactccatttttttctaataatggaatagcagcaacagagaactcaaggattattaaaacaagagatgagtttgtaagttagaattctgaggtacctcttttaaattgttgaaacacttctagtggatatctgatagattactgaccatttgcctaactttatcttaattgttctggctcacagcaggatggaatatcttgtggaaatttttggtatacataagcggttttatagataaagcgattttccttcatttagagaaataattcacccttctggattttacggtccccttatgttatctcttgcttctcctagctaataatgacttttctatgacacctacatttagcacctggttttaaagagttaaaactaatttatgcatatttgtcttattaagcacaaatcaatttgctttgcttggcagatgggaactactacacgaatggagctatggggctacattctactaagtactctagtatatgggatttaggaaggtctgccaatcaggaagccttcatataggtagtttttaaagagtattttagtcttgaattttccatatctgaatagtgtaagcaggttcttcagtgttagattgataagctccctcagtagaccttttttgtgtggtgtagaacaaagctacgaagtaaaacttattaaaatggagaatttttagacattctgtttctgatttcctttttcatcttggtaccattactttgaaattaaattgtctgtaaaaaccagaatatgataatatttgaaataagcttttcattttatgatatttatatagactgagcaaatcactgtgtaaacaatttgtcataaacccatacataataaacaataaggtaacctttttaaaacctcttagtgaccatcccttgaaaatataaagcttctttcccctatttcctcaccccagactcaaggagtccaactctgaaaatgtgcgccttagttattagcaaaatatccctgcatttcatgcttacaaaggacatatctgataaaaaaattttggccttctaagtacctgtctactgagatgagggtgcccaagtgccaagcatgacatttcatttaaggtaaggaaagatctacccgcccccccccatacacacacacacaaacacacacacacaaaattaataagttaacattttggcttattaaaaagaaaatcccatggggcaacccctagagagggcagatcacgctttgtgctcccatccctctctggaacatcttggtccctgtgaaatcaagttaaagattacttttaaagatctctgaatgagaaagagcaactttgtaggaggttttgagtaatgaaggatgatcagtgttaccctcacctttttttttttttttttttggaatagtggaaagattattgactgcatacctaagtagaaaactaatatttggtttcaagtagatttaattctaatgaaagaaaaaacaagactgaaaagtcatgacattgaccgtcctttatttctcaaaatctcctacaaggctgccctttcttattcaaagagatctttaaaggtaattttttacttgatttcagagaacgaaatgttccagggagggagaggaaaacagtgtgatttgccctccctaggtattgccctatgggattttaaaaaaataaaaaataaataaaccaggctgggcacagtggctcacgcctgtaatcccagtactttgggaggccaaggcgggcggatcatttgaggtcaggagtttgagactaccctggccaacacgttgaaaccccatctctactaaaaatacaaaaattagccggacttggtggcgggtgcctgtagtcccagctactgatgaggctaaggcaggagaatcacttgaacccaggaagtggaggctgcagtgaaccgagatcgcactgttgtactccagcctaggtgacacagggagactccatctcaaataataataataacaataataataataataaataaaccaactacaagccaacatccacaaatatatgaatataacaccaagttcagtgattccacttgccccattaaccctgtttcttttatcttccttgattttttgatagttttatgtctctattcagctataattattttataaaggcttagtttcctcatctgtaaaatggggataaaaacttgtctttcctacctcacagcattttttatgtgggtcaaatgagttttgaaacttgtgagcaactatacaaatacttgacatttatctattaatgaaagagaaagacgttaaaatgccattttctgggcctgaagaacaaaggggttatatatttatgccattttccctagtaattactttccccatgttgtatatagaaattgatttggagtggtaacatagattatatctgatatgcaatgatatcactacaaaaacaaaacactgatagttactaattgaagaatttgggcatgatagtgattatgcatttatggtttataatcagaataatgtacaagaattagaataacttatcatgacatcatttccttttgatctgtcatcgcccaaaacctggaagttctcaaacagtgcttccgtagatatcagcatcacttgtcttgctgagtggtgataaagagtacatataacattggttaccttagtagtatttttcaaaacaatacttaaaaaataattattcaactggtgaaaactcatgctgtttgtgaacagttgtggaaggcttatggctataaggtaagctaaaaataaaaaataaaaagcagtcaggcatggtggtgcacacctgtagtcccagctacttaggaggctggggcgggaggattgcttgagcccaggagttcgaggccagcctaggcaatatagtgagataaaaaatattttaaaaagtaaaaggcattataatgtttgccacattgctgtacagctatgacagattttatattgcctttattttagaacatttgcccagttttccaccttttgctactgctatgtaagcacaaaaggtaagattaaatcctaaatgtgatggtatacaatgctttaattcaacagatatttaccgagtgccttttaaaaaacaagcactgttttaagtgctggagataaagcaatgaaaaaaaacaaagtccctactctcatggggctaataccgtagttgggggaggcaaataaacaaatagtatatgatatgactggtgctgataagcaatatgaagaaaaataaagtaaggtatcatgatagagaggggagggggttggtatattagagaaattggtctgggaaggcctcttaggatgagctgtggacagagacttgtggtactagaatatatgagccaaacaaatatttgggaacagagtgaatacatataattttttctagaagttttttctgtgaagggaaagagagaaatagggtggtagctggcccttgtcctgggtgttgagtatacagtggtgaataagacaggaatagttctggccaggcgcagtggctcacacctgtaatcccagtgctttgggaggccgaggcagatgtatcacctgaggtcaagagttcgagaccagcctggtcaacatggtgaaaccccatctctacaaaaaatacaaaaattagctgggcgtggtggcacacacctgtaatcccagctacttgggaggctgaggcaggagaatcactggaacccacgaggcggaggttgcagtgagccgagatcacgccaccgcactccagcctgggtaacaagagtgagactccgtctcaaaaaaaaaaaaaaaaaaaagacagaaatagttccaacccttacggagtttatcatgtgatggctcagacagttgataaataagtaagcaaaccaatacaattgctagtgtagtcaataataatagcagccttgttctgttggcttagaaatctccataatgcagggaaaccctcaaagcaattttccaaggccagctgtcttataaagtatgcttatctgaagtcctgttaaagatacaaatatttcctaaaagcagtgattaataataggtggtgtactggtggcaaagttccagtgtggcatctgtgaagcatcttgccaaaaaccagtttggggtgttttcaaattaaatcatccatctatgagcactaacaatatctgagaggtggtttggtagaagtggtgggaggaggggggacgttctaagtaggaggaataatgtgatagtgcaaaagcaaaagataacagttgttggggacacagcaaatattctagattcatttacgtggagttgaaaatatgagactcaatatataatgcacttagcgactagaaaaaggttattaaagagcaatgtcttaatctataccagaggaaaacctgagatagagaattaaagggacctaataattaaacctttgttttttgtgtccactgttctttcagtggacataaaacagcctatgtataacaaaaatttccacaagatattccatcctgctctgagccagaacaattaagtaagataaaattaggcaaatagtcagtaatctatcagatatccactagaagtgtttcaactcataagccaaataaattaacattttggcttattaaaaggaaaatcacgtagagcaacccctagagagggcagatcacactgtgtgctcccctccctccctggaacatcttggtccctgtgaaatcaagtaaaaaattacctttaaacatctctgaatgagaaagggcaaccttgtaggaggttttgaaaaatgaaggatgattagtgttacccccccacttttttggtagcagtggaaagattattaactgcatacctaagtagaaaactaatatttcctgtcaagtagatttcattctaatggaaaaagaagaaagaaaaaaagaaaaagaaaaaacaagactgaaaagtcatgacattggccatactttatttctcaaaatctcctataaggctgccctttcttatgcaaagagatctttaaaggtaattttttacttgatttcagagaataaaatgttccagggagggagaggaatacacattgtgatatgcccctttttccccctcccttactacactataaagaactgaagttttaaaacaaggtatagggctgggcacggtgacccatgcctgtaatctcagcactttgggaggccaaggcaggagaattgcttgagcccgggagttggagaccagcctcggccacacagtaagaccttgtgtctacaaaaaataaacaaaattagcaggacgtggtggtatgcgcctgtagtcccagctacacggaaggctggggtgggtgggagatcgtttgagccagggatgtggaggctccagtgagctgagattgcatcactacactccaggcagggtgacagagtgagaccttgtctcaaaataaataaataaaacaaggtgtaatcacattttctgattattattataatattagttgctctcttgttttaaactaaccaaaatgatgggcctggtttagttcttctaaataatgtttaaaagtactacactgtataccagtttattcatttgctatcatatttgctttcttctttgtacctagaaattcaggtgttgcaatttatttgcttttctgagggttactctttttgtgcattggtgtataggtcttgaagagtaagaagtggctgtaaatatagtaccaattctcatattttcctgtgtctctatctttagaaatgtttctgggtttgattaataattcatctattctttttttcccagaagacattgtaatctgttgtttgttatatcaattgcttccctaaaaaattctaaatcctttaatgaaaaaaagatttcagttagggaaggaaatgagtgcttatatatatatattcagttttcaagtaagtccctttaaaagaatgcagggagagagaaaacaggaccaaagaagaattatttttattaactgttttccgaagctcttaatataaagttggcagctttcaaaatgccaactgtggctattgaattattccaaaataagcattcatagtgtcattttaaggacttacatctggtagcaaagtaatagaatcaggaaaatccacaaactttattgagcacactaccttctcttatttgaatatatttcctgctaagtgtattggcagtttactaattagtttgtttattaacatataatgaaactaagttcagtaaagttgtacttgtttgactttgtaagcatgacaacttatgacaagataaagaatccactgtaagtttccagtaatcattaccgtggaaaaaattataattgaacattttacttagaatggaaataaatcttgtttgtaattaggaagttcattacatggctcttctgcagctagagcagtattcacttacacagtgccctcaatccagtttacaaacagaaagagcaacttgtcaaactaaaggacattttagtttgtgtactaaactagcacattgataatgagtatcattttcaagctgtggctgttttactggtctttcctctagcactcagcccattgccctacctgttcatcattaccattgacctaatacaaaaaaagaaatgtttatgaaatttgcaggtgtctaaatattggaaggggcaattaataccatagatcaatgtgctcaatattggccacaggttagattcaaatgaggaccttttatttttatttatttattcatttatttatttatttttgagatgagtctcactctgttgcccaggtgggggtgcagcggcgcaatctcagctcactccaagtgatgcaacctccgcctcccgagttcaagagactctcctacctcagccttctgagtagctgggattacaggcacctgccaccatgcccagctaatttttgtatttttaatagagacagggcttcaccatattggtcaggctggtctgaaactcctgacctcaggtgattcacccgcctcggcctcccaaagtgctgggattaaaggcgtgagtcaccaagcccagcctctgaggaccttttaaaataaactaaaagatactggatattcatggatgaaatgatacaatgtctagaatttactttaaaatactccaggagggagtatttagaacccagaaattggtacatattaatttctgaatgacttgcagggacttgatgatgattacagcttaatgagctggaagagttccccaagtgactagaaatgtagtctagcactagtttccaaattatttcttgcatagttttatactaactgcctgatttcacacttaacaaaactgagcaattttctttctacatagtacaaggcgcttataatcttgtgaacatttctgctgccaaaaagtgacctttcttgccagtgattttgactactcctctcacatccacatagccaccattaatctttcaacagtatcttcaaaaagatagttatcttttatctttatctgttatctgctaaagctatcctgtattcaataaagtgccttcatttgaaattctaattcctttattttgacaaatttgacaacttatgtttatttatatacacacacatttatgtacttaattctgtttttcaacatagtgatagctcttttggttgtcttttgcgactactcttttatccctttttttagtattttcacattcctatcttcaaattgaaaacattctcctcttctctatttcctcagtaatttttttttattattacactttaagttttagggtacatgtgcacaatgtgcaggttagttacatatgtatacatgtgccatgctggtctgctgcacccattaacgcgtcatttagcattaggtatatctcttaatgctatccctcccccctcccgccaccccacaacaggccccagagtgtgatgttccccttcgtatgttcatgtgttctcattgttcaattcccatctatgagtctgaacatgcggtgtttggttttttgtccttgcaatagtttactgagaatgatgatttccaattttatccatgtccctacaaaggacatgaactcatcattttttatggctgtatagtattccatggtgtatatgtgccacattttcttaatccagtctatcattgatggacatttggcttggttccaagtctttgctattgtgaatagtgccgcaataaacatacgtgtgcatgtgtctttatagcagcatgatttatagtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcgccattctaactggtgtgagatggcatctcatagtggttttgatttgcatttctctgatggccagtgatgatgagcattttttcatgtgttttttggctgcataaatgtcttcttttgagaagtgtctgttcatatcctttgcccactttttgatggggttgtttgtttttttcttctaaatttgtttgagttcattgtaaattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttggtgttttagacatgaagtgcttgcccattcctatgtcctgaatggtaatgccaaggttttcttctagggtttttatggttttaggtctaatgtttaagtctttaatccaccttgaattaatttttgtataaggtgtaaggaagggatccagtttcagctttttacatatggctagccagttttcccagcaccatttattagatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccgtgtagtatagtttgaagtcaggtagtgtgatgcctccagcttttttcttttgccttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgatcttccatttgtttgtatcctcttttatttcattgagcagtggtttgtagttctccttgaagaggtccttcacatcccctgtaagttggattcctaactgttagaaccaaagacaaaaaccacatgattatctcaatagatgcagaaaaggcctttgacaaaattcaacaacgcttcatgctaaaacctctcaataaattaggtattgatgggtcgtatcttaaaataataagagctatctatgacaaacccacagccaatatcatactgaatgggcaaaaactggaagcattccctttgaaaactggcacaagacagggatgccctctctcaccagtcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctaagcccaaaatctccttaagctgataagcaactttagcagagtctcaggatacaaaatcaatgtacaaaaatcacaagcattcttatacaccaataacaaacagagagccaaatcatgagtgaactcccattcacaattgcttcaaagagaataaaatgctcagtaattttaatcacatagttctgaagacactatctgcatattttggctcctacttttctttctttttactttaccaaatctccaatttctcatagtcactatttcaatgctaaaagtgatagaattatttttccttttatccccaaacccatcagtaattccctcctcattagttgaaatataattattttctgtttccctcatcctcattcccattgtcttttccccaatactttctctttcataatatttgtcagttttctcatttctattttttaaaagcttcaattcatacttgaactttttttcatatcagataacttcttatctctataatctgcacatactgccattgccaaaatcttctttcttgaactttgccctatcaaaatcctcagaaaatttctaattgatgctatgctgcatttgtgactcctgtttttactttttatcaattcctgtatctactctcctatcctttcctttcagctaagccaaatttctctttatgtctttgtcttatctcctactcttctagtttacctccttctatgcatgtaacttcctaatgtgataggaagtgatgtgaggcaaatgtgagcatctgccaatctatctatattctcattcaaaccttgcttaaaatctcaattctttttaagtgggtcaaaataggaagagagccaaaagcctggtttataattgaattaaatttttcttaaaaatctgtattctaaattaaagggaaatgcctcataaagcaaaaccaacactcaaccaatcagagcttccagaaaaggaaggtaaatttatatatttcagccatcccattgatatggttaaatcaacaaactatatccttattgtgcagcaatatgttgaaagttatggatataaacacagagacagaagacatggttattgtcctcagaggacaaataatctagataaagagacaaaaattatatacatgaagctcttagaaagtagttataataaccagcctaatatatgctaggttgtgtagtacaggttaaacatcactaatctaaaaatgaaaaatctgaaatgttccaaaatccgaaacattgattgctgacatgatgccgcaaatggaaaatttccacacctgacctcatgtgacaggttgcagtcaaaactcatgcataaaattatttaaaatattgtataaaattatcttcgggctatatgtataaggtatatatgaaacaaataagtttcatgttcagacctgggtcccatccccaagatatctcagtatgtgtatgcacttaatccaaaacctgaaaaaatctgaaatctgaaacacttctggtcacaagcatttcatataagggatactcaacctgtatagactctaagtcctatgaatattcagagaaaatggaaagtattattgcttgggatagccagtgaggatttcataggggaagtgggtcttgaagaaaatgtagaattcagattagttggactggactagaagactttcattaggatttctttttttttcattagcatttctaggtaaaatgataattgcttagcaaagaccctatgggagaaattaactggttgtttaagaaaacagtgaactttgttctaggaaatagtaggaaatataattagattattaaactggaactaattgatcaagaaccttgaattcctaattgaggaattaagaattgttgaaaagaaaatccctgtacagaagcattttatttaatcaaggttttatcttgtttaaatatctaagattttcttaaataataatagtattaactaatatcgggtgttttactgtgtgctaagcattgctctaagtgcgttaaatgtaacaactcatttaatctttacaacagccctttgtagtaggatctgttttaaccttattttacaaatgaggatgcagaaagggtaagtactttaacttgctcaagttgacacaagcgacagagccagaatttaaacccagttagtctatagtactatattctacattcttatctaatatacatacaaccttatgaacgagatacataagtgctgcagatacattttgagatttggacaattgaagctgacttaactcttttattgaaagataattttctcagatactactcacattggcatactgtaatctctctttatcccaaatgtattttttctttaagaaaaatctctgtaaggactctatgggctagaaaagttttaaaataaatttattagtttgttatatgaagtgatacagatttgatttatctcttgtaaagtccttatttcaacaatctttctattacaacagggcttctggttgggactcttgattcagtcttggactctactgctaaagtagctccatttcgcatcctacaccagacaccagattctcaagtttacttgtcaattgcatgtggtgagtatgatttttaaaacataattcaaattaaataagggtactacaaagctgagtattcatatttatttatagtctgtagttgctttgagatttaaaaacaaattaaatgtgcaactttactttgagagaatagcaagacctctatttttaaaggatatgggttattaagttttttttttttttttaatccattggtgtgagggacctgaagcatgtggtctagcagggctgattctgcacagattttggtcagtgttactgctatataactcctttcttcaacttctgctttatccaactgctgggaagatgagaacttctccatgaaataaattgtttcattactaataactcaaatgagaagaatctgaagttatctgtgaacccaaaacataatgactcctaaggaagtataagcctggaaaattaaaccttttttattcattcccaccttctcagaaaaagcatcatatccttgaaatatgaaggaatgtcttacagttaatgttacatattcattcatgccagggtggttcagatgcttcaacatatatattatgggtagaaaaggaattaggataatcctttctaataaagcaagtcaaaataaatttttaaaaagctgcattgacagtttcttacttccttttatgatgccattataatgttggtctaaattagaatcccagatttctagcctttttgatattgaaaaactgcctttcttcttatccccctctcttctaaagtagatatattataattttttaaaaagaacaaaagcacatgagtttctggaacattcatatgtgtgaacatatagcatacaattaattttttaggttgtgtggcttgttttttatatttccgcctaaatttcttttagtgttgccagtgagtctttcctcctggccctcttaaagtgaatgtcacttaacctaaatgaggttgacattatacctgctgacatcacgagaattctgtaatctcaactctaaatctggttagtaaaaattattttttttaaaaaaaggcctttctacttaaataaagatgattgtataacttatttcccccaaattaacctgatgcagaaatagtgtagttacctactaatgaagcttccttataccaaaagaatcaaacttaaggccttaacatttcccccatggcttttatttgtggtccattaaagacagttattactcttgctatggtgacttagtagcatgaataaaattctgattgaattgtaggaaataggccatttgcaatgtcaacaaattttttaatatgccagtctccatatattataaaatatactaaaaagtcagcatatttcttttgaatatttatataatccatagtgctgagaagactttaatggtatgtgagtgataggaagagattgatagatactgaaatattcttcaagtcaaagcaactagggctaataatgtttaatctcaccctcagcaaacctcttaacactgattcagcgggtcacatggatttaaccttgctacagaatttctaacctcctgtatgaaatttctgtaagtttactaggtcttttgatgaatggggttgctctgagcaaaggttttgtggcttctgaaataagtagagtggccacagttaaaatctacatttacttagcatgcataggattgtcacatacatgctgttttcagccacacatattatagacacagcactaactgcattatttggagaccaaggattgaattacacattatgtattttctggtactctacatattttcttaaaagatactggttattctttaggcaccagttactagcatcttgttttcagaattttatatattttctcatgagctggatttactttactcccctttcattaaatgttttgttctttctatttatgagaagtactgttcatgcccacatagagggataaagtaggaataaatgtaaatattttactcctttatgaccatcattttttaaagtgaaaatgttatttctttttaaactatgcttttaaataacaagagcagttttattgtggagttttccttaagtgttttattttcttgtgttattaatcaggagccaacagagaagaaataaccaagcattgggattggttggaacaaaatattatgaagaccttatctgtatttgattcaaatgaagatattactaattttgtacaaggaaaaataagagtaagtggcacggatatatcttgtagatggagtgccaaaacctttgactctcatgtatgaggatcaaagtttgcatggaaggtcattgtttcactggcacctttcaggattggtagaaacgaacatatgaatttcagaatcagtgtgctaaagaaaactgtaaagtctttagcacagggggagattgatagatattgaaatattctcttaaaacatactggttattctttaggtaccaattactgacatattgttttcagaattttatatattttctcatgagctggatttacttttttcccctttcattaaatgtttgtctttggtgcccttgtgaatgcttttaggggcatttttgtttcaatatctcttgagttttgagttgaataaaccatttgttcattcaaaaaaatatatttagcacttgtatttgtagtagttccttatgaggcattcagaaaaaaacctaagcacaaaactgaagaaaatttgcttacctctgtcctaagagaattatctatgtacacacatatgatatatgtacctgtatagatatatacagtcgtccctaggtatctatggggattggttctggccgccgctgtagataccaaaattcacagatgctcaagtctcctaatataaaatggcatagtatttgcatataacctatgcacatctgcctatatacctaaagtcatctctagactattcattcctaatacaatgcctatgcatcacttcatttgagtggactctgcatagtcttcggtgcatggcaaattcaagttttgctttttggaactttgtagaatttttttcccaaatattttcaatccctggttggttgaatccatggatgaggaacccatggatatggagggctgactgtacaattgtattcaatcaactgtttgaatgtatgaaatatatttttgttggtaggtgatgaattttcagaaaatattttgtctcctttagggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaagtaagtggtttctattgcttactatggccttgaatttgctgtctgacctaccaactctaatgatgttaggttgtaaataaaataataggattgatattaaaggtaattaaactgtacaataaaaagtttatttcatctagggaaagaactcttttaagactggttgcttaacataaaaccattagaagtgtatatagaatgccttgcatatcgtgggaagtgagtcagtattaaatgatgatctggcatatgactgctttcaattccttgttatgaactacctacatgctttagtctgtgttttaatctattttaaacatacaatttgaatatagtggccatagtacctaatggcccacatctcactttgtagctacaaagaagaatcaaacagtgctatttatagcatacaaacagcttttacattggtagttatataattatgtaattatataaagagatagatttaaatatcaaatcagaatcattttttttaaaaattatctaaaattaaattgggcacagtggctcacgcctataatcctagcactttgggaggccaaggcaggaggatcacttgagcccaggagttcaagacgaacctgagcaatatagtgagactctgtctctacaaaaaaaaaaaaaaaaattacattagctgggcatggtggcacatgcctgtagtcccagctacttggggggactacttgggatgtgagaatcacttgaacccgggaggtcaaggctgtaatgagccatgatcatgtcacctcactccagtctgagcaacagagtgagactctatctcaaaagaaattatttaaaattagatctcttcctggaatcaccaattcttgcacgttcatgttgatgcttcaaatttttaactaatcttgaactctaaactattttagctgtttatagtatttttcaagggattaactattgtttcagaagaactgattaataaacataaatcactatgaaaatttaatcatacctgcttatacctcttatttgcagtaaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaaggtattcaaagcttaatttttagttttcaaagtattgtttgaccataagaatgaagatagtattgcttaccattaaaagttaactcttctatattatatgatagggttttttttggagttgattgtgggtgtgtgtgtgttttgtgagtttattcatatgcattacataaatagtacccttctctccaggaaatttaattgtaagaaataatagaagttagatttgaaaattatttcttgagattcagataggacttgccctggaatgcttttagaaatgcagagatttttatgtgtggttagtctaactctaaatttctctatgaatagtctagacagtttgggtctgaaattgttaaacatattgtttattttttaaaataacttacagaaaacattttttaatgaagaggcaagttcgtggagtcagtggagcatggactttagaatgaaagtagaacaacccttagacaagtcatatctctcaggacctcagtttcctcatctgtcatttctacctcagagggcacttatgaggaatgggcatgatatgtgtgaaagcactttgtaaaatataaaatatgaggcaaatattaatcattattagtgcctccttcagaagtatgtgtctgatagctgtttgccattatatttggtttgttgaaactgaccagatatcttttatcctgctgaacattctgaacagttgactaaaatgagcatgccaaaggggaaaaggagaggagatgatccagaaatagctagtgaaagcagcttctggcaaggaggatgtcagtatagactatatgggaaagtataagaggaacctaagccaaagtcctatggatagaccagaacaagtgacctagaaggttgtatgatcactacatagccctcattgggtacagttgttcctcttacctgttcctaaactattcctaaaattgatatacatgaggatttgtttgtgagcctccctgcttttatggaaattagatcagcaaggtaaattttttatacttcagtaccaaaactaggtctcagtatgcatgatttataaatagaattctataaggattaagaatcctgtttgtattatattataggtgggcgtttgtttttgtatttcatttctttattggcaaccataaacaaactgttttgccattttatttcccttaaaatacagtctaaaaggctatcaatgagttattcatcaccaaatcggtatttaattaagatataataaatccatttttgtctgtgtgcatttttaggagagcccattgaaaatcgtacatatctacatctttttttctagtaagttaaaaagaacagtaatttattgggacttagtctccaaatggcttttttataaaatggaatatctttattgctctgcttattgtttttacaaatatgtattacttttatagtttaaacaatacagaagcacagtaatgatagttaagtttagcgtatatccttctaggctttttaatgcatgaatttataaatatttgcaaaaataggtctggacatcacacattgttctacaatctgctttttttctcttgtatcatggacaactttctattcacataaatggactttattttatttaaataatagtgaacccacaaaattgcaatttatttgttttattagctttcccagtttgaaaaaaataccatttaactgaggtaaaaattaacatggttgtgtttttctgttcatgtttatccgaagtattttgaaagacatgatgaactaccacatatttaaatagtatatgcaggaagaatgaatttagttttagctttgttggatttgagttagaacttgcattatttacttattatcccagatggcattgctgcttaatgcaattgtttcgtgtgcctagaaaaaattatactatttaaagcaattgctttttacacaaaggctacatttgtctatcagttaataagccctctgtatttattgacacctatcctgtgcccaacatagtacaagcagtattattttatcatacttctactttagattttttaaaacattcatttaaaattttacttcacttaatttttaatatcgtctttaatagactactctttccctctaaatttttatgccacaaattttcattattttattttacttgaactgggtaactcgcttgattttctggtaaccagataggaacattgttgtcttccaggattgattttaaccatagtcacatattatgcctatatgataatataatagtcttctaggaaatcaccccttagagatagtttgaagacctacatgatctctaacttttgtgcattttaatctactaataaaatgaaattggaagaaaagaacaaacaaaaggagtttgcaaggaatcagtgtatttttttctatttcagaatttgttgaaaaatatagcatttttagtgtttaatctgtgtgcacagtgtatgtagattagtcaatataggcatatgtataccttagaattcatttctaaaaattcatttgtgccttatcccattttttctttcctacagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtaatgtaaatttggttacatatcagtttttagtttgaaaatgttatccttcacagagtaaaatgtcctttaattctataaattattaaaacctcaagatgcaatatccttttagtaatttaaaataattattcttcagaataagagtacagccttctgagatattctcagttccatttagtaaagtctttttttattattatactttaagttttagggtacatgtgcacaatgtgcaggttagttacatatgtatacatgtgccatgttggtgtgctgcacccattaactcgtcacaacattaggtatatctcctaatgctatccctcccccctccccccaccccacaacaggccctggtgtgtgatgttccccttcctgtgtccatgtgttctcattgttcagttcccacctgtgagtgagaacatgcggtgtttggtttttttgtccttgcgatagtttgctgagaatgtcatacatttttgaatgatcaagctccattttgcattaacctaaatgcttatcttgtttttaaattttaaagttttaaaattttcactttcagtaagagctgtaagactttactaaatggtaaagttagactatcacttttgatgtactctgtcagaaaaaaataacattgacatcttttacgtaagtcagaaataaattgttggtatttgatactgaatttttacatttgtactgtcatttttaaaggatacatgttagacctttttcttgagaagtgaaataacttgcactgaggttaattgtatgattggtgcaactagtacccaaagtctatttcttaataagtcatactatagaccaaaacttttggccacaaaagagtaagccaaacacattttacttgaaggtgtcaacaataaaggaaaatttaattgacctctatgtttttcaccccctaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatattagagaggacagagaaatcaggaaagatccaaaattgacaccctaacatcacaattaaaagaactagaaaagcaagagcaaacactttcaaaagctagcagaaggcaagaaataactaaaatcagagcagaactgaaggaaatagagacacaaaaaacccttcaaaaaattaacgaatccacaagctggttttttgaaaggatcaacaaaattgatagaccactagcaagactaataaagaaaaaaagagagaagaatcaaatacacgcaataaaaaatgataaaggggatatcacgaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaacaacgaaaaagagcccaggaccagatggattcacagccgaattctaccagaggtacaaggaggaactggtaccattccttctgaaactattccaatcaatagaaaaagagggaatcctccctaacccattttatgaggccagcatcatcctgataccaaagccgggcagagacacaactaaaaaagagaattttggaccaatatccttgatgaacattgatgcaaaaatcctcaataaaatactggcaagccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaatcataagagctatctatgacaaacccacagccaatatcatactgaatgggcaaaaactggaagcattcccttttgaaaactggcacaagacagggatgccctctctcaccactcctattcaacatagtgttggaagttctggccagggcaattaggcaggagaaggaaataaagagtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatagaatacctaggaatccaacttacaagggatgtgaaggacctcttcaaggagaactacaaaccactactcaaggaaataaaagaggatacaaacaaatagaagaaaattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcgttaccattcagtacataggcatgggcaaggacttcatgtctaaaacaccaaaagcaatggcaacaaaagccaaaattgacaaatgggatctaattaaactaaagagcttctgcacagcaaaagaaacaaccatcagagtgaacaggcaacctacaaaatgggagaaatttttctcaacctacttatctgacaaagggctaatatccagaatctacaatgaactcaaacaaatttataagaaaaaaacaaacaaccccatcaaaaagtgggcgagggatatgaacagacacttctcaaaagaagacatttatgcagccaaagaacacatgaaaaaatgctcaccatcactggccatcagagaaatgcaaatcaaaaccacaatgagataccatctcacaccagttagaatggcgatcattaaaaagtcaggaaacagcaggtgctggaggggatgtggagaaataggaacacttttacactgttggtgggactgtaaactagttcaaccattgtggaagtcagtgtggcgattcctcagggatctagaactagtcataccatttgacccagccatcccattactgggtatatacccaaaggactataaatcatgctgctataaagacacatgcacacatatgtttactgcggcattattcacaatagccaagacttggaaccaagccaaatgtccaacaatgatagactggactaagaaaatatggcacatatacaccatggaatactatgcagccttaaaaaatgatgagttcatgtcctttgtagggacatggatgaaattggaaaccatcattctcagtaaactatcgcaaggacaaaaaaccaaacaccgcatattctcactcataggtgggaattgaactatgagaacacatggacacaggaaggggaacatcacactctggcgactgtggtggggtggggggaggggggagggatagcattgggagatatacctaatgctagaggacgtgttagtgggtgcagcgcaccagcatggcacatgtatacatatgtaactaacctgcacattgtgcacatgtaccctaaaacttaaagtataataataataaataaataaataaataaataaataaataaaatattagagaggacaaggaggattttgatgtttaatatgtctctcatggaaatgcagacaggtcaaattcaaatgaattttcttttacaatgtccaggaaccccaagttttaatagattgatacaacttatcaaattatagctatttgtattttaattaaaattcaaagaaaaactaaatgtgtctttattggctatattattttatttgaattggagtatagagccttttactgctatctccagagtagagattgaaaataatatgctaagtcaattataatgcagtattgataaaactaattttccctttgataattaaaaagcacaatgaaaacatgtaattaaatttttttttccatctcaattccagacgcagaatttctacattggccatcaagggttttccttgccccaactttattatctctcattctcttttagtatgtacccaggatattccttagtttgatgtgggaatacaagtaaaatctgaccagccttagtagttttctctcccaatgctcccaaattcttacttatatcatgttttccttgttctgttctatttcacattcagtccacgtgttagcttcaaagctcaacatatctttctttttcctttaatttgcttttccaaaacctgaagagctgtaactgttccccttaaaactttcatgtgcttttagtagctgaatatgctcagttgtcaagaaaggattttgtttcaaaatgagtttaccatctttccaaatatgcatcagaattctacagttttctagtttctcactcgtttttagaggttttaataaatatatgtacaaaataccagctagtatactatctgcttggaaatatgtatttttaaattgccataatattctgttttcacttaagatttttatcttatcaatgatgaagaatattgacccattttagtatctgtatatatctagttttaataatagtacacgtaaaaacttagtaaagagaaagctttttaaacaagagctagttccatttgatttctaagtaacagaaattatagctatattcttttataactacacttttactaaaacgaagagaaaaattgcattctataattttaataaacctggtgacttttgtacaaacagcaagactttttattttaaatctccaagagtctaaatcaacaagtctaaatatgaatacaggaagtactttaggaaatctttcctgtgagaatgtcaaagacattatacaaagaacaagtcctaccagaagtaattgaaattatgcatgagtaccagttctatccaagtttttatatgggtatatatttaaatgttccacattttaataagttatactaaaatctgggcatataaagagatttagtaaaattctaataaactgcttggaaaaatacatgaatcttttactttcattgacacatataatcaagaactattactagataaggtaatttttcaaaactactcaatgaaagaaaaatgggccctcttaggttagttttaagcaaagtggcctaagaatggaaagcactactgaagatcccttgcctgatgcttttaaactacattatgaatgaattgtagaaactatggaatgtcaagaaaggtagtaattgagtttatgccttaaagtttttagatgggcaaataagtatcttctacatattatcacagaatatgtaaacataacttgtttcatatagttagtaagatagttactaactgtatgtaatatagttattatcttaataagatagtttcataaccaggactatcttactaagtttttaaatagaagtaatgggtttcctacatgataatgtagatcaaaattgtagtttaaccaacataactgattttttcttgccttgataagaataaggtgcttcctatgaccataatataaatttggaaaatgatttttagctgtgggggtagatttatttctaagttgggaaaccagaaactattaaaaatgaaattcacaccctttaaattgtggactatgaacaggatcctatttaagataagcttctgatatttgagaaaagcatttgtttatatttttttgttttaattattggttttacaggtcaactctggcccccaaaccaccatttattataccgagtttatgaagtattctaatttaaatatagtattttgtagaaatttacacataaagaaatgttaatctttgctttgtctttccttcacttttagagccatatgataattgtaaaatcaatgtcagataataaaaatgaaacagattaagaatacctgctatagagttaacaatctatgttgctttctagatgtgattggattttgctcaggcactaaaagtctgatgagtgccaagtttatttgtcgtaagtgtgaacacccaaataaatggagagaaatatagatatttatccaagtatatatataaaacaccatgggtaaaagtttccattcaaaagagccagagcaaaaatgttcaaaaactttaagtttagttccttgaataatctactttattacactcttcaaaatttcaaacattaaactaccatctttgaaggtaaatgttttttattttatttcttttgtcatttttttaaattttctaaccacctactgcctgttgatgaaggtgaaggttttaacgtgactttatgaatacttaagaggcaataatggatagaactgacatacttgtcatcactcttataaatttatgtttagggtttcattgcttaagaggttatttttttccctctgggatacttttcctgtagtttagaacaatagataaactgatgattcagtcatttaaattaaaggaatgtgctgtgcttgagatccagactacaaccatgaattttccaacctgtatttgcaaaaatgtaactcctcgttcaaacagctaaacttaatattaagttgtcaagtatgtgatttgtcaaaataagcatttaaaaaaaaaaagaagggaattgttgcaatttgagacctatactctctaatcattaatttttcctttattggcttcttctaccttaccctttcatttacacattgatttgaatactccttaactttccttgaatcctatctatactcatctgttctcacgctgctatgatgaaatacccaagactgggtaatttataaagaaaagaggtttaattgactcacagttctgcgtggctggggaggcctcaggaaacttacaatcatggtggaaggcacctcttcacagggtggcaggagagaaaatgagtgctgagcgaagggggaagccccttataaaaccatcagatctcatgagaactcactcactatcatgagaacagcatgggagaaactgcccatgattcaattatctccacctagtcctgcccttgacacgtggggattattacaattcaaggtgagatttgggtggtgacacagagccaaaccatatcattccacccctggcccctcccaaatctcatgtcatgtcctcatatttcaaaacacactcatgccctaccaacagccccctaaagtcttaattcattcccatattaacccaaagtctgggtccaaaggctcatctgagataaagcaagtcccatccacctataagcctgtaaaatcaaaagcaagttagttacttcctagagacaatgggggtacaggcattggataaatacactattccaaatgggagaaattggccaaaacaaaggggctacaggccccatacaagtctgaaatccagcggggcagccaaatcataaagccctgaaatggtctcctttgactccatgtctcatatctaggtcacactgatgtgagaggtgggctgccacagccttgggcagttccacccctgtagctttgcagggtacagcccccctcctggctgctttcacaggctagcattgaatgcctgcagcttttccaagtgcaaggtgcaagctgtcagtggatctaccattctggggtctgaaggatggtggccctcttctcatagctccactaggcaatgctccaatggggactctatgtgggggctccgaccccacattttccttccatactgctctagcagaggttcccccatgaggactccacccctgcagcaaacttctgcctggacatccaggcatttccatacatcctctgaaatctaggcagaggtttccaaacctcagttcttgacttctgtgcacctgtgacttctgtgcatctgtagcccaacaccatgtgtaagccactaaggcttggggcttgcaccctctgaagcaatggcccgaactgaaccttggcctcttttagccacagctggagctgaagcagctgggatgcaggggaccatgtcctgaggctgcatagagcaggggggccctgggccaggttcacgaaaccatttttccctcctaggcttccaggcctgtgatgggaggggctgacgtgaagatctctgacatgccctggagacatccaaatttggtgattaacattcggctcctgttgcttacacaaatctctgtggctggcttgaatttctccccagaaaatgagtttttcttttccgtcacatcatcagtctacagattttccaaactttttgctctgcttcctcttgaacactttgctgtttagaaatttcttccatcagatatcctaaatcatctctctcaagttcaaagttccacagatctctagggcaggagcaaaatgccaccagtcttttcactaaagctccatttcccaagaagttcctcatctccatctgagaccacctcaacctggacttcattatccatattactatcagcattttggtcaaagccattcaacaagtctatagaagtccattgtccatattactatcagcattttggtcaaagccattcaacaagtctataggaagttccagactttcccacatctttctgtcttcttctgagacctccaaactgttccaacctctgcctgttacccagttccaaagttgcttccacatttctgggtatctttacagcagcgccccactacctggtaccaatttactatattagtcctttcttacactggtatgaagaaatacccaagactgggtaataaagcaaagaggtttaattgactcacaattccacatggctgggaaggcctcaggaaacttactatcatggcagaaggcacctcttcacagggtggaaggagagagaatgagtactgagtgaagggggaagccccttataaaaccatcagatctcttgagaactcactcactatcatgagaacagcatgaggtaaaccgtccccatgattcagttatctccatctggtcccatgcttgacacatggggattattacaattcaagatgagatttgggtggggactcagagccaatcttaatgtccagccctgctagggcttgtactggcttcttggatttcaaactaaagtaccactggattggtccaccctaagctgctacttttcctctgcctcagtcatgggcattctttatcttacttaagctactaaggtttactaaagtttaagggatgaacttaagtgagtcttttcttcttttttttttttagcactcctagtaataacttgcaatagctggtgtagttataatccatagaagctgggtaactgatatgttttaagagtaaaactttggtgttcataaagttttatgtggaaatacaaaagactcagagtaactaaaacagtattgacaaggaaaaacaaagttggaagactcatgctttccaatttcaaaacttattatacagctatagtaaacaagacattgtgatactggcataaggggagacatgtagatcaatgtaatatagttgagactctagaaatacattcttacatttatggtcagttaattttcaacaagaaggccaagctaactcaatgggggaaagaactattttcaacaaatggtgctgaaacaatggacagcaacatactccccacccccaaaaagatgttgtactcttttcttaaaacatacacaaaaattaaattaaaatggatcaaagaccaaaatgtaagagctgaaactatgaaactctcagagaacacataggagttaatcttcatgatcttgaattaggcaattgtttatagatatgacaacaaaagcatgtgaccttaaagaaaaaataggtaaattggattacatcaaaattaaaaacttttgtgctacaaatgatatcatcaagaaagtgaaaagacaacccacagaatggaggaaatatttgccaattatatgtctggtaagggactgctgtctagaatgtatgaagaactcttacaactaaataataaaaggcaaacaacccaattttaaaaatggttaaaggatttgaatagacttttctccaaagaaaataaagaaatggccaataagcacattaaaagatttttcatatcattagtcaatagagaaatgcaaatcaaaagcataatgagataccatttcatacccactagggtggctataattaaaaagaaatataatactgttgaggagaatgtgaagaattgaaactctcatgtattgctgttgggaatgtaaaatggtacaaccctcccaccccatactttctgtcctctaataaccatcattccactctatacttttatgagctcaactttttacctccttcatatgagtgagaacatatggtatttatctttctgtgcctgacttatttcacttaacataatgttctccatgttcatccatgtcgctgcaaatgaaaatgtttcattcttttttgggctgaatagtattccattgtaaaaatttatcacattctctgtatccatccatctgttggtggacatttaggttgatttcatatcttggctattttgagtagtgctgcaagaaacataggggtataatttatatatttgtgcttatttaacattgcatgcctgtatcaacacatcctcataagcaattggtattttcaatgttttgggttttaataggtgtgtaatgttgttttaatttgcaattacccagtgacatctgatgttgaacctctttcatatgattatttgccatttatatcttccttggtgaggtatctatttagatcttttgcccactttttaatgggtcctttatttttttaaacatagttttaattctttgaatatatttataatagctactttatagtctttatttacaaaatccaacaagtgggccccctcaagacactttctattggttgcttttttaagttcttgtttctatttttaagcctgacttccttggatcaccccctgaatcagtataatttagtggttattcagtgatgggttagatttccttaaatgccttatgctaccaaatattctacctttttctcaaggatatctgtgtgaaggtatatgtcaaacttcaggcaattttcacatcagctttagcttttattccctgctttcaaagatagccagagttgagtgactggggctttcttctgtcccatttctttcctaggcatgttcacagccctgtacatgtattcattcttctagatccccaagaatatgttgcagcccttcaaagttccacatcatcatctggtttttcaggtcttccttttaaatctttagccaggctcttgtttgctctagctgaaatcatagccttggacagctgggttgttaccaaccaattgctattgttttctataataccctgggaacagagttttttcaccaagctgagctgtgaataaaatcaaatgataacaacaccctgggaatagagattttccagggagttgcaagtttggtcaaatattgtctatgccctagggatagggcttttaatgaaactccaaaagatccactggttgccatactgctggctttcatttctgagcttgggcaggtggatagagttaaaagacccacagactcttctggtcttactcaggcaggctcattagtttttctcgaataggtgcttttcagtttattgcatgcctttggttaattccagtgttctgaaatggtttattttgaatgttttgccactattttgttgcttttgttggggagtgtgttcacaggggttctgagcttgccattctagaagtcaggttgttgacatatctaattttgataggtatgtctctgagatattgctttaatatttgttatgtatacagattgtggcttataaataacagtaaacattagaacttttttttcttgtagaaacgtaagcatgcatctgggacaactacattctttctttttcagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatggtaggaaaacaaaatatttaaacctatgggctgaaacatttggtgaaaagtaaaaatcttaaaagcagactagaaggtatcacaactgaaaactcttcttttgggacttgaaaagttttccagcaggtactactgtgtaacttatttagttccactgtacacaaggactattatcaggaatgaagataaaagataaaagttggacattggggatttttacagatacataatagtcgtacatatttattgacattgggttttatttgcatggatttctaatccttacatagatgtgatttggggagaatgatggtttaaagctttgcctcccaagtataacacttttaccatttttatatgagtttagctaagaattaaaatagtaaattaagctgctatgctcacatgagtttaaaagattttcatgatgacaaggattcagtgtttcacccctgggtgaatactgattttggttttctatgttcttaatttctatagatgttgtttcaaggtaaagagagtgggaaagttattttgcagaagttaatttctcactaaatttagttgttttgatttttctgtcattacagttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtattacgtttattcattgtatttatttaatagacattaactatgcctttctaggagttatgccctaagctaaagcaaaagaattacaaagatggttaatacaaagtcttactcatcttgagttcggactagtcaaagaaagaaaggtaagtagttatctataccttacctatctatccacacatccagcatctgagcacattagtttattaggcaagatatgtatactgggggaatctttagtgtcaacagtcagttaagggggaaaaaagctcatgaaattggtattctgttggataaattagtagcttgacatagattctagtgtaaagctcttttctgtttgtgctcagaaatcacttaagcataaggctaaatatcaaggtaatgaaatccaattatttatgtatatatggaaatagcttcattatatccaccttctgttgtatgttaatgtaataatcttcacaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggtatgacttaactatgagcccaactgtgtgtatgttccaaataaaatcacatcaaatccaattccactaatttggaagtggcgattataaggaaagagatgggggtgagatagatagagcatagtattaatgtaagtaggatggtagtgggaatacttaggagaattgatatttcattatttttctttttcacttaacaaatgtttattgaacttctgctctataaaagatactctgctaggtacttaaggctatataaagatgtatcagataagggtcctcccttaaaagtatgtagaccaggagacattaaagcatattcattaagaaacaaaaatcaagtgagaaaaactgttagagaaatataaattcctgtcatgatttataacaaggagaaactatttttcatctggaggagtcagagaaggcttcgtggaaaaggtagcatttgcaagtcttaaaaattggtgaattttggacatatggaaatggaatgaaaagaacatgccaggtgatggaatccatgtaaccgaacataggtagaggtaaacgtaaagtatgtataggaccatgtttgtttagtttggtagaaacatagggtggatgaagtgaagtagttggagaaaaaaaatcaataaggtagattgggatagagctggagtttgaattttattttataggcagtggaggaatcattggaaaaaaattatttaggagcacacaatcaattaggataggctagactgctaacacaaacacagataatagatgaaacagtataattttatttcttgaaggaataaacaaaggagattgactcttcaggtcagtaggcagctctcctccatgagattattcaggaacttagactgtagactgacagcagactgtcattttcaaaacaaaccttcccgagtacattttcatcaccattagcactcacaggaacagggaaagagcatggagaaacaactgtgaaagattttatgggctaggcttgaaaggggcaaatatcacttcatgcacattctattggatgatcttagtcacgtggatacacctattcacaaggaagtctgtggagtatagcgtggctgagcagacatgagcagctactatggaagaagaggagattggaatgtcatggataggtagcactctgtgccatacgtttatttataatgggttgaatacctgtaattgttacatgtcaatactacctatccactgtaacttgtcaatagagattttttttttttgaaaaactgtttaagtgaatggaacatctaaatggcaaggatttttagcatattttaggatctctgaaaggtacaaaagaagcataatgcttcttttctcaaagagcttatactcacagaccctgtgatattgtctataagcagtagtttagagatagcttcaaaataggcagcacttaatattgacttctaaaagatgagagcaaagttagaaacatggagggcaggaggaaagttatttggggctaaagtatgagtgataccattcaggtgagaataagcccaccttgggagataagattggctaggttcacattggaataaaaaagtaaatttgtatggcacaagatcatgaagaatctttcaagcctgggaaaagaatttaaacttaatatggtagacagattttgttggttttgatcaaaaacccacgtgagacacatggctggctagcttgctctatctatctatctatctatctatctatctatctatctatctatctatctattctgtctctctaatcttttctatcatctgtctccatctatctatctaatgttgatatataattcacttaccacaaacgtcacccctttagtggtctctcatatattcacaaagttgtgcaaaccttcaccattatctaattccagaacattttcatcaccctaaaaagaagccccatatccattagcagttactccccatttctcctactaccaacccaagcaatcactgatctactttctagctctatgaatatgcctattgtgcacattttatataaattgagtgatacaatatgtgatcttttgtgcctgccttcttttacttagcatatcattttcaaagttcatccatgttgtagcatgtatcaggacttctttcttatgatttaataatattccattatatggatatataccacattttgtttattcaatgttaatagttatttgagatgttttcttgttttggctgttgtgaataatgctgctatgaatattcatgtacaagttttttatggacattgctttattattcttgtgggtaaatatcttgaagtgaaatttctgggttatatgataactgtctgtttaacattttggcgcactgtcaaactattttccaaagagactgcaccattttatattccctccagcaatgtatgagggttctattttttctttgtctttattttattttatttttttaccaaatctccccttcattgtatgtacaaggattctaatttctgcacatccttgacaacacttcttaattgtctttctttttgattgcagccattccggtgagcgtgaagtggtgccttggcactcttgttgaaaattagttgaccataaatgttagagtttatttctggactctcaattctattccattgatttatacttctacccttataccagtgccacattgtcttgattactgcatctgtgtagtaagttttgcaatcaggaagtgtgagttctttaactttgttcttttctaagattgttttggctcttttagttccttgtatttccatacaaattttaggatcaacttgtcaatctctgcaaacaagaaaaaaaaaaggcagctgggattttgatagtcatcatattgaatctgtagatcaatttcgggagtatttcatattaacaatattaactcttccaacccataaacacaagatgtctttccttttcatttatttaatcattctttaatctgtctcatccaaagatgttttatagttttcagtgttcaaggcttgtacttcctttgttaattttatttctaagtattttaattttttgttattatagtaaattgaattgttttcttgatttcatgttttgattgtttgttgccagcatatagaaatacaactgataactgatcttgtgttctgtaagtttgctaagcttatttattagttctagtagatttttttgtggattaattaggattttctatatacaaaatcatggcatctgaatagtgttacttttacttctcttattccagtatggatgtctttttttcccttattcttgcctagttgaccaggctagaaccttcggtacaatgttgaatagaagtggtaagaatgcatgtccctgtcttgttatttatcttaaggggagtaatcagtctttcaccataaagtataatgttaactgtgggtttcttgtagatcatctttatcaggttgcggaagttctcttatattgctagtttgttgagtgtttttatcatgaaggagtattgattttgtcaaatgatttttctgtgtcaattgagatgatcatgttattttttccatatatatatatatataaacatatatatataaacatatatatatatacacacacacacatatatataaacattgatggattgttatatgttgaatcacttttgctttcccagaataaatcccacttggccttttgggatcctttttatgtgttcttaagttcagtttgctagcatgttgttgaggatttttatgcttatatttgtaagatatattgatatatagtttttttgtgatgtcttcgtctactttgggtgtctaggtttcttagaataagttggatagcgtttcctcctttcctattttttgaagagtttatgaagaattggtggtaattattctctaaatgtttggtagaatttgccagtgaagccatctgctcttagagtttgctttgtggaaagttttttcattactaagtcaatctctttatttattataggtctatttcacttttcccattttagtttcagtagtttgtggttttttttagaaactcgtccattttatctagattatctaatttgttggcatataatttttcatcataatcacttataatcttttttacttctataaggttgatagttctctatttcctggctataataatttgagtcccccttctcacactcttgctcttgcacactctcacttttgcactcttgatctctcactcgcactatctcgttcttgctctttttttttggaaaatttttttagttaggctacctaaaaatatttctatgttttttatcctttttgtcttttttaatcttttcaaagaaccaacttttgcttttgttgatttttctctatttctagtcttttttttaattatattttaagttttagggtacgtgtgcacaatgtgcaggttagttacataggtatacatgtgccatgctggtgtgctgcacccattaactcatcatttagcattaggtatatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcagttagaattatttctagtctttatcactttctgctcgcacaaagctggaagattagctggagataagagcttaggtcttttctgttctttcctaagaatacatacaactgtgagtatacataaagccatatgcatgtagttggccttctgggttcccaggaatatgtcacagtttttcaaagcccccacttttcttttaacactttgttagcgtattgtttggcccaactgctatccactgccttggatagccacatgttcaacaactgcctctgattgttttcaacaaacaccacaggggaaaaggctgtttacaccagaggagctctgtgtcaagtcaaataaagacagtcttgtgagaggagtcttccagggaaccactagacaagtcaaataacaacaattatttgggaatggggctttgctggagttccaaccccaatctgttccattcagtagctactaggtactggtttccactgtaattgctagatgttggtttctttcttttttctctctctctctcttttttttttttttttttttttaatgatagagtctcactctgttgcccaggctggagtgcagtggcatgatcttggctcactgcaacctccacctcccaggttcaagcgattctcctgtctcagcctcacgagtagctgggattacaggtgtgcaccaccatgccctgctattttttctttattgtatttttagtagatactgggtttcaccatgtcggccaggctggttatgaactcctgacctcaagtgatccacccacctcggcctcccaaagtgctaggattacaggcatgagccaccgcacccggcctagatgttggtttttaaggctactgtgaaactggggaggggggtgggaatagggcaatttaaaatgccacagagcttactggttttactgagattcagccattttattaaataaatgctacctgaattgctgtaagctattggttaatttccagagttctaaagttgattccgatgacttttgtcagtgttcttgttgcttttatagaggagagcatttttagaagttcttactctgccatttttactacatcccctcctagtatggcttcttgcatgggaaaatgattcagtaaaaactaagcttgacatcaaacagtgtactagattaggcaagaaattggcatagttaatatacaaatctatatgaaaggtatgaaagtataaaaatgagcaatggacatgaaaggattaatcacagaagagaaaatacaggttgatgttaaagtctgaaaaagaaagttcaacctcaaagaaattaaaattaaaacaatgagctaccatttttcactatcaaatcaataaagatgattatagttattacgattcacaatattggcaaagatgcagtgaaataaacatttaaacactattggtcagaaatataaattggtattttctttcaggaatttaatttggcaataatatgaagtcttttaaaaataccatgtgaccaaacaatttcatttctaggtatgtgtcctgagaaaaaagtatagttggatgaaaatttatataaaaaagataaccattgcagcattatatgtaatagtaaaaaatttgaattaacctaaatgtccaacaatagtagaatggttaaataatttatattagatccaccttagatttttttagtcattaaaaatactgttttagaagaatatttagtggcattgaatattactatatagtgctaagcaaaaaaataaagatttagtacacagtgtgatacaaattttaggagaaaaaggaagaaaaaactgcagaaaaatatatcaacttgttaacagtttatttctgggtacataggatacaagaggttttattttctcattcatacttttccattctctccaaattctatccattaaggatttattactttataataagggatgtggcaatgtatataaaagtaatgatctgacatttgtatgcaagataggtaagaagcagcagcaagttagagtggtagtgggaatgggaaggaaaaagcaaatccgaaagacgttttataagaagaaactctaggatatgaaacagatgcagcagatagagggttttcagcataatcaaaactaggataggtaagaagaatcctacttgataggggaaagaagatattcagttttggacaaaattgaggatgattcatatctgagggctatttctttataggtagttggaaatacagatgaagttcgttttctttcgttttagtatgtctttgaaaattatgtaggcttttttcagattagtgataattaaggtttttcactcttcgaaattagagaggttttgcttattatgttctgtatttattatattactgcttcacttttcttgaatgttactttataaaataactgattatcaaatgttagcctgacttcaccttgttttgccttggactggctcagagttctcatgtttccactgttattacactattattactctcagttgttcttgttgctgtcaaaaactattatgtttgaagaagtataattattacttgagcaatatttgctttttaatactgttttctatgaattttaggcaatgaatattttgacttcagtgctgcttctatatgcaaaagaggaagaagctttttggcttctggttgctgtatgtgaacgaatgttgcctgattattttaatcgtcgaattattggtaaaagaaaaaccacacacacacatatgcatacacacacagagatgtatatttcctttctaaacaatttcagtgtctcttgtctaattactaataaagtagaaggactgatggattatgttgtggtataaaatgcaagcaatatcaaaatgtcacattcactgacattctcaaaagaagagctttttgtactgaatgtatagtcagaaagattgtttaatatgttgcttttaaaaataaaatacctggtctgtttcttaacaaaaatggaagcattaagtttataaactctatgttgctaaaacaatggtgatctcaagtatccacagctactggtgaatttttgtagttttttgatgggagggagatttcaatctgcttaaaatctccatatttgtatgaattatatagatatttgcaagatttcaaagaaggatcgagttcttagtttgttaattgtataatttttattttattttattttattttattgagacggagtcttgctctgtcgcccaggctggagtgcggcctcggcttactgcaagctccacctcctgggttcacgccattctcctgcctcagcctcccgagtagctgggactacaggcacccgccaccacgcctggctaattttttttttttttgtatttttagtagagacggggtttcaccgtgttagccaggatggtctcaatctcctgacctcgtgatccacccacctcggcctcccaaagtgctgggattacaggtgtgagccaccgcgcctggccaatattttctttaatcatcaaatatttacagatctgtgaccacttaccttaaaacttatgaatggtctctttgtaccgtaataggctttcaggattgtggttaggtcatcgattttactgtctttcattataattatttgtgtattttttttttttttttttttttaggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatg

SEQ ID NO: 3553 - DNA, 37611 bp, human
gccacgctctgcacagtctattttcggagcctagccagagacgggaaaactgaccaaggtgaggaaactcgaacctcaagacggggaaagacagggtcctcagatgctgtggctatcagaaaaactagggagaactctagatatttataactctgcgagataccccaaaaagccacaagttgggcaaggtggagaagacccgttccctaaatcccgctatcctagactcttcactaaatcccgctatcctagactctagaaacaggacgctgctttaacaaaactcggttttacaggatgtgagtgaaagatggatgctgatcgactgtcagaaggcaaaagtaaacatctgaaagtttcccaactggtcttctctcaactctcacatgcacttattggttctcccttcccattaataatgactaatttgggaatgtaaaccatattttcttataggaggacctgggtgctccaaactggagcagccactgtacccttctgttttatatgtgcaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaagtattacatgtcgtttgactgtaactatcaaaaggtggggaagtgtgaccaaaaaaattaaatctgagtgaagggagagaacctagtttgaccaaagagggaggagtcattactccttaagagcttcttgtgataaggattcagaacagagaccatatttcctgaagaaaggaaaaaaataggactagggagaaaatttaaagcacagcaagaaaatttgccaggccgagcgcggtggctcccgcctgtaatcccagcactttgggaggccgaggcgggcagatcacttgaggtcaggagttcgagaccagcctgggcaatatggcgaaacctggtctccactaaaaatacaaaaattagccgggtgtgttggcgcctgcctgtctggatgctgaggtgggagaatcacctgagccctggagatcgaggctgcagcgagccgtgatggcgccactgcactctagcctgggcgacagagtgagatgtggtctcaaaaacaaaagagttctcatactccacctgtatctaaaaagagtccctccaacttctttttagatagaggtggagtatgagacttgagatagataaacgaagagaaaaaaatattaagtgtattgtttgtctgaaatgtactatagagcattcgataattcaggatgggttctacagataccaaggatttgcctctccatattaaaactaatttttctgtcaactcagcactttgagagtcctaagcgagggatcacttgagctcaggagttcgagacccatctgggctacacggtgaagccccgtctctacaagtaataacaaaaattagccggcgaaaccccgtctctacaaataacacaaaaattagccaggtgcagtggcacagcctgtagtcccagctacttgggaggctgaggtgggaagattacttgagccagggaggtcgaggctgcagtgagccgagatcgcgccactgcactccagcctgggctacagcaagaccctgtctcaaaaacaaaaaaacaaaaaaacccctccattttcaaaaaggattgggatggtacagactccttatgaataaatgactaaaacagaggaaatattaaatcaaaagacgcaatttttttttttttttgagacggagtctcgctctgtcgcccaggctggaatgcagtggtgcgatctcggctcactgcaacttccacctcccgggttcaagcgattcttgtgcctcagccacccgaggagatgggattacaggtgcgtgccactatgcctggctaatttttgtatttgtagtagagacggggtttcaccctgttggcaagctggtctcaaactcctgacctcaagtgatccgccggcctcggcctcccaaagtgctgggtttacaggcatgcaccaccgcgcccagccaaaagacactttttttgatttagtaatcaataactatttaatttcttgacttctttttctatgaaagattctaggtactttcaaaaagcatcttccttaaatatattttaaatttgaaacgaaaactgttaagttcccatagttacttatgagttagtacatttgatggtagcgaaagttagagacctgaaaaagaaaccattcttagtattgtaaagataaattcaaaatgaattatttttaataggtgggaaatcattgatgagtatagttatcaaaaaatgcaaagcagaaagcaattagtcagtatattataatttaattcagacataggcagagatgatatcactgttgtgttctcaagaattttaatggaggaattgctaaataaggcactatataaataaagttgcttcaatctaggaaagctgatttaaaaaaaataaataaataaaaataaagttgcagaagaaatgccaaatttatttagagaataaatagattttgagtacttgcaaatcattgtgttaaagtcagtattttacatagggatatatctatttacttaaacaagttccaaaaggatattgcttggtgactttttttggggggcagggaattgagtttctctctgtcacccaggctggagtgcagtggcatgatctcggctcactgcaacggccacctcccaggttaagtgattctccagcctcagcctcccaggtagctgggattacaggcgcccgccatcatgcccggctaatttttgtgttttttagtagagtcggggtatcgccatgttggccaggctgatcttgaacttctgacctcaggtgatccacccaccttagcctcccaaagtgctgggattacagacgtgaaccactgcgcccagccctgcttggtggttctttatcaccctgattttatttaccatatatacttgaattaataaaatctattatctatttgaatagtctgtaattcagagttttcactaatttaacctagacttttctacaattaactgatgtcaaaagccatctttattgatactgtgaaggagacaaataaaatagaaagcatgatcccagccttagaaccagtctgactttaactcaaggttactgatgttgcttaagtgctgtgggtctggagccaatctggttgaactttttcagcccctgactggctccagtgttatggtaatgagctggttctggagtgtcagttgctttagctcattgtggctagtagatggtccaatcatgcctctatttatgaagaccccaagtactcaggttaatgtgggaaaatcaaaggctctgtctggaaaatgttgccattagcattggcctagcaaaagagaaggagagaaagaaaaacaaagggcctaaaaaatttattttctaaatacaaatctcaaataaaagacagtaatatattttgtttttactgaaactcttaaattttccttactttaagtttattcttggcctatttaagtgacagtgccagattcaaacattttaggcagtgtggctccagaatcttctttttcattttttattgttattattttatttatttatttatttttgaaacaggatctcactctgtctcccaggctggaatgcagtggcccgatctgggctcactgcaacttccatctctgggactcaagcaatcatcctgcctcgggcccctgagtagatgggaccacaggggcacaccaccgcgcccgtctaatttttgtattttttgtagagtcggggtttcgctatgttgctcaggctgatctcgaactcctgagctcacgtgacccgtgagctcaccttggcctctcaaagtgtttgcattacagacgtcagtcagccaccatacccggccagaatcttctttttaaaaatcgctacactgtactatccaataagtcagggcaaaaggaagaatgcactccaaggtacaaaggcaggaaattatagagtatgtttaataagcagtttagtttttaacagaatatgtaggagaataatagaagggaaggacagaaaattacgttgggactatatcctgaaggaccttgattgccagactcaggatgaacttaaatgtatatcacatttagaaataaaagatagagctataaactaacactgcatagttcattgtagtgaagatagttccctacaaatagttctttgtagttcctaaaaagtcctcctgttttagtttttcagctgtgatccacttgtgtcaaatgaattttaataaatgttttttaataaagttgaataagttattctaaatatgttagacttcttaaaaagctagtagaatcttcctttccattgaattttgaatgtttttttctaaaaattcacaaactgtttttctcttttgatactttgaaccatttaactagttagtcacaaaatatttgggattcttttgtttatcaaaatacaatatcaacaaacttgtcatgattgatttatttatttttgttgtcatgatttattaatttgtgtttacagattattattacatttgatatggcaaaaatattttggctaaagtggtaattttattattatatttctattttaattgagctatagtgcaaatctatggcattttattccagcataatttggaagtccaattgtactttaagaagtctaactcctaatatgcttcagatatataaagtgttactaagaattattgtgaataatttaacaaaaacaagtgtacacgttccaaggaggaccatccccttcgaagtagtcactttaggagactaatctatttactctaatgttgttgttattgctaaaattgcttttgaaacttctgttttagaatcaccttgaggcatgtagcacattcttttgaatatcctcaaagaagaaaatcttcatattttgaaagtagacatgatatctaaatatatctagaaatcacttggcgacaaatctgatgtgtaatcaaaccaaatgataccataatgataccataatgatacctattttcttggtgatacatatgaaggcaattccaaataaaaagaaaaatcccaaaatattttgagcattgatagcataatttacatcagtgtataaccttccaaatgactattttgaaatataacattcagatgaatttagtcatgcttcatttggtattaatcaactgctgactatgtgccagctgcagttattaaagacactaaatctacaggtatagcttcccactgctcacactggcctacttcccacctaatgagaaccaggccagagttcctttccaaataactggtagggattcagaattaatctggtttttctgaatccagtatccaatgtaccaaaggaaccataacattccttcataacctccactgtgggtacctaggtgacacgagaaagccaccgacacagtgcctggtttgttttctcttttccagctggaactttgagccctattctgccctattctgaaccttcatctctagtagtcaacttgtgcacaaacctcaagaactgtaccccaccttctataggccagcgtccttcttcactttaaataggtctccctgtaaccatgacttcaacctttctgccctgaagcactgctcatgtctaaaaaatatgttcccaaatgatgatacataatgtatcatacactttttctagaggtagggcttaagaatctgcattttaaaccaactcccccaagtgattattaagcacattaaaacccgagaaccactatactaggtgctcaataagtgcttgttagcttgagtatgacattttagtaaagcaggctgaatgtttgagtttacttggtgctccaggtctgtgagttagcaaaatacatatatttgaaggagtttaaaaggatttccaaggaagtataagaaccaatggagtgatccagggaaagaagggagatatgacaataaaacatcttcatgtcttaaataaaacagaaaagtaaaatacctctttctgattatctttttcttcagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacaggtggtcatatacttaacagttgaattagttttgttcatgggaagttgtggaactgtatttgaataacctgttcccacctagctgtgggaacagagctgtgtcatttgatacattcacaggaagctacaaggctgattatgcatgacaatgtaacctgtagtacatttctagcaaagataattatatttttctaaaccacctgaacactgaataggaaaatagttctgtaactgtggtagcaatagccacatctcaaaatgttgtcatttatatttatagccaaagaatgcttgacaaccattgcagagtggtagctaggattgtttaagcctaggcaatatttctataaaacaaatattttcagttatacagtattaattggaccaccaagtaccagtcccttaattttttaatttgtctacacattaacgcagaacagaaagtttttgagccaaataatagggcaaactagtttcagcctaccaaaattggcttcccagtaatgcacaaataaagttgtggagtctaattagttgagtagcatttggggtcaagataggtaatgccagcaaggcttgcagtagcaagatgggcttcattttgggtagaagagttcattgaactgacctttgaccactccaaggttactgccagtattcccagaacaattaaaacacttttatataactccctgctctccattctcctatttcttaactatcggtgagccttggctatcagactgcctatgatagggcaaacaaaatttggggcaaaaaatcccatatcataacagaatctgtcaatttgcataaaattattttaatgaagtgttttgttatatgaccaatttatcatgaataaatcatctttcacaaacgtacatatcaatttactcctcccaaaatttatttttgccacaatgtggagaaaaaagcaagctatgaacaggcagcaaattcagtggctcagattgacactgaactgagctaccaccctaaggaagagcttaggtggaatagggcagaataaataagatgtgaaatgggaataacatttgtagaagaactgagtcagcttggagccaggatcaggaaccaggaagttttagtcagggaaaagtcttagtagaggctaaacaaagaaacatcaggatgttaatgacagcattagctatacacaacaaacaggatacaggagaaaaagttaggaacaatgtatcaatgaagttgggaaggcaagctcatttttgctaccttagttgagtagcagaataataattttctggagcctacatcctaggaaaggtaaggttatgccatatagaaaaagtatatcaagtatttgagaaacagtgaccttgaatatagtgaagtggaacttgtaactgggacagattcaaatataaggatttaccctggttacagagcctattccatttggtgtttatggctggaggtgtttatttgcatctagaggtgtttctaggagaaaagatgagtgcttatgagaatagactaacataatattactgagttgtacagtttataaaggaaaattactataataatgtatgattctgtatatctgggttataaacaattttgagataattggtcattcagacaccacagtacagatatcattagaggacatacagtatcagaacagtgggagaataattaatgtttctaatgaactattacattttccaggagagaaactgcttttcattttttaacatgtattaatcttgggaactgtgggatgattacaagagtgatgtgtttttgaaaatatgctctctgaaaacagcaagagaacagttgcatacacattgcttcatttacactatcccttttctatatgacttgttaagaatctgggagattgaggagagagtgtgtctgtcatttttcaaagccatgaggggatcttaaggcctgtgggaaataaggttcactgctcttcacagacattataacgaggatgttctgtcttacatattacaaagtggcatgaattgcagtgataaattgctcagataattggctgtagattcatggtaaaggctcaaatgatgttctaatagaaaacaattgccagatggtttttaatgtttttatgatcccattccatcttttaacttgaaaattttatttttaatcatttattttcattaaattaataaattgaaactcccatgtgttctgagccaatcactgtccatggaaagtataccaatttttgtcaagaatgtccaaggttttacttctactgcttttaattttctgtggaaggcagcactcaactaaacaagaggccctcatgttctgagaaatgctttactctgactattagtgttctgatgattaataatttaagaaaagtactacacatttacatgacattagtgattaaaaaagagggaaaaaaatgtcccaaatattatcttgggattttcacataaaaatgcctgtaatgccttaaccgcagacatagcacttttgaaacaccttttggaaaggaatagttactgtctcagacactgttgagagattatagattaatttctgatttataactcttggaatagtttcacataataaagacccacgtgagctgttccatcagctttcaagaacagacactactctccttgcccaaacaagacattctaacttttgtacatgtctaaagtcttaggagatgaggacaggggcctgagaaaagagagatagaggtgctagttggccagtaggcaaggagataagaattttttgactgccagcagtggagtgagttggagctgcagggtctgtcatcagcaaaaaacaattggtaagaaattgggattttcttgaaatatcaaagaatccctgagacgggccaatgaggtggtgtcgctatgtgttatacttagttgaaaaaaatgaagattgcttgtattggtgagtcagggcaagtcctttggggatgtgtatgcttgtgcagaagatggaaaaataaacttatgaagttatgaagactgaagtacatcagcatgtattagagactattaatttgtggttgctgtttaaatccactagttcagtgtcatgaggcggtgggacagggaagtgtttcatacctatagtggaaaaaagtaaaagcagttatcagggcttttgaatgattaatctgaagtctgaatacttagcttctgcttagtgttagtttttatttctataaaactttcacatactctgtcctccatctgactacaaccagacactgctaaaccccaaaagtgtcaatgcctttatactaatacttggttctaaccttcatagagatgaatgtggctcgttcctctatccccagggatacatgattcactgagctggaactagggttttagcctgactaaagatcaattctgctcttgagtctattaaaccaaacactttttgaaagaacaaggaaagcatattcgaaatagtacttgacatctgtctttctgttttataacaatgatgggtaattaaagtggaaagctccatgagtttttttatggaaatcctatcaaatttaaagtatcactagtcatataggttatacaagtattaattacagaatattgaactttttctcctccctcagacaaatggtttatctactattggagccatgggtcctgggaatattggaccaccccaaatagaagagctcaaaggtaagttatttaacaaagcaatatagatcaatataatcttttccttggtagagaaattatagggagagtaataagtactaatactagtatttattaagatgaactaaataacaatgtattgtatacttggaaattgctaagatagtagattttaagtattctcatcacaagtaaatgataagtaggtgaggtaatccatatgttaatcagcttgagttagtcatccactgtgtatacatatttcagaacatcatatggtatatcataaatatatacaatttttatttgttcattaaaaatggagaaatgaataaataatttttaaatagaaaaaagatgaactaaaataatcatggaaatgatgaatagccatttacatataaagatgctgtttttactctaccactgcaggtaaatagtttttctaataatggaaatatatttgccttgaattatccacattccttgcatattttctgagatagaagaccaagaaagtcacgtgtggttagatcattttttattttttaaggtctatttaccaagatgcttagcttctttaccttctaccttcctatattctagcaatttcatggaattcattcattgaattgtttaataaatatttattgagaacctattgtatcaggcagtatgaccatctctgatactacaatgcagatcaaaacagaaaaagtccctgttctgattgagctaatagacttttggagaagacaataaaacaaataactacacaattttatcttacattaagaggcttatacattaacatctttgagtttacttataaaaaaaagtccaataaataaggctaaataatatttttacatttccccagcattttgagctatacatttttacagagttgaacattttacaaatctttaaaaatataaaaggctctaattctgttggtcatgatcaccattaaccagaggataggaagggagaggaagtgaatttcattcatcaatttagttaattgcaaaagattaatctggacaaatgtttaaaataatggctaaaatgaggtctaaggatggttttaaaatttcagttattattgctatacatactcaagaggctatttgccttacccaagagatattcgctccatggcagtctaattcacatttcatgtatttctgtgctgcctgtatttctgataatgtaggtctaataatctttaaattctgaaggcaatgattcatatgtaaaatgttatatataaatctgtagttaggctttacaaagcccgtgctagatagaagctgatcatttcaaaagaattgccagaattgaaaacctaacaatcgggtgcatttctgggaatgcttaaaatgactcaaagcagtgctctgcacctaatgcaggtctccaccggatgctacaatagttaaaacaaatgtgagctgggtttttgcatgcctactggagcctatccatttttaaacatttaaagatgacatgcagaaacccaacctcatgctcagctctgcatgaggaaaatgctggactaaaaaatgatcattgtatccactgctttcagtttctttaattgatattattgagaattatgtcatgcttgcatggaaaagatatcaaagcgtttttatatagtaaaaacaatgcaagataagacatttctctccacatcagattgattgtagttgtaattttttcttttatataaaaatatttttaaatataatcctatttatgtttctggaaaaatgtgtaatatttctttgcatatgtatatggagagagagagagagagagactggaatgatacacaacagaatactaacattgattatctccaggcagttggattgtagattattttcttctttttgtttatgtttttgccaaattctctacagttgttattaaaattctacaatgtattggttctgtattgatagaaacatttagtcagtagttactaatttagtttgttttgatcaaaaaaaaaagctagcgattacaaataatgttttatttcaatgaacccaaactgagtgtgaagaagaacaggagcaatttagagaaggaaaaaagcatgagcttcagctttatcttccctttcttcacagtcatccctgaaaccagcgaggaaaataatgaggacatctggaattcagaagagattccagaaggagcagaatatgatgatatgtgggatgttagagaaatcccagagtaagtcaaatgaagccaggaatgtctttaggagtttaagttagctgtgtcatctgataacattttactttttacaagattcataaagtaacataccacataaaagataaaactacagtgacacacggaaggcatgtgtaattgattatttttttccttctagagcagaaacaaataataaagcataacaccttcctttcagttactatctagcaaaaatgaaaaatatagtcatttccattataaatttatatttaatgtcaatttgttgtataatgtggaactagcagttggagaaagccagcccattaaattgcaagcattcatacaaactaaattacaatgccatgtttatttgtcaagcacttgcttttaattactcaatgttccacaatttcggtaaaaggctatgttctctctccaattatcaattattacccagacttgtttactagatattctaagattatatttagtgttcagtgtattttgcaagcagggttcaagacttgctttgtagccttttcaatacaatcaagttgtaaatatgaaatttagaattattataaaaagccttttattctgattttaaaagcactcatacttttaagaaccttaaaatatatttatatacatagattaaattattggtcaaatagactaagctttacatatgtgtattttgaaataaaatttggattgactatttagaatagcaggaaaaataaagccaacacttactaaattataatgtactatataaattcttaaagacttctatggcaagtgatctgacaacttttctaatactgaatacaaaactatccagtatttttttttttttttagacagagtcttgctctgtcgcccaggctggagtgcagtggcacaatctctgctcactgcaacctgcgcccctcctgggttcaagcaattctcctgcctcagcctcccatgtagctggaactacaggcacctgccaccacgcccagctaatttttgtatttttagtagagacggggtttcaccatgttggccaggctggtctggaactcctgacctcaggcaatccgcccgcctcagcctcccaaagtgctaagattacaggcatgagccactgcgcccagccaaaattgtccagtataaaacaagcaaataaacaaaaactccatgcttctgccttctacataagttctgaaaacagaagcagtgggagactgcagacaattaactagaaagaagtatccagctttcaaataaacaatgtcaagaccataaacctcataaaaaatcaaaggagattttaaaacatttcttagagaacgaagagagtaaatttgaagttatgtttatatagtgtccacgtatcatatgaaaagtaataattaagtcacttatttgtcatattgtctaacaaatgtcaaatatccatatgcagcaaacttcaaatttgagtaatttttcccttttcatcctgatgtttgatgttaggtagatagaacatccatgaaagctttaaatgaataataacttcaggttattatgaggaaaattgctttataagattttaaaaatcttcatcttctaccttatgaaaatacatttcaacatttctcagtggatgcagaggaaaataggtaaagaacatgaacaggcagttcaaaaaagaagaatcacaagtggccaagtaaaagaataacaaggagctgagctaaggcactggccttggggagaagtatgagggtctttatttgagtgagttttggatgaagagttggtatttggttagataaaatggatgagaggagagcgtcaaagatgatgctgaagttattagcttgggtgactgaggaaatgataatgccattaactttgataggaattataggttaagaagaagcagtgagtttgtttttgttttctttctttctccctttctttctttctttctttctttctttctttctttctttctttctttctttctttttctttctttctttctttcttccttttttctgagacagagtcttgctctgtcgctcaggctggagtgcagtggtgtgatctcggctcactgcaacctctgccttccgggttcaagcgattctcctgcctcagcctcacaagtagctgagactacaggtgcatgccaccaggcctggctaatgttttttgtgttttttgtagagacgaggtttcaccaagttggccaggctggtcctgaactcctggcctcaagcagtccacctgcctcagcctcccaaagtgctgggattacaggcctgagccacagtgcccaaccaaatttgttttttttcttcgccaaccaccgcccccccggccccgcccattgttcactgcagcctcaacctcccgggctcaagcaattctcccaccttactctcccaagtagctgggactacaggtgcacactttatttttgtgaagactgcgtctaaccgtgctgcccaggctggtctcaaactcctggactcaagcaatcttcctgcctcagcctccctaagcactagattacagttgagagccaccatgactagctggtttttgatatgtacactttgagttgtctttgggacatccaggcaaacctttgtagtagacagttggaaaattgcgtctggagctcaggataagagcaggagcttgagcaaatccattaggagcaatgaacatatagatcaatcctctgtttgttttaacctggcttcaccttcataaataattggtagatgttatagcctattaagagaaaagtgccccatagcaaatagctgcttattgttagccatgttcaaactcagagaaatcccttttttatttttgggcattcctattggcaaatggtcagaagttcaatcaagtcctttagtcttactatccagagatctacaatttcttcattaaggtagcattaagcataataataataataataataataataataataatttgtaaatatttgtttcattctatctgaagagatggggtaccttgtggtgggtgcttctataaaccattgtattcctggaggcccaaatttggagggaggaatgatttgtgaattgtcatgtgtggggtgaaatatcaggaaaacctttcattacactcagaattctgtaagactagattctaagcactatggtgtagctgtgctgactacattaccagtgtttctattgtagaattttagccgtggagatcattcagttcaaactcacccctccctcccataaatcatacaaatgtagaaactgagaccccatgagtttgtgacttgaccaaggtccacagttaatgacagaaacagtactaaacctgaattttctcctctgctctgtggtttaaacttggcagaggaaggtttctatcaatccctaggttatggactcagtatttttctgagctattgtttttcaggaacagactttccttttttttcttctgcttttaatcttattagaatcttattacaagttccctcaatctattttatttgtctagctctgaaacagttaaagctttattttagaaaataataacaatcctgcctttcagtgtttattttgaccacatttctagacttcttttcctttatgttctattatatgcctgaagacctgcaagcactttatttgtttagtccttttattttacctaatagcatatcctcataagttactagttttcttttctgtgacaggaaattgctctttcatctgagtccctataatcattgattttttttcaggtatgagattatattcagacagcaggtgggaactgaagatatatttttagggttgtcaaaaaaggactcctcaacaggttgttgcagtgaactagtggtaagcctctcctccccttcttcattttctatacaaccattgtagctaaattgactgactattatttacataatattgtaggcaaggttgtaaactctttaaaaatcgtggttgctatgtttcacgtactagggtaacaatgggatagacagtttaaaattgttaacttgtacaaaataaactaagtttacacatttggatgagatttacaaataaacataatggaatcatatgacacaatacacaatttctatttttatccctattaaaacttcccaattggattggactggattttcttccatcctagttccgtcccatgcatgccaactgattggttattaacttatgatgaattgacaggcaatcagaatgaagtatctccttccccgcatctgtcttatctcttatttctgtatttctcgtaatgactcagcttacaatgtgggacttaaaaagggattttcttaattttgggatctgacttctgattaaaaacactaagaaagacatctaaaatgttactttgctttcttatctgaatgacgctaccgaatgttggagagcatcctttaccaggtcactgtttctgtataacagttgtggcaataccaacaatatcaatgataccaccttacttttgcttatttcatcctgataatgaccttgttgaaaaatctgggcctaacccagagtgtggaatttgattcattttagcaacattaacaagtaattcttgtgttaaaattttattttttgagatcaggaactttgcttctattttttttcctcctttcttacaatacattatagaataccatggtgcccatgggagatgtgtaatatttttttcttaagcaaatgataaatggaatttctcttttgcatgaacttcaggttttctcttattagcaaaatctaagacattcaattcaatcaagtaacataatgggaatagtggctttaagtacctcaggagatttttcaaactctaatgagttatgctttcaagtaatcttgaagtaattagctcccagggttttaccagtaatattcaaattcctctcttttaaattattgtaaaattgtgtttttgatgtgtaatgttggggattgctctaaattctggaggaattctaggccctaaataaataaaactgttgcaagccttacagtttatctcatgcaaaaattgccactagttttaataataaaggtatcctgaatgaagaatcttggaaactaaatcatacctcataataggaatatatggtttatctaaaactcaataagtatatacagaagacttgatatttctctcaaatgaatttataatcaactggggagacaaaactaacataaatgaaccaattttattattaagaattaaactcagtgtaaacaattataagtcgaatagaagttcagaaggttgggataagtcatggacaccactgaaaggcagcagcaaataacacatttgttgatactgtggcactttgtcacgtgtatactgttccttttctctttctttcctttatttctctttgtttcttcatttattacatctttaaatacttagtgaatgttactacataccagggactgtcctaagtactagagatacaaaaataaatgataaacaatcaattgtcctcaaggaatttacagtaaaggagattgacacctaataaatcactgcagttcagtatggtaagtacatatttagaggcaaacaccatgaacagaatgatggttaccagagactgggaagggcagtgggcagtgggagttggaaatgtggggatggttaatgggtacaaaaatatagttagatacaataaacacgatctagtatttgatagtacaacagaaggataacagtcagcaataatttgttgtacattttagagtaactgagggagtacaattggaatgttcataacacaaagaaatggtgaatgatttaggtgatacaaacccaccccatttaccctgatgtaattattatacactgtatgcctgtatcaaaatatctcatgcaccccataaatatattttcctattatgtacccataaaaattaaagatagaaaaataaagacatatatcaggtacatagtgacataaagcaggaagagatcaacttcaagtggataatattactacagtggacaacattctaaaaagggcattccaagcagaagtaagagcacgtggaaaggtatccaggcatgaaatagcatggcatatttgagtaaacagagaatataacaagaataaagagtaagtgtcggtaataatggactagtaagctgactctcaaaaaagataaaagcttgtagcttttatttgtagcttgaatgttatcctgtaggcatactaatgatgacatccactatcattgcttactccactgacaagactcagagtaaataggttgttgagcccatctcaagtatttcttgctcaaatgtatatgcttatcattcttcttgataatatggtgtttccttgaatctaagacatcataaaattgtaaatgtgccatttatttaacaataacaatgtttcagaggaaaatagttataatgccatattataccaccattgattgtgcagttcgtctcaatatcataaacattaaaatgtggggaaaattgtacctgagaattgcctaaatatgttatttgtgtcctggacctggtctatatgtaacaatccaatccaaaaactttaagaaaaaatccttacttaaaccgagtaaggcaataggagtacaatctgtttacgtacaagaagtgatttggggtttaaaaattcacaaggaccatcctttcctttaccctccccagactccaaataagaaagcaagatttatgaatcctaaatcaaagcaacggtcctaaacaaaattatgaattaggaatgtcttcagcaaacccttcgaacctcaaacccaaagagccccattaaccaaacactccctgccctattgttatcctctgcaactgctttactcctgagtttgtagccaccaagtttcccttgccttaatctatatttaggtattttagagctagagctagccagtggtttacaggtttgttttgttttgtttctagctctcaagcttttttctttccaaataaaattctatgagtaagcccagtgtaataaacataaaaagtaccactgccttgtttaagaaggtactatcacccatgaggcagctcttaggagaatggctgaggctccttggaacacagttagaaagatgctgatctaatttctcatcctgatattacagttgataaactaaggtcaggcttacaaggtttcaaatactcatatacattaatggaagaataataagaaatctagagggcttctttttccttggtgacatatatgcttttctttaaaccccacgagtggaaggccctagcttatttcattttgttttggttgtttttctttttatcctctagccatattctccatccctctccccaaagctctcactgtaatgggtgtgatattaggttggtgcaaaagtaattgcagttttgctattgctgactactggttattgccagactgactgaagtactggacctcttgggtgccagctgaggagcatggaaaaaagaactataggtataaaaatatgtagcaagataccctaattctccataggattatttgtggcaggaaatgggatgggtgtattggaaaaataggtcagcagattctcattttcacccatggtgccaaaatccaaaaatgaatgggcctagggttattggtattctgccaaattaccctttgtttgttctaggagaggggaaaggcagcttgcagatagcttgatgctctttgacctagaatgaacacatattttgatgttttactttgatagatctatattgataaggcgacattctgatatgacccaagaaacaagccactaagcctattttttcccaacatcacctcctccctaggatatgattcttcccccatctttaaatctcactgagaatgggatgagagtcagggatgggatagaagtcagtcaccatctggcaggcagacacaaccaggagtcacatgtttatcatacatatttatctcagaaagtgctatcaatcattttgagcaaagtatttgctcatcctctaagaattcacttgcttcctgaatggtctgctcttcaaatcctgatttctttcttaaggttaaaacagttatatttgtttacttttttattttttgagacagaggctcactttgttacccaggctggagtgcagcctcaactcactatagcctcggcctcccagattcaaacaattctcctgattcagcctcccgagtagttgggattccaagcatttaccaccaagcccggctaatttttgtatttttagtagagatggggtttcaccatgttggccaggctggtctcaaactcctgacctcaggtgatccacctgtcggcctcccaaagtgctgggattacagccgtgaggcaccgtgcctggcctatatttgtttacttttaatgaaaaaatgtatttggctgcttgataatgaaataggttttgttctccattctattcccctctagaggatggacctagttttttttttttggtaggcttcctgattatgttaaccttgtttgattggttgtataccagaccatgtggcacagggaaggatatctgatctgtactatgattccttattgtcagttccaggcagcacagtaaaccttcacttaaatttctaatcgctgtctcagtaatatattcataatatatacatttatagttaatgtcataacactccttcataatgatggtggttgtgggacatggtaacaaatacttccttaaaagctaatctaatcatatagacagtatatttctgattatggaagtaatatatatgtaaaattttaagcaataccaaaattagtagagttgatgataaaagtccatcataatgagatggagaaaaattgagagagagagtgtgtgtgtgtttgaaataggctatggtcaaggatggaataaaggtaaaagatgtcatatacatattacttcatatatgtatcagtaattttacattttgatgatgtcattttgaggtttcatcaaaatatctgaatcacatggtctggaatccttgagctggacctggcagaaactcccgattccatgcaagcagattcacagattgaccttggaaattaccaatacttgagggatcaataaaggtagaggaactgagaaggatattcagagatgggagggaaaccatagtagtatccgctgctgtcaagcaggattaggatgcagaaagaactttgagatttgtcagttaagaagtctttggtgatctttggaagagagcagcttcagtggcatggccaacaccagattgaagaaagctgagaagtgaagaggaagtgaggaagagaagccagcaaatatagattgttctttgaggaagtttagtggtgaagaggaggagaatgaggaaatgatttttgagaaggaggcaggatttaggggagtttttttaagacaggagagatttatgtatgcatttcagctgatgacaagaatccatgcattcatccatgtaatatttatttagttcctactgtgtgtcactagagctaatgaacaaacagtaaaaaaaaaaaagtagtcatggtgtgggcccctaggtggaggcatttttggttgtcacaatgattacagaattttttgtttttttgagataaggtcttgctctgtcacccaggctggaacgtagtggcttgatctcagttcactgcagcctcaacctcctgggctcaagcgatcctcccacttcagcctctctggtagctaggactacaggcatgcaccacaatgccctgctaatttttcttttttattttttgtagagacagggtctcattatgttgcccaaactggtctcaaactcctgggatcaagcaattctgtcacctcggccttccaaagtgctggcattacaggcatgggcccccatgcccagctgattacaggatattattgtcatttagtattcagggccagggttgccttaaatcttgcaataagaggtatagtcctcaagaatgaagagttgtcctacacaaaatgcccatattgctttcctctagtttaaaaacactgattagataaagagggattgaagatatgagggtgctgctactcagcagcattccaccctgttgactactcttttttttttttttttttttttttttttgagacagagtcccgctctgtcgctcaggctggagtacagtgatgtgatcttggctcactgcaaactccaccttctgggttcaagctgttctcctgcctcaaccccctgagtagctaggacaacaggcacgcgccactacgcctggctaattttcatatttttagtagagacgggttcccaggctggtctccaactcctggcctcaagtgatctgcctgcctcggcctttcaaagtgctgagattacaggcatgagccaccgcacccggcctgctctctccttgaaacacagttttctctttactttaatgaccccattctcactgaggagtgaggaaagacttcactcttttcttccgaaatcactaggcattcctcctctctttcactcccaaatcactggctcttcctattctgccttaagttctctggagatttgacctatgtctttttttttctctacctattctcttttcacctagtctcatagctttaaatatcatttatctctctagtcctgaactctcccatgggctttggattcatataactcttttaactctcgctctgtcacccaggctggagtgcagtagcgcggtcttggctcactgcaagctccacttcccgggttcacaccattctcctgcctcaggctccggagtagctgggactacaggcgccccccaccacgcccggctaattttttgtatttttagtagagacggggtttcaccgtgttagccaggatggtctcgacctcctgacctcgtgatccgcccgcctcggcctcccaaagtgctgggattacaggtgtgagccaccacccccggcctcatataactatttacttgccatctcttacttgtttaatagacaactcaaacctaacatgtctaaaacagaactcttaattgtcttccataaacctttttctcattcatcttctttgtggcaataacattcacccagttgctcaagctaaaaacctaaatcagccatcattcctctttcctttatacctcatgtctaatccatcagcaagtattactggctgtaccttcaaaatatattctaaatccatctaattttcattaccactgcaattgctatcatgttactaacgatcatcatctctatctggaccattctgacgagtctctaatgacattatctccctgctttgactcttccttccctatagcctttccacacagagtgtaagagttcctttttaaaagtaagtcaaggccaggcacagtggctcacacctgtaattccagcactttgggaggctgaggcgggtggatcacctgagatcaggagttcgagactagcctggccaacatggcgaaaccctgtttctactagaaatataaaaattagccgagcatggtggtgcacttctgtagtcccagctacttgggaggctgaggcaggagaattgtttgaacctgggaggcagcagttgcagtgagcagagatcacgccattacactccagcctgggcgactccgtctcaaaagaaaaagtaaatcagaccatatcacctcttcgcttacagccctcaatggcttcctgttgcacttacagaacaaaatccaaactccttatcttaaaagtagggaagggccccgtgtgatctgacccttacctacttttacagtttcatccaatgtgacactttcttccttgtttgttatgttctgcttatcctgaccttctttttgatccttcaatatgccaagttatttcccgattccttgttattcattccacctgggtattccacctagtccctcagataatgaaattttacttcttcctttccaatcattttaacctatttcttgtttaattgcatgttagtacctccagaactatattatgtaataatagtgaatactgaactttatttcttatttctcactttaaatttttaaaaattaaaaaaatatgagtacgtaatagagatacactattcagccattaaaaaaagagatcctgtcatttgaaacaacgtgatggaactggagatcattatgttacgtgaaataagccaggcacagaaagacgaacatcacactttctcacttatttgtgggatctaaaaatcaaaacaattgaactcatggacatagggagtaaaaggatggttaccagagaatgggagtggtcattgagggaggggaagtgtggggttggttaatgggaacaaaaatataaatttctcactttaattggaatggttctagtgtttcttcatttagttagatactgatttttggggtatgtgttaaggatctgttcatctattctgattttaagagttctaagcaagaatagatgatgaatttaatcaaatgcctttttaccatttgtgaagatcatatgatttttttagtttttatctattggtaaattatattagcaaatttcttaatatggaaccatccttgcattcattcattcagtcaacaaatatttgttgagtgcctatgatttgccactaagtattttatgaaaactctcattaacaatgataagctgtaggaaaatgaaaaaaaaattaaaggtgatgggtctctgttttgaaattataaaaatatttacctctgaagtataaaaatgtagaggtatgtattgtccaaaaccagggcaaaaaaccagtaggtcatctttttaaattgatagataaatttcttttttttctttttgttttttgagacaaggtctcactctgttgcccaggctagggtgcagtggtgcaatcttggctcactgcaacctccacctcctgggttccagcgattctcccacctcagcttcctgaatagctgggattacaggtgcatgccaccacacctggctaatttttgtattttttctagagatgtggtttcaccatattggtcaggctggtctcaaactcctgacgtgaagtgatccacccaccttggcctcccaaagtgccaggattacatacataagccactgtgtctggccagatggataaattttgataatgctaccactttgaaacagtccagtactatattaccatacctgtctttttaaaaatagtttatagatgcatgactcctctcccatcacaggagtcaagagtcctcagaggcctcttgtggctttccacaacttattgtcccatatttttatggccagttcatgcaggcaccccataaacctttttcccaacatattaccatacctgtctttttaaaaatacttcatagatgcatgactcctctcccatcacaggaatcaagagatactgttctaagtatagaggatagcatagtaaacaaaacataaacatcactgccttcacagagcttaccttattgtggaagagataaataaaataaacacataaattgtattgtacattagaaggtgaaaatgctctgaggagaaaaggaggaggaagtgatagggcatactagagttggtggtggctgaaattattaatagtgtggtcacgaaagccttcactaagaaggcaatatttgagcagacacctgaaagagatgaggaagtgaggttccaatgttagaaagggttttgttgttgttgttgttgttgtcatttgagacagggtcttgctctgtcacccaggctggagtgcagtagtgtgatcttggctcactgcagccttgatctcctggactcaagtgatcctcccaccccagcctcccaagcaaatgggagtacaggcgcgcaccaccatgcccagctacttttgtattttttgtagagacggggtttcgccatgttgcccaggctggtcttgaactcctgagctcaagtgatctgcccatcttagcctcccaaagcactgagattataggtgtgcacaccacacccacactagaaaggttaatctaagtgaatatttaaaactccaagatttaagacaggaggtaatcttagaaatatcaataaagaacaagtaactattcttagagaaatcaggggaagtgtcccaggaattagtaaacgattccagcaagatgggtaataggtggtatcgtgtaagaacatgagtttttacgttgtatatgttttaggtgtacaacatgatgttttgatatacatattctcagtaaagtgattactacagtcaagctaattaatgtatttatcatctcaggtagtatcttttgtgtatgtgggggataagaccacctaaaatctactcttagaagagttccactacttggtataatattaactatagtcctcatgctgtaccttagagctctagatttattcatgctaaataacccaagtttgtatcctttgacctgcatctcttcatctcccaccccacctctagtaaccaccattcttctctctatttctatgtattagatattttttaggttccacatttaagagagatcatgccgtatttttctttctgtgtctggcatttttcacttagcataatggaggacatgagttttttttttaactggaagaaagggacaggcccagtgttataaaggaaataggagagaaaaaaaaactggcgccaactgagaagactataggggaagcagtgtaattggggagatccagatttcagttagattaagaagctgagaatattcaaagaggctaaagagataagggatgatgtactatgtattccagaggacctaatggaaaaggctcaggatttgatgagggatggaaaatggagacataataggagatatgaagatccatatggtagttatgtgataaggaatgatttgggagtctgagacttcttgtggttattgacaaatagagttaaaagtataatgaatttagttctggtggtctcaagacaggtagtggtggtgaggctatgattattttgggggagagggtgagtgccagtggagatgtggatgcctgtagatgaatgttcttactgcagagtgagttgactcctgtggtggagaggaggtatgcatctatgaagcatttttaaaaagacaggtgtggcaatatagtactggactgtttaaaaatggtagcattattgaaatttatccatcaatttaaaaacatgacctattgggcctttgccctagttttgtacaatacatacctctatatttttatccttcagaggtaaatatttttataatttcaaagcagagatctaatgcctttaattttttaaaattttcctatagattatcattcttcatgagagtttttataaaatacttagtatggctgcagtggaaaaaaatatcttatacatgtttctgtagttaaacaatgggaaattaaacagttgaagcaattcagaatgaaatctacccaaactttttctgttaatcaaaatttcctaatattgttaagtttcaaatgggaactcaaatagccttctttcctaagaatcaaatgtgtgaggagtggtttctgtatttctgtcaaatggaaatattcttataatatctagaacccataaataaattaatttagaatatcttccaaagtgtcagtccaaaccctccagtgaagcagcttcactgaaatatcagtaaatagtgctggtcaagttacatatattttttacttattcttatcgtggtgatgaagtgacagttcaagaggaaacctagaatggatgacctccatgaaacacctgctatttggacttctcttgtcaattttcaaacatcttataatataattgtagacatttatctgaggagctgagaagcctgttaatcacttacaaattatatgacctttcaggaaccatcttgtcatacacatctctcataagaacacgacaggaaagaagagatttgaaactcacaataataatcactcaataatgactccctagtaagtcagctctcttacagcacatagaggacaataaatgaaggccaaggaaaacgatttgcaagcactttaaccttcctttacctctcttgagggaagcctcaaagtaaattcccagagagagactgagtagtttttactacttgcctgaagagaagctgaaagtgggaagaagggatctcacaaaccttaaattatgggcttttttcctgttactttttatttataaggacagaaggcagatatttgaaataaagttagtgatggatactggggtaaccagcttccagcatggcacccaataattctcacctccagatattcttctctttgtgtagccccctcccacattgagtagggctgacctgtataactaataagattttttttaatgaaaaagtgtaatctatgaggctacattctaaaaaaggcattgcttctgccttcatcttttggatcctttactctggggagaatacagctgttgtatcctaaggacactcaagcaacactatggagaagtccatgtggtgaagagctgaggccgcttacaaacagccatgtaagtgaactatcttagacacagatcccctagccctagtcaaaccttcagatgtctacaaccacagccaacatcttgactacagtctcataatagagcctaagccagaaccatctagctaagccattcccaaattcctcatacacgaaaacatgtggcataataaatgtttattgttgttttgaattataaattgggggggggaggtataatttgttatgcaataatagatgaccagtaaacaataaataataagtggctgggcatggtggcttacacttgtaatcccagcactttgggaggccaagatgggaggatcacttgagcccgggaatttgagaccagcccgagcaatatagcaagaccccatctctacaaaaataaaaataaaaataaattagccaggtgtggtggtgcacacctgtggtcccagacacccaggacactgagtcgggagaattgcttgagcccaggaggtcgaggctgcagtgatccatgatcacaccactgcactccagcttgggtgtcagagtgagagcctgtctcaaaaataaacagttaatttttaaaaagtaacagaaccagaatttaaacctaagtttgattccaaaggttgagttctcagaaggttaaaagtttcccaatgaatttttaaagttttccttagtttacctgttaaaataacttattctttaaaacaaattcaatttgcaccctatgtaaagaaaggaacatcaatccctttaaattgtttggtcagtgacatcatcctatatttactaatgtttaacaagttaggtcttgagcgcaatcagttagaggtcaattaatatccatgtctgtattccaggtatttgttttaaagtattgctggaaaaatctcatgcatgtgtcaggagttgtttttctattaagattcctcattgagtcttctgtcttgcaagatattaatgtgtgcgattccacctaatttgtcccttctcttgtctcttctctgaaaccactgtagtatataattttaatttccttaagaagaaaaattagtgagttgtttctgaattgcccttcactagaacagcaaatgattttaagaaccattttaaagttctacccagaaattgtatctatttttgtctttctcaattggcattttaaccctggaaaaataatattttgccatgaaaattctaaacatttcagactaaagaaacaaatatttgtatctcttctttgaggtgacatgagttaacatgtgacgttaaagatctcaatttgactatcagacctgagtattagagtaaaaatgggtgggactttctttgtcgaatagaatgcctatttactttgaggcagagcacctgtaactaccccctgagaactgtacgtctctcacttgaagcatctctgattatgaagatccaaattttcaaaatataaattaggaggcaattttttgttgaatgaaaatgttaaccgtagtatttagatagtagcacctgtagagctctatttacaaatctttgtttatatacagatttaataaagtaaaatataactcacaagcatgtattgctccaaacacattatattgcaaaaacacaactgcctactttaagcttcttacaagaaatctcaatttgtcgcattatttatttgatatgtattttcctcataacttactgctttccctctggccattagagccatgaattcaccagatgttcaatatttcaagtcttctatctcattttacagaaagcttcataatttacctgaaccttgggctgcattttcttcatttctttgtttatggaaaccatatgccatgctatcctatatatagacatcaacttccatcagaaagagaaagcatgtagagagtaagagatagactttgtgttgtggtaaaaatacacatagtataaaatttaccattagtgacatttagtatattcacgatgttgtgcaaccatcaccagtatctaattccagaacactttcatcagtgctaaaggaaacaccatacccattaagcagttacttccctcttctccatttccgcagcccctagcaaccaccaatctcttttctgtctgtatagatttgcctattgtgggccgggcgcgtggcttacccctgtaattccagcacgttgggaggctgaggcgggcagatcacaaggtcaggagatcgataccatcctggctaacacggggaaaccccgtctactaaaaatacaaaaaattagccgggcgtggtggcacgcacctatagtcccagctactctggaggctgaggcaggagaattgcttgaacctgggaggcagaggttgcagtgagccgagattgccccactgtactccagcctgggcaacagagcgggactgcgtctcccacaaaaaaacaaaacaaaaacaaaaatttgcctattgtggacatttcatataaatagaatcctataatatgtgacattttgtccctggtttctttcacttagcataatgttttcaggattcatccatataacagtactttactcctttttatggctgaataatattccattgtatggatacaacacattttgttttttccattcatcagttgatgcacatttgggttgcttacaccttttgactgttatgaatagggctcctataagcaaaaacattatgtacatgtttttgcttgaaaacctgttttcagtgctcttgggtatatacccaggagtggaattgctgggccatgtggtaattgagatgaaacatttaaagtgaaatcttactaaaccaatatgttgtccttttggggaggtgggagtcatattgttatttctcttttgttttgataacataacacctgaactcccacacctccctagaaaatgtggtatggaaatttatgccagaagactattagatggcatcaccaactcatacccaacatgagaactaaactttttttatacaaattgccaactgatataaaggcagttgaaggtccccaactctaacaggtgtactactatgtaccttcagaaaatgaaggttacagtcaagtaaccaaagtgtttctgtatagctttggagccagaaaccttagtcagattacaggaggttgcccttgggccactcactaaatttctctgttgtagtttctccatctgtaaaatggggataataatctctgctgctcaagattgacataaagatagggcatagcctggcacatagttgacaataaatattagtctcttttccccatatattcttatattcttcaaattaattgctctccaagatatcactatttttcttctcattttctctttcaggctaaaattaaattgccaaatacaaacccttctgatattcaaattgatatccaggaaacaatccttgaccttcgtactcctcagaagtgagtaaaacttagaactggaatagtgtattataatattaaagagtcttcagtcaatattattttttaaaatgtacagttattttgtatcacccctaaagtctgaagaaaagtggaaaattttgtattcagatgtttgatctacattaatataaacataaatatgtttggaaatacttggacttttttctactttgcatccgtgcatttggagtgggttaatgctattaaaacacaattcttgacacccagatgcagtttatctatcagaaaaaataactagaagtgaaaatgccattaagttgtaagtcttatatgtggtttttgtacattgattacataagggaagcaatatctttatacttttgtcattttgtggggctgtaaggttaaatttgagtgttttcatttaaatcaacaaaaagatcttgccatcaattactatctaaatacctcactgctttgtgcacatcttatctggatatagagcagtgagcacatactggttcactgcaatggtcctaactctgtaactcatgaacatttcaaactggatttgggaggcaggcagttgctggcacattttcttccttccattatcagtacctataattctcctttgttgagcttaggacttcaagaaaatgacaagaagatccttcatacaaaagattcctatgtgtaaacaacccaatatgcatatgtagcttaatcttggcttctatagtaaatgcatttaacccaaaatggtctacagataaatatatatcaaatgttttcttattatttacatcatttcaaaaatgtatcctcacagaacaatcatctcatgttataaaaattatattcactatttctgctgtttacttcaaggagtattgtacccttttgttgcattttatacacgaatttactcttccacataacctttacaaggaaaattggttaaatgaacaatcttccaagatatttgcaagcttgttaaaagcacacacatgtctacacaccatggggttaatttccgtttccctagcagttctcactgtctgtgagactttcatttagtggattctgatggatatctgtaatgacggcacagccatagcagctacctaaagattgatggagacagcagaaatactgaatacaatttttataacatgagatgtttgttctgtgaggatacattttggattaaaagtactttcccacatagaacatgggctatacactaggtcctttggatcataatgtacttatatattaaatgcgcagtgcagagaggtaccatctcaagaaaacctgcttaactaagatagaagacagaaaatataattaaggattttatcatgtttcctaaatacttgagaatcctttagagccatgcttttctctgaaattgcattatcgggaatgtgtcttgttttcgagtttattgatattcacacctactttctttagtttctaactttgacatcatataacgctatgtttatccaatctgagaaagatttgagagggcattctgttcttgtatctataaggcagaaacaagcgaatttattttaactgaattgaccagtggtttctgtcaaacaatagtcaatttcattcgaattaccaataaaacccaggtatttaccaaaataaataaagcagtttaccaaattcttcacttttttcaattggttgttttggcatgtagatacccaacatggagtaaatggagaggaggaaagacggagaaaattggataatttacggggatctcttaagtcttcatatgagatttcattatttttctaagtgaattctaagaatttcataaatgaataccttgaatgtgataataataacacattctaaagacaaatgtaagctaatttttggttgagtgctgctttagattactcacacatttgctgtgctcctttagtttggattgggaattgactgattttcaaagactgatagctaaaaaagaagttttctaaatgaaatagttgagttgcagctcagtagctatttctgcactttctttgaaaatagttatgtctccttcagtaaaccttaaaaaggtttttaacccagatatgtaagtcaaataattttgttaattatataagataaaaatttcattatgcgaatatgctgggaaccaggatgtcctttgcttaaatctcttgtgagcaacatcaacttaaactctctaatataagtataagcatgtaagtctctaaacttgagttcactgtagagattttttttgtatttacattcatgtattattgtttgcatttaatttctaatgaaaattaacactggatgaacctttgatcactgcctagactgtaacttctgaaaatgcaaatacattgtcaatgtaaaagtagaggtattgggtttaaatgtttgttcatatcttatagtactaatctatggtaattattcaaatgttattttgtggtgacctgaatacttgcttcatttatttactcactcattcatttatttattcactcaacatttataaagtcttccactagacactaagggagcaccaagataagatacattaatgtccttccatgaattgtacatggataagtatttggagaatttttattttgtttaaatataaatctcagtacagataataagacagtaaaacagacgacgaaaatatttcccttctcctaagagcctaaatcagttgtacagttctactgttcaacattttattatgtgaagccatactacttagaactacacagaaatgcaggcgtagatggatcattccaatggccactaactgtctcttttgaatttatttctctctggacagagaagtgcacattatcattggaactccttcttcagctgatttatagttgtcttttagtgcaacgaagctaccatactaagctttgctttcttttaaaagtgaatatattatcatttattgaataaagtataaaggaaatctaagtctagcacaacctatatagtaaacagatttaaaggatggactctacacggtttttgcactcactttttttttcctgagatgccaaatattacagtctacattaaaatgcattgccactacgtttggcaacgtattcaggcgaagtgtttttcctaccccacatggaatggaacaagagtcacagaaaatttatccttcaggttccataaatgtgtaataaatacttttaatgaacccagtcttctgaactcaggtttttgcaaaggaataaagaaggaattgattttcaagggttttgttttcaaatacatactagttctcaattcaagaacccaataagtgcccctaaaaataccatattcctttacttatttggatattataccttctaaaagagcatcctgtccaccttttatagagatactcagaccttctctactgaaaatgcgaggtaacaagtgtttcatgcatttaattttcttccaaaaccagcatgtgctgaccccgtgcataatttagattcatgccaatatggcagaattatggatgtctcatcccagcaatgcatctaaagcataaaactatccagcaactgaactataaaccacaaaataaacctagcaatctatcacagggaatttttgtcaatgtgtaagtagaaagaatcagaagcaaggagagagaagcactttcattgatttggtattgaaatcattcccagcctcagtttcaaaaactacacctgtggtagagactctgcttaaatctatgttagcagaagtgtcatagagccattccaattttcaaatttgtatccgtcggccacattgcatctatacataagtatgagtggcaacagatctgtccagcaaacttaaaagttgcatagttctatttctatgcctgtaaacatagcctgagactatgtaaaatgaggtcaattcggagaaaaataggggcgccaaaacaactgcttggatttttaagtccagaaaaactggtatactgtttgtgttatttaggcatatttttgatccaatatttacactatctaaatattgggggggggttgttttctaacactctagtggcatatgttgtttgcaattgtcttattgaaagtgatacatcattttaggaagctaaggttttattttgttgtttttttttaggaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattta

SEQ ID NO: 3554 - DNA, 37610 bp, human
gccacgctctgcacagtctattttcggagcctagccagagacgggaaaactgaccaaggtgaggaaactcgaacctcaagacggggaaagacagggtcctcagatgctgtggctatcagaaaaactagggagaactctagatatttataactctgcgagataccccaaaaagccacaagttgggcaaggtggagaagacccgttccctaaatcccgctatcctagactcttcactaaatcccgctatcctagactctagaaacaggacgctgctttaacaaaactcggttttacaggatgtgagtgaaagatggatgctgatcgactgtcagaaggcaaaagtaaacatctgaaagtttcccaactggtcttctctcaactctcacatgcacttattggttctcccttcccattaataatgactaatttgggaatgtaaaccatattttcttataggaggacctgggtgctccaaactggagcagccactgtacccttctgttttatatgtgcaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaagtattacatgtcgtttgactgtaactatcaaaaggtggggaagtgtgaccaaaaaaattaaatctgagtgaagggagagaacctagtttgaccaaagagggaggagtcattactccttaagagcttcttgtgataaggattcagaacagagaccatatttcctgaagaaaggaaaaaaataggactagggagaaaatttaaagcacagcaagaaaatttgccaggccgagcgcggtggctcccgcctgtaatcccagcactttgggaggccgaggcgggcagatcacttgaggtcaggagttcgagaccagcctgggcaatatggcgaaacctggtctccactaaaaatacaaaaattagccgggtgtgttggcgcctgcctgtctggatgctgaggtgggagaatcacctgagccctggagatcgaggctgcagcgagccgtgatggcgccactgcactctagcctgggcgacagagtgagatgtggtctcaaaaacaaaagagttctcatactccacctgtatctaaaaagagtccctccaacttctttttagatagaggtggagtatgagacttgagatagataaacgaagagaaaaaaatattaagtgtattgtttgtctgaaatgtactatagagcattcgataattcaggatgggttctacagataccaaggatttgcctctccatattaaaactaatttttctgtcaactcagcactttgagagtcctaagcgagggatcacttgagctcaggagttcgagacccatctgggctacacggtgaagccccgtctctacaagtaataacaaaaattagccggcgaaaccccgtctctacaaataacacaaaaattagccaggtgcagtggcacagcctgtagtcccagctacttgggaggctgaggtgggaagattacttgagccagggaggtcgaggctgcagtgagccgagatcgcgccactgcactccagcctgggctacagcaagaccctgtctcaaaaacaaaaaaacaaaaaaacccctccattttcaaaaaggattgggatggtacagactccttatgaataaatgactaaaacagaggaaatattaaatcaaaagacgcaatttttttttttttttgagacggagtctcgctctgtcgcccaggctggaatgcagtggtgcgatctcggctcactgcaacttccacctcccgggttcaagcgattcttgtgcctcagccacccgaggagatgggattacaggtgcgtgccactatgcctggctaatttttgtatttgtagtagagacggggtttcaccctgttggcaagctggtctcaaactcctgacctcaagtgatccgccggcctcggcctcccaaagtgctgggtttacaggcatgcaccaccgcgcccagccaaaagacactttttttgatttagtaatcaataactatttaatttcttgacttctttttctatgaaagattctaggtactttcaaaaagcatcttccttaaatatattttaaatttgaaacgaaaactgttaagttcccatagttacttatgagttagtacatttgatggtagcgaaagttagagacctgaaaaagaaaccattcttagtattgtaaagataaattcaaaatgaattatttttaataggtgggaaatcattgatgagtatagttatcaaaaaatgcaaagcagaaagcaattagtcagtatattataatttaattcagacataggcagagatgatatcactgttgtgttctcaagaattttaatggaggaattgctaaataaggcactatataaataaagttgcttcaatctaggaaagctgatttaaaaaaaataaataaataaaaataaagttgcagaagaaatgccaaatttatttagagaataaatagattttgagtacttgcaaatcattgtgttaaagtcagtattttacatagggatatatctatttacttaaacaagttccaaaaggatattgcttggtgactttttttggggggcagggaattgagtttctctctgtcacccaggctggagtgcagtggcatgatctcggctcactgcaacggccacctcccaggttaagtgattctccagcctcagcctcccaggtagctgggattacaggcgcccgccatcatgcccggctaatttttgtgttttttagtagagtcggggtatcgccatgttggccaggctgatcttgaacttctgacctcaggtgatccacccaccttagcctcccaaagtgctgggattacagacgtgaaccactgcgcccagccctgcttggtggttctttatcaccctgattttatttaccatatatacttgaattaataaaatctattatctatttgaatagtctgtaattcagagttttcactaatttaacctagacttttctacaattaactgatgtcaaaagccatctttattgatactgtgaaggagacaaataaaatagaaagcatgatcccagccttagaaccagtctgactttaactcaaggttactgatgttgcttaagtgctgtgggtctggagccaatctggttgaactttttcagcccctgactggctccagtgttatggtaatgagctggttctggagtgtcagttgctttagctcattgtggctagtagatggtccaatcatgcctctatttatgaagaccccaagtactcaggttaatgtgggaaaatcaaaggctctgtctggaaaatgttgccattagcattggcctagcaaaagagaaggagagaaagaaaaacaaagggcctaaaaaatttattttctaaatacaaatctcaaataaaagacagtaatatattttgtttttactgaaactcttaaattttccttactttaagtttattcttggcctatttaagtgacagtgccagattcaaacattttaggcagtgtggctccagaatcttctttttcattttttattgttattattttatttatttatttatttttgaaacaggatctcactctgtctcccaggctggaatgcagtggcccgatctgggctcactgcaacttccatctctgggactcaagcaatcatcctgcctcgggcccctgagtagatgggaccacaggggcacaccaccgcgcccgtctaatttttgtattttttgtagagtcggggtttcgctatgttgctcaggctgatctcgaactcctgagctcacgtgacccgtgagctcaccttggcctctcaaagtgtttgcattacagacgtcagtcagccaccatacccggccagaatcttctttttaaaaatcgctacactgtactatccaataagtcagggcaaaaggaagaatgcactccaaggtacaaaggcaggaaattatagagtatgtttaataagcagtttagtttttaacagaatatgtaggagaataatagaagggaaggacagaaaattacgttgggactatatcctgaaggaccttgattgccagactcaggatgaacttaaatgtatatcacatttagaaataaaagatagagctataaactaacactgcatagttcattgtagtgaagatagttccctacaaatagttctttgtagttcctaaaaagtcctcctgttttagtttttcagctgtgatccacttgtgtcaaatgaattttaataaatgttttttaataaagttgaataagttattctaaatatgttagacttcttaaaaagctagtagaatcttcctttccattgaattttgaatgtttttttctaaaaattcacaaactgtttttctcttttgatactttgaaccatttaactagttagtcacaaaatatttgggattcttttgtttatcaaaatacaatatcaacaaacttgtcatgattgatttatttatttttgttgtcatgatttattaatttgtgtttacagattattattacatttgatatggcaaaaatattttggctaaagtggtaattttattattatatttctattttaattgagctatagtgcaaatctatggcattttattccagcataatttggaagtccaattgtactttaagaagtctaactcctaatatgcttcagatatataaagtgttactaagaattattgtgaataatttaacaaaaacaagtgtacacgttccaaggaggaccatccccttcgaagtagtcactttaggagactaatctatttactctaatgttgttgttattgctaaaattgcttttgaaacttctgttttagaatcaccttgaggcatgtagcacattcttttgaatatcctcaaagaagaaaatcttcatattttgaaagtagacatgatatctaaatatatctagaaatcacttggcgacaaatctgatgtgtaatcaaaccaaatgataccataatgataccataatgatacctattttcttggtgatacatatgaaggcaattccaaataaaaagaaaaatcccaaaatattttgagcattgatagcataatttacatcagtgtataaccttccaaatgactattttgaaatataacattcagatgaatttagtcatgcttcatttggtattaatcaactgctgactatgtgccagctgcagttattaaagacactaaatctacaggtatagcttcccactgctcacactggcctacttcccacctaatgagaaccaggccagagttcctttccaaataactggtagggattcagaattaatctggtttttctgaatccagtatccaatgtaccaaaggaaccataacattccttcataacctccactgtgggtacctaggtgacacgagaaagccaccgacacagtgcctggtttgttttctcttttccagctggaactttgagccctattctgccctattctgaaccttcatctctagtagtcaacttgtgcacaaacctcaagaactgtaccccaccttctataggccagcgtccttcttcactttaaataggtctccctgtaaccatgacttcaacctttctgccctgaagcactgctcatgtctaaaaaatatgttcccaaatgatgatacataatgtatcatacactttttctagaggtagggcttaagaatctgcattttaaaccaactcccccaagtgattattaagcacattaaaacccgagaaccactatactaggtgctcaataagtgcttgttagcttgagtatgacattttagtaaagcaggctgaatgtttgagtttacttggtgctccaggtctgtgagttagcaaaatacatatatttgaaggagtttaaaaggatttccaaggaagtataagaaccaatggagtgatccagggaaagaagggagatatgacaataaaacatcttcatgtcttaaataaaacagaaaagtaaaatacctctttctgattatctttttcttcagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacaggtggtcatatacttaacagttgaattagttttgttcatgggaagttgtggaactgtatttgaataacctgttcccacctagctgtgggaacagagctgtgtcatttgatacattcacaggaagctacaaggctgattatgcatgacaatgtaacctgtagtacatttctagcaaagataattatatttttctaaaccacctgaacactgaataggaaaatagttctgtaactgtggtagcaatagccacatctcaaaatgttgtcatttatatttatagccaaagaatgcttgacaaccattgcagagtggtagctaggattgtttaagcctaggcaatatttctataaaacaaatattttcagttatacagtattaattggaccaccaagtaccagtcccttaattttttaatttgtctacacattaacgcagaacagaaagtttttgagccaaataatagggcaaactagtttcagcctaccaaaattggcttcccagtaatgcacaaataaagttgtggagtctaattagttgagtagcatttggggtcaagataggtaatgccagcaaggcttgcagtagcaagatgggcttcattttgggtagaagagttcattgaactgacctttgaccactccaaggttactgccagtattcccagaacaattaaaacacttttatataactccctgctctccattctcctatttcttaactatcggtgagccttggctatcagactgcctatgatagggcaaacaaaatttggggcaaaaaatcccatatcataacagaatctgtcaatttgcataaaattattttaatgaagtgttttgttatatgaccaatttatcatgaataaatcatctttcacaaacgtacatatcaatttactcctcccaaaatttatttttgccacaatgtggagaaaaaagcaagctatgaacaggcagcaaattcagtggctcagattgacactgaactgagctaccaccctaaggaagagcttaggtggaatagggcagaataaataagatgtgaaatgggaataacatttgtagaagaactgagtcagcttggagccaggatcaggaaccaggaagttttagtcagggaaaagtcttagtagaggctaaacaaagaaacatcaggatgttaatgacagcattagctatacacaacaaacaggatacaggagaaaaagttaggaacaatgtatcaatgaagttgggaaggcaagctcatttttgctaccttagttgagtagcagaataataattttctggagcctacatcctaggaaaggtaaggttatgccatatagaaaaagtatatcaagtatttgagaaacagtgaccttgaatatagtgaagtggaacttgtaactgggacagattcaaatataaggatttaccctggttacagagcctattccatttggtgtttatggctggaggtgtttatttgcatctagaggtgtttctaggagaaaagatgagtgcttatgagaatagactaacataatattactgagttgtacagtttataaaggaaaattactataataatgtatgattctgtatatctgggttataaacaattttgagataattggtcattcagacaccacagtacagatatcattagaggacatacagtatcagaacagtgggagaataattaatgtttctaatgaactattacattttccaggagagaaactgcttttcattttttaacatgtattaatcttgggaactgtgggatgattacaagagtgatgtgtttttgaaaatatgctctctgaaaacagcaagagaacagttgcatacacattgcttcatttacactatcccttttctatatgacttgttaagaatctgggagattgaggagagagtgtgtctgtcatttttcaaagccatgaggggatcttaaggcctgtgggaaataaggttcactgctcttcacagacattataacgaggatgttctgtcttacatattacaaagtggcatgaattgcagtgataaattgctcagataattggctgtagattcatggtaaaggctcaaatgatgttctaatagaaaacaattgccagatggtttttaatgtttttatgatcccattccatcttttaacttgaaaattttatttttaatcatttattttcattaaattaataaattgaaactcccatgtgttctgagccaatcactgtccatggaaagtataccaatttttgtcaagaatgtccaaggttttacttctactgcttttaattttctgtggaaggcagcactcaactaaacaagaggccctcatgttctgagaaatgctttactctgactattagtgttctgatgattaataatttaagaaaagtactacacatttacatgacattagtgattaaaaaagagggaaaaaaatgtcccaaatattatcttgggattttcacataaaaatgcctgtaatgccttaaccgcagacatagcacttttgaaacaccttttggaaaggaatagttactgtctcagacactgttgagagattatagattaatttctgatttataactcttggaatagtttcacataataaagacccacgtgagctgttccatcagctttcaagaacagacactactctccttgcccaaacaagacattctaacttttgtacatgtctaaagtcttaggagatgaggacaggggcctgagaaaagagagatagaggtgctagttggccagtaggcaaggagataagaattttttgactgccagcagtggagtgagttggagctgcagggtctgtcatcagcaaaaaacaattggtaagaaattgggattttcttgaaatatcaaagaatccctgagacgggccaatgaggtggtgtcgctatgtgttatacttagttgaaaaaaatgaagattgcttgtattggtgagtcagggcaagtcctttggggatgtgtatgcttgtgcagaagatggaaaaataaacttatgaagttatgaagactgaagtacatcagcatgtattagagactattaatttgtggttgctgtttaaatccactagttcagtgtcatgaggcggtgggacagggaagtgtttcatacctatagtggaaaaaagtaaaagcagttatcagggcttttgaatgattaatctgaagtctgaatacttagcttctgcttagtgttagtttttatttctataaaactttcacatactctgtcctccatctgactacaaccagacactgctaaaccccaaaagtgtcaatgcctttatactaatacttggttctaaccttcatagagatgaatgtggctcgttcctctatccccagggatacatgattcactgagctggaactagggttttagcctgactaaagatcaattctgctcttgagtctattaaaccaaacactttttgaaagaacaaggaaagcatattcgaaatagtacttgacatctgtctttctgttttataacaatgatgggtaattaaagtggaaagctccatgagtttttttatggaaatcctatcaaatttaaagtatcactagtcatataggttatacaagtattaattacagaatattgaactttttctcctccctcagacaaatggtttatctactattggagccatgggtcctgggaatattggaccaccccaaatagaagagctcaaaggtaagttatttaacaaagcaatatagatcaatataatcttttccttggtagagaaattatagggagagtaataagtactaatactagtatttattaagatgaactaaataacaatgtattgtatacttggaaattgctaagatagtagattttaagtattctcatcacaagtaaatgataagtaggtgaggtaatccatatgttaatcagcttgagttagtcatccactgtgtatacatatttcagaacatcatatggtatatcataaatatatacaatttttatttgttcattaaaaatggagaaatgaataaataatttttaaatagaaaaaagatgaactaaaataatcatggaaatgatgaatagccatttacatataaagatgctgtttttactctaccactgcaggtaaatagtttttctaataatggaaatatatttgccttgaattatccacattccttgcatattttctgagatagaagaccaagaaagtcacgtgtggttagatcattttttattttttaaggtctatttaccaagatgcttagcttctttaccttctaccttcctatattctagcaatttcatggaattcattcattgaattgtttaataaatatttattgagaacctattgtatcaggcagtatgaccatctctgatactacaatgcagatcaaaacagaaaaagtccctgttctgattgagctaatagacttttggagaagacaataaaacaaataactacacaattttatcttacattaagaggcttatacattaacatctttgagtttacttataaaaaaaagtccaataaataaggctaaataatatttttacatttccccagcattttgagctatacatttttacagagttgaacattttacaaatctttaaaaatataaaaggctctaattctgttggtcatgatcaccattaaccagaggataggaagggagaggaagtgaatttcattcatcaatttagttaattgcaaaagattaatctggacaaatgtttaaaataatggctaaaatgaggtctaaggatggttttaaaatttcagttattattgctatacatactcaagaggctatttgccttacccaagagatattcgctccatggcagtctaattcacatttcatgtatttctgtgctgcctgtatttctgataatgtaggtctaataatctttaaattctgaaggcaatgattcatatgtaaaatgttatatataaatctgtagttaggctttacaaagcccgtgctagatagaagctgatcatttcaaaagaattgccagaattgaaaacctaacaatcgggtgcatttctgggaatgcttaaaatgactcaaagcagtgctctgcacctaatgcaggtctccaccggatgctacaatagttaaaacaaatgtgagctgggtttttgcatgcctactggagcctatccatttttaaacatttaaagatgacatgcagaaacccaacctcatgctcagctctgcatgaggaaaatgctggactaaaaaatgatcattgtatccactgctttcagtttctttaattgatattattgagaattatgtcatgcttgcatggaaaagatatcaaagcgtttttatatagtaaaaacaatgcaagataagacatttctctccacatcagattgattgtagttgtaattttttcttttatataaaaatatttttaaatataatcctatttatgtttctggaaaaatgtgtaatatttctttgcatatgtatatggagagagagagagagagagactggaatgatacacaacagaatactaacattgattatctccaggcagttggattgtagattattttcttctttttgtttatgtttttgccaaattctctacagttgttattaaaattctacaatgtattggttctgtattgatagaaacatttagtcagtagttactaatttagtttgttttgatcaaaaaaaaaagctagcgattacaaataatgttttatttcaatgaacccaaactgagtgtgaagaagaacaggagcaatttagagaaggaaaaaagcatgagcttcagctttatcttccctttcttcacagtcatccctgaaaccagcgaggaaaataatgaggacatctggaattcagaagagattccagaaggagcagaatatgatgatatgtgggatgttagagaaatcccagagtaagtcaaatgaagccaggaatgtctttaggagtttaagttagctgtgtcatctgataacattttactttttacaagattcataaagtaacataccacataaaagataaaactacagtgacacacggaaggcatgtgtaattgattatttttttccttctagagcagaaacaaataataaagcataacaccttcctttcagttactatctagcaaaaatgaaaaatatagtcatttccattataaatttatatttaatgtcaatttgttgtataatgtggaactagcagttggagaaagccagcccattaaattgcaagcattcatacaaactaaattacaatgccatgtttatttgtcaagcacttgcttttaattactcaatgttccacaatttcggtaaaaggctatgttctctctccaattatcaattattacccagacttgtttactagatattctaagattatatttagtgttcagtgtattttgcaagcagggttcaagacttgctttgtagccttttcaatacaatcaagttgtaaatatgaaatttagaattattataaaaagccttttattctgattttaaaagcactcatacttttaagaaccttaaaatatatttatatacatagattaaattattggtcaaatagactaagctttacatatgtgtattttgaaataaaatttggattgactatttagaatagcaggaaaaataaagccaacacttactaaattataatgtactatataaattcttaaagacttctatggcaagtgatctgacaacttttctaatactgaatacaaaactatccagtatttttttttttttttagacagagtcttgctctgtcgcccaggctggagtgcagtggcacaatctctgctcactgcaacctgcgcccctcctgggttcaagcaattctcctgcctcagcctcccatgtagctggaactacaggcacctgccaccacgcccagctaatttttgtatttttagtagagacggggtttcaccatgttggccaggctggtctggaactcctgacctcaggcaatccgcccgcctcagcctcccaaagtgctaagattacaggcatgagccactgcgcccagccaaaattgtccagtataaaacaagcaaataaacaaaaactccatgcttctgccttctacataagttctgaaaacagaagcagtgggagactgcagacaattaactagaaagaagtatccagctttcaaataaacaatgtcaagaccataaacctcataaaaaatcaaaggagattttaaaacatttcttagagaacgaagagagtaaatttgaagttatgtttatatagtgtccacgtatcatatgaaaagtaataattaagtcacttatttgtcatattgtctaacaaatgtcaaatatccatatgcagcaaacttcaaatttgagtaatttttcccttttcatcctgatgtttgatgttaggtagatagaacatccatgaaagctttaaatgaataataacttcaggttattatgaggaaaattgctttataagattttaaaaatcttcatcttctaccttatgaaaatacatttcaacatttctcagtggatgcagaggaaaataggtaaagaacatgaacaggcagttcaaaaaagaagaatcacaagtggccaagtaaaagaataacaaggagctgagctaaggcactggccttggggagaagtatgagggtctttatttgagtgagttttggatgaagagttggtatttggttagataaaatggatgagaggagagcgtcaaagatgatgctgaagttattagcttgggtgactgaggaaatgataatgccattaactttgataggaattataggttaagaagaagcagtgagtttgtttttgttttctttctttctccctttctttctttctttctttctttctttctttctttctttctttctttctttctttttctttctttctttctttcttccttttttctgagacagagtcttgctctgtcgctcaggctggagtgcagtggtgtgatctcggctcactgcaacctctgccttccgggttcaagcgattctcctgcctcagcctcacaagtagctgagactacaggtgcatgccaccaggcctggctaatgttttttgtgttttttgtagagacgaggtttcaccaagttggccaggctggtcctgaactcctggcctcaagcagtccacctgcctcagcctcccaaagtgctgggattacaggcctgagccacagtgcccaaccaaatttgttttttttcttcgccaaccaccgcccccccggccccgcccattgttcactgcagcctcaacctcccgggctcaagcaattctcccaccttactctcccaagtagctgggactacaggtgcacactttatttttgtgaagactgcgtctaaccgtgctgcccaggctggtctcaaactcctggactcaagcaatcttcctgcctcagcctccctaagcactagattacagttgagagccaccatgactagctggtttttgatatgtacactttgagttgtctttgggacatccaggcaaacctttgtagtagacagttggaaaattgcgtctggagctcaggataagagcaggagcttgagcaaatccattaggagcaatgaacatatagatcaatcctctgtttgttttaacctggcttcaccttcataaataattggtagatgttatagcctattaagagaaaagtgccccatagcaaatagctgcttattgttagccatgttcaaactcagagaaatcccttttttatttttgggcattcctattggcaaatggtcagaagttcaatcaagtcctttagtcttactatccagagatctacaatttcttcattaaggtagcattaagcataataataataataataataataataataataatttgtaaatatttgtttcattctatctgaagagatggggtaccttgtggtgggtgcttctataaaccattgtattcctggaggcccaaatttggagggaggaatgatttgtgaattgtcatgtgtggggtgaaatatcaggaaaacctttcattacactcagaattctgtaagactagattctaagcactatggtgtagctgtgctgactacattaccagtgtttctattgtagaattttagccgtggagatcattcagttcaaactcacccctccctcccataaatcatacaaatgtagaaactgagaccccatgagtttgtgacttgaccaaggtccacagttaatgacagaaacagtactaaacctgaattttctcctctgctctgtggtttaaacttggcagaggaaggtttctatcaatccctaggttatggactcagtatttttctgagctattgtttttcaggaacagactttccttttttttcttctgcttttaatcttattagaatcttattacaagttccctcaatctattttatttgtctagctctgaaacagttaaagctttattttagaaaataataacaatcctgcctttcagtgtttattttgaccacatttctagacttcttttcctttatgttctattatatgcctgaagacctgcaagcactttatttgtttagtccttttattttacctaatagcatatcctcataagttactagttttcttttctgtgacaggaaattgctctttcatctgagtccctataatcattgattttttttcaggtatgagattatattcagacagcaggtgggaactgaagatatatttttagggttgtcaaaaaaggactcctcaacaggttgttgcagtgaactagtggtaagcctctcctccccttcttcattttctatacaaccattgtagctaaattgactgactattatttacataatattgtaggcaaggttgtaaactctttaaaaatcgtggttgctatgtttcacgtactagggtaacaatgggatagacagtttaaaattgttaacttgtacaaaataaactaagtttacacatttggatgagatttacaaataaacataatggaatcatatgacacaatacacaatttctatttttatccctattaaaacttcccaattggattggactggattttcttccatcctagttccgtcccatgcatgccaactgattggttattaacttatgatgaattgacaggcaatcagaatgaagtatctccttccccgcatctgtcttatctcttatttctgtatttctcgtaatgactcagcttacaatgtgggacttaaaaagggattttcttaattttgggatctgacttctgattaaaaacactaagaaagacatctaaaatgttactttgctttcttatctgaatgacgctaccgaatgttggagagcatcctttaccaggtcactgtttctgtataacagttgtggcaataccaacaatatcaatgataccaccttacttttgcttatttcatcctgataatgaccttgttgaaaaatctgggcctaacccagagtgtggaatttgattcattttagcaacattaacaagtaattcttgtgttaaaattttattttttgagatcaggaactttgcttctattttttttcctcctttcttacaatacattatagaataccatggtgcccatgggagatgtgtaatatttttttcttaagcaaatgataaatggaatttctcttttgcatgaacttcaggttttctcttattagcaaaatctaagacattcaattcaatcaagtaacataatgggaatagtggctttaagtacctcaggagatttttcaaactctaatgagttatgctttcaagtaatcttgaagtaattagctcccagggttttaccagtaatattcaaattcctctcttttaaattattgtaaaattgtgtttttgatgtgtaatgttggggattgctctaaattctggaggaattctaggccctaaataaataaaactgttgcaagccttacagtttatctcatgcaaaaattgccactagttttaataataaaggtatcctgaatgaagaatcttggaaactaaatcatacctcataataggaatatatggtttatctaaaactcaataagtatatacagaagacttgatatttctctcaaatgaatttataatcaactggggagacaaaactaacataaatgaaccaattttattattaagaattaaactcagtgtaaacaattataagtcgaatagaagttcagaaggttgggataagtcatggacaccactgaaaggcagcagcaaataacacatttgttgatactgtggcactttgtcacgtgtatactgttccttttctctttctttcctttatttctctttgtttcttcatttattacatctttaaatacttagtgaatgttactacataccagggactgtcctaagtactagagatacaaaaataaatgataaacaatcaattgtcctcaaggaatttacagtaaaggagattgacacctaataaatcactgcagttcagtatggtaagtacatatttagaggcaaacaccatgaacagaatgatggttaccagagactgggaagggcagtgggcagtgggagttggaaatgtggggatggttaatgggtacaaaaatatagttagatacaataaacacgatctagtatttgatagtacaacagaaggataacagtcagcaataatttgttgtacattttagagtaactgagggagtacaattggaatgttcataacacaaagaaatggtgaatgatttaggtgatacaaacccaccccatttaccctgatgtaattattatacactgtatgcctgtatcaaaatatctcatgcaccccataaatatattttcctattatgtacccataaaaattaaagatagaaaaataaagacatatatcaggtacatagtgacataaagcaggaagagatcaacttcaagtggataatattactacagtggacaacattctaaaaagggcattccaagcagaagtaagagcacgtggaaaggtatccaggcatgaaatagcatggcatatttgagtaaacagagaatataacaagaataaagagtaagtgtcggtaataatggactagtaagctgactctcaaaaaagataaaagcttgtagcttttatttgtagcttgaatgttatcctgtaggcatactaatgatgacatccactatcattgcttactccactgacaagactcagagtaaataggttgttgagcccatctcaagtatttcttgctcaaatgtatatgcttatcattcttcttgataatatggtgtttccttgaatctaagacatcataaaattgtaaatgtgccatttatttaacaataacaatgtttcagaggaaaatagttataatgccatattataccaccattgattgtgcagttcgtctcaatatcataaacattaaaatgtggggaaaattgtacctgagaattgcctaaatatgttatttgtgtcctggacctggtctatatgtaacaatccaatccaaaaactttaagaaaaaatccttacttaaaccgagtaaggcaataggagtacaatctgtttacgtacaagaagtgatttggggtttaaaaattcacaaggaccatcctttcctttaccctccccagactccaaataagaaagcaagatttatgaatcctaaatcaaagcaacggtcctaaacaaaattatgaattaggaatgtcttcagcaaacccttcgaacctcaaacccaaagagccccattaaccaaacactccctgccctattgttatcctctgcaactgctttactcctgagtttgtagccaccaagtttcccttgccttaatctatatttaggtattttagagctagagctagccagtggtttacaggtttgttttgttttgtttctagctctcaagcttttttctttccaaataaaattctatgagtaagcccagtgtaataaacataaaaagtaccactgccttgtttaagaaggtactatcacccatgaggcagctcttaggagaatggctgaggctccttggaacacagttagaaagatgctgatctaatttctcatcctgatattacagttgataaactaaggtcaggcttacaaggtttcaaatactcatatacattaatggaagaataataagaaatctagagggcttctttttccttggtgacatatatgcttttctttaaaccccacgagtggaaggccctagcttatttcattttgttttggttgtttttctttttatcctctagccatattctccatccctctccccaaagctctcactgtaatgggtgtgatattaggttggtgcaaaagtaattgcagttttgctattgctgactactggttattgccagactgactgaagtactggacctcttgggtgccagctgaggagcatggaaaaaagaactataggtataaaaatatgtagcaagataccctaattctccataggattatttgtggcaggaaatgggatgggtgtattggaaaaataggtcagcagattctcattttcacccatggtgccaaaatccaaaaatgaatgggcctagggttattggtattctgccaaattaccctttgtttgttctaggagaggggaaaggcagcttgcagatagcttgatgctctttgacctagaatgaacacatattttgatgttttactttgatagatctatattgataaggcgacattctgatatgacccaagaaacaagccactaagcctattttttcccaacatcacctcctccctaggatatgattcttcccccatctttaaatctcactgagaatgggatgagagtcagggatgggatagaagtcagtcaccatctggcaggcagacacaaccaggagtcacatgtttatcatacatatttatctcagaaagtgctatcaatcattttgagcaaagtatttgctcatcctctaagaattcacttgcttcctgaatggtctgctcttcaaatcctgatttctttcttaaggttaaaacagttatatttgtttacttttttattttttgagacagaggctcactttgttacccaggctggagtgcagcctcaactcactatagcctcggcctcccagattcaaacaattctcctgattcagcctcccgagtagttgggattccaagcatttaccaccaagcccggctaatttttgtatttttagtagagatggggtttcaccatgttggccaggctggtctcaaactcctgacctcaggtgatccacctgtcggcctcccaaagtgctgggattacagccgtgaggcaccgtgcctggcctatatttgtttacttttaatgaaaaaatgtatttggctgcttgataatgaaataggttttgttctccattctattcccctctagaggatggacctagttttttttttttggtaggcttcctgattatgttaaccttgtttgattggttgtataccagaccatgtggcacagggaaggatatctgatctgtactatgattccttattgtcagttccaggcagcacagtaaaccttcacttaaatttctaatcgctgtctcagtaatatattcataatatatacatttatagttaatgtcataacactccttcataatgatggtggttgtgggacatggtaacaaatacttccttaaaagctaatctaatcatatagacagtatatttctgattatggaagtaatatatatgtaaaattttaagcaataccaaaattagtagagttgatgataaaagtccatcataatgagatggagaaaaattgagagagagagtgtgtgtgtgtttgaaataggctatggtcaaggatggaataaaggtaaaagatgtcatatacatattacttcatatatgtatcagtaattttacattttgatgatgtcattttgaggtttcatcaaaatatctgaatcacatggtctggaatccttgagctggacctggcagaaactcccgattccatgcaagcagattcacagattgaccttggaaattaccaatacttgagggatcaataaaggtagaggaactgagaaggatattcagagatgggagggaaaccatagtagtatccgctgctgtcaagcaggattaggatgcagaaagaactttgagatttgtcagttaagaagtctttggtgatctttggaagagagcagcttcagtggcatggccaacaccagattgaagaaagctgagaagtgaagaggaagtgaggaagagaagccagcaaatatagattgttctttgaggaagtttagtggtgaagaggaggagaatgaggaaatgatttttgagaaggaggcaggatttaggggagtttttttaagacaggagagatttatgtatgcatttcagctgatgacaagaatccatgcattcatccatgtaatatttatttagttcctactgtgtgtcactagagctaatgaacaaacagtaaaaaaaaaaaagtagtcatggtgtgggcccctaggtggaggcatttttggttgtcacaatgattacagaattttttgtttttttgagataaggtcttgctctgtcacccaggctggaacgtagtggcttgatctcagttcactgcagcctcaacctcctgggctcaagcgatcctcccacttcagcctctctggtagctaggactacaggcatgcaccacaatgccctgctaatttttcttttttattttttgtagagacagggtctcattatgttgcccaaactggtctcaaactcctgggatcaagcaattctgtcacctcggccttccaaagtgctggcattacaggcatgggcccccatgcccagctgattacaggatattattgtcatttagtattcagggccagggttgccttaaatcttgcaataagaggtatagtcctcaagaatgaagagttgtcctacacaaaatgcccatattgctttcctctagtttaaaaacactgattagataaagagggattgaagatatgagggtgctgctactcagcagcattccaccctgttgactactcttttttttttttttttttttttttttttgagacagagtcccgctctgtcgctcaggctggagtacagtgatgtgatcttggctcactgcaaactccaccttctgggttcaagctgttctcctgcctcaaccccctgagtagctaggacaacaggcacgcgccactacgcctggctaattttcatatttttagtagagacgggttcccaggctggtctccaactcctggcctcaagtgatctgcctgcctcggcctttcaaagtgctgagattacaggcatgagccaccgcacccggcctgctctctccttgaaacacagttttctctttactttaatgaccccattctcactgaggagtgaggaaagacttcactcttttcttccgaaatcactaggcattcctcctctctttcactcccaaatcactggctcttcctattctgccttaagttctctggagatttgacctatgtctttttttttctctacctattctcttttcacctagtctcatagctttaaatatcatttatctctctagtcctgaactctcccatgggctttggattcatataactcttttaactctcgctctgtcacccaggctggagtgcagtagcgcggtcttggctcactgcaagctccacttcccgggttcacaccattctcctgcctcaggctccggagtagctgggactacaggcgccccccaccacgcccggctaattttttgtatttttagtagagacggggtttcaccgtgttagccaggatggtctcgacctcctgacctcgtgatccgcccgcctcggcctcccaaagtgctgggattacaggtgtgagccaccacccccggcctcatataactatttacttgccatctcttacttgtttaatagacaactcaaacctaacatgtctaaaacagaactcttaattgtcttccataaacctttttctcattcatcttctttgtggcaataacattcacccagttgctcaagctaaaaacctaaatcagccatcattcctctttcctttatacctcatgtctaatccatcagcaagtattactggctgtaccttcaaaatatattctaaatccatctaattttcattaccactgcaattgctatcatgttactaacgatcatcatctctatctggaccattctgacgagtctctaatgacattatctccctgctttgactcttccttccctatagcctttccacacagagtgtaagagttcctttttaaaagtaagtcaaggccaggcacagtggctcacacctgtaattccagcactttgggaggctgaggcgggtggatcacctgagatcaggagttcgagactagcctggccaacatggcgaaaccctgtttctactagaaatataaaaattagccgagcatggtggtgcacttctgtagtcccagctacttgggaggctgaggcaggagaattgtttgaacctgggaggcagcagttgcagtgagcagagatcacgccattacactccagcctgggcgactccgtctcaaaagaaaaagtaaatcagaccatatcacctcttcgcttacagccctcaatggcttcctgttgcacttacagaacaaaatccaaactccttatcttaaaagtagggaagggccccgtgtgatctgacccttacctacttttacagtttcatccaatgtgacactttcttccttgtttgttatgttctgcttatcctgaccttctttttgatccttcaatatgccaagttatttcccgattccttgttattcattccacctgggtattccacctagtccctcagataatgaaattttacttcttcctttccaatcattttaacctatttcttgtttaattgcatgttagtacctccagaactatattatgtaataatagtgaatactgaactttatttcttatttctcactttaaatttttaaaaattaaaaaaatatgagtacgtaatagagatacactattcagccattaaaaaaagagatcctgtcatttgaaacaacgtgatggaactggagatcattatgttacgtgaaataagccaggcacagaaagacgaacatcacactttctcacttatttgtgggatctaaaaatcaaaacaattgaactcatggacatagggagtaaaaggatggttaccagagaatgggagtggtcattgagggaggggaagtgtggggttggttaatgggaacaaaaatataaatttctcactttaattggaatggttctagtgtttcttcatttagttagatactgatttttggggtatgtgttaaggatctgttcatctattctgattttaagagttctaagcaagaatagatgatgaatttaatcaaatgcctttttaccatttgtgaagatcatatgatttttttagtttttatctattggtaaattatattagcaaatttcttaatatggaaccatccttgcattcattcattcagtcaacaaatatttgttgagtgcctatgatttgccactaagtattttatgaaaactctcattaacaatgataagctgtaggaaaatgaaaaaaaaattaaaggtgatgggtctctgttttgaaattataaaaatatttacctctgaagtataaaaatgtagaggtatgtattgtccaaaaccagggcaaaaaaccagtaggtcatctttttaaattgatagataaatttcttttttttctttttgttttttgagacaaggtctcactctgttgcccaggctagggtgcagtggtgcaatcttggctcactgcaacctccacctcctgggttccagcgattctcccacctcagcttcctgaatagctgggattacaggtgcatgccaccacacctggctaatttttgtattttttctagagatgtggtttcaccatattggtcaggctggtctcaaactcctgacgtgaagtgatccacccaccttggcctcccaaagtgccaggattacatacataagccactgtgtctggccagatggataaattttgataatgctaccactttgaaacagtccagtactatattaccatacctgtctttttaaaaatagtttatagatgcatgactcctctcccatcacaggagtcaagagtcctcagaggcctcttgtggctttccacaacttattgtcccatatttttatggccagttcatgcaggcaccccataaacctttttcccaacatattaccatacctgtctttttaaaaatacttcatagatgcatgactcctctcccatcacaggaatcaagagatactgttctaagtatagaggatagcatagtaaacaaaacataaacatcactgccttcacagagcttaccttattgtggaagagataaataaaataaacacataaattgtattgtacattagaaggtgaaaatgctctgaggagaaaaggaggaggaagtgatagggcatactagagttggtggtggctgaaattattaatagtgtggtcacgaaagccttcactaagaaggcaatatttgagcagacacctgaaagagatgaggaagtgaggttccaatgttagaaagggttttgttgttgttgttgttgttgtcatttgagacagggtcttgctctgtcacccaggctggagtgcagtagtgtgatcttggctcactgcagccttgatctcctggactcaagtgatcctcccaccccagcctcccaagcaaatgggagtacaggcgcgcaccaccatgcccagctacttttgtattttttgtagagacggggtttcgccatgttgcccaggctggtcttgaactcctgagctcaagtgatctgcccatcttagcctcccaaagcactgagattataggtgtgcacaccacacccacactagaaaggttaatctaagtgaatatttaaaactccaagatttaagacaggaggtaatcttagaaatatcaataaagaacaagtaactattcttagagaaatcaggggaagtgtcccaggaattagtaaacgattccagcaagatgggtaataggtggtatcgtgtaagaacatgagtttttacgttgtatatgttttaggtgtacaacatgatgttttgatatacatattctcagtaaagtgattactacagtcaagctaattaatgtatttatcatctcaggtagtatcttttgtgtatgtgggggataagaccacctaaaatctactcttagaagagttccactacttggtataatattaactatagtcctcatgctgtaccttagagctctagatttattcatgctaaataacccaagtttgtatcctttgacctgcatctcttcatctcccaccccacctctagtaaccaccattcttctctctatttctatgtattagatattttttaggttccacatttaagagagatcatgccgtatttttctttctgtgtctggcatttttcacttagcataatggaggacatgagttttttttttaactggaagaaagggacaggcccagtgttataaaggaaataggagagaaaaaaaaactggcgccaactgagaagactataggggaagcagtgtaattggggagatccagatttcagttagattaagaagctgagaatattcaaagaggctaaagagataagggatgatgtactatgtattccagaggacctaatggaaaaggctcaggatttgatgagggatggaaaatggagacataataggagatatgaagatccatatggtagttatgtgataaggaatgatttgggagtctgagacttcttgtggttattgacaaatagagttaaaagtataatgaatttagttctggtggtctcaagacaggtagtggtggtgaggctatgattattttgggggagagggtgagtgccagtggagatgtggatgcctgtagatgaatgttcttactgcagagtgagttgactcctgtggtggagaggaggtatgcatctatgaagcatttttaaaaagacaggtgtggcaatatagtactggactgtttaaaaatggtagcattattgaaatttatccatcaatttaaaaacatgacctattgggcctttgccctagttttgtacaatacatacctctatatttttatccttcagaggtaaatatttttataatttcaaagcagagatctaatgcctttaattttttaaaattttcctatagattatcattcttcatgagagtttttataaaatacttagtatggctgcagtggaaaaaaatatcttatacatgtttctgtagttaaacaatgggaaattaaacagttgaagcaattcagaatgaaatctacccaaactttttctgttaatcaaaatttcctaatattgttaagtttcaaatgggaactcaaatagccttctttcctaagaatcaaatgtgtgaggagtggtttctgtatttctgtcaaatggaaatattcttataatatctagaacccataaataaattaatttagaatatcttccaaagtgtcagtccaaaccctccagtgaagcagcttcactgaaatatcagtaaatagtgctggtcaagttacatatattttttacttattcttatcgtggtgatgaagtgacagttcaagaggaaacctagaatggatgacctccatgaaacacctgctatttggacttctcttgtcaattttcaaacatcttataatataattgtagacatttatctgaggagctgagaagcctgttaatcacttacaaattatatgacctttcaggaaccatcttgtcatacacatctctcataagaacacgacaggaaagaagagatttgaaactcacaataataatcactcaataatgactccctagtaagtcagctctcttacagcacatagaggacaataaatgaaggccaaggaaaacgatttgcaagcactttaaccttcctttacctctcttgagggaagcctcaaagtaaattcccagagagagactgagtagtttttactacttgcctgaagagaagctgaaagtgggaagaagggatctcacaaaccttaaattatgggcttttttcctgttactttttatttataaggacagaaggcagatatttgaaataaagttagtgatggatactggggtaaccagcttccagcatggcacccaataattctcacctccagatattcttctctttgtgtagccccctcccacattgagtagggctgacctgtataactaataagattttttttaatgaaaaagtgtaatctatgaggctacattctaaaaaaggcattgcttctgccttcatcttttggatcctttactctggggagaatacagctgttgtatcctaaggacactcaagcaacactatggagaagtccatgtggtgaagagctgaggccgcttacaaacagccatgtaagtgaactatcttagacacagatcccctagccctagtcaaaccttcagatgtctacaaccacagccaacatcttgactacagtctcataatagagcctaagccagaaccatctagctaagccattcccaaattcctcatacacgaaaacatgtggcataataaatgtttattgttgttttgaattataaattgggggggggaggtataatttgttatgcaataatagatgaccagtaaacaataaataataagtggctgggcatggtggcttacacttgtaatcccagcactttgggaggccaagatgggaggatcacttgagcccgggaatttgagaccagcccgagcaatatagcaagaccccatctctacaaaaataaaaataaaaataaattagccaggtgtggtggtgcacacctgtggtcccagacacccaggacactgagtcgggagaattgcttgagcccaggaggtcgaggctgcagtgatccatgatcacaccactgcactccagcttgggtgtcagagtgagagcctgtctcaaaaataaacagttaatttttaaaaagtaacagaaccagaatttaaacctaagtttgattccaaaggttgagttctcagaaggttaaaagtttcccaatgaatttttaaagttttccttagtttacctgttaaaataacttattctttaaaacaaattcaatttgcaccctatgtaaagaaaggaacatcaatccctttaaattgtttggtcagtgacatcatcctatatttactaatgtttaacaagttaggtcttgagcgcaatcagttagaggtcaattaatatccatgtctgtattccaggtatttgttttaaagtattgctggaaaaatctcatgcatgtgtcaggagttgtttttctattaagattcctcattgagtcttctgtcttgcaagatattaatgtgtgcgattccacctaatttgtcccttctcttgtctcttctctgaaaccactgtagtatataattttaatttccttaagaagaaaaattagtgagttgtttctgaattgcccttcactagaacagcaaatgattttaagaaccattttaaagttctacccagaaattgtatctatttttgtctttctcaattggcattttaaccctggaaaaataatattttgccatgaaaattctaaacatttcagactaaagaaacaaatatttgtatctcttctttgaggtgacatgagttaacatgtgacgttaaagatctcaatttgactatcagacctgagtattagagtaaaaatgggtgggactttctttgtcgaatagaatgcctatttactttgaggcagagcacctgtaactaccccctgagaactgtacgtctctcacttgaagcatctctgattatgaagatccaaattttcaaaatataaattaggaggcaattttttgttgaatgaaaatgttaaccgtagtatttagatagtagcacctgtagagctctatttacaaatctttgtttatatacagatttaataaagtaaaatataactcacaagcatgtattgctccaaacacattatattgcaaaaacacaactgcctactttaagcttcttacaagaaatctcaatttgtcgcattatttatttgatatgtattttcctcataacttactgctttccctctggccattagagccatgaattcaccagatgttcaatatttcaagtcttctatctcattttacagaaagcttcataatttacctgaaccttgggctgcattttcttcatttctttgtttatggaaaccatatgccatgctatcctatatatagacatcaacttccatcagaaagagaaagcatgtagagagtaagagatagactttgtgttgtggtaaaaatacacatagtataaaatttaccattagtgacatttagtatattcacgatgttgtgcaaccatcaccagtatctaattccagaacactttcatcagtgctaaaggaaacaccatacccattaagcagttacttccctcttctccatttccgcagcccctagcaaccaccaatctcttttctgtctgtatagatttgcctattgtgggccgggcgcgtggcttacccctgtaattccagcacgttgggaggctgaggcgggcagatcacaaggtcaggagatcgataccatcctggctaacacggggaaaccccgtctactaaaaatacaaaaaattagccgggcgtggtggcacgcacctatagtcccagctactctggaggctgaggcaggagaattgcttgaacctgggaggcagaggttgcagtgagccgagattgccccactgtactccagcctgggcaacagagcgggactgcgtctcccacaaaaaaacaaaacaaaaacaaaaatttgcctattgtggacatttcatataaatagaatcctataatatgtgacattttgtccctggtttctttcacttagcataatgttttcaggattcatccatataacagtactttactcctttttatggctgaataatattccattgtatggatacaacacattttgttttttccattcatcagttgatgcacatttgggttgcttacaccttttgactgttatgaatagggctcctataagcaaaaacattatgtacatgtttttgcttgaaaacctgttttcagtgctcttgggtatatacccaggagtggaattgctgggccatgtggtaattgagatgaaacatttaaagtgaaatcttactaaaccaatatgttgtccttttggggaggtgggagtcatattgttatttctcttttgttttgataacataacacctgaactcccacacctccctagaaaatgtggtatggaaatttatgccagaagactattagatggcatcaccaactcatacccaacatgagaactaaactttttttatacaaattgccaactgatataaaggcagttgaaggtccccaactctaacaggtgtactactatgtaccttcagaaaatgaaggttacagtcaagtaaccaaagtgtttctgtatagctttggagccagaaaccttagtcagattacaggaggttgcccttgggccactcactaaatttctctgttgtagtttctccatctgtaaaatggggataataatctctgctgctcaagattgacataaagatagggcatagcctggcacatagttgacaataaatattagtctcttttccccatatattcttatattcttcaaattaattgctctccaagatatcactatttttcttctcattttctctttcaggctaaaattaaattgccaaatacaaacccttctgatattcaaattgatatccaggaaacaatccttgaccttcgtactcctcagaagtgagtaaaacttagaactggaatagtgtattataatattaaagagtcttcagtcaatattattttttaaaatgtacagttattttgtatcacccctaaagtctgaagaaaagtggaaaattttgtattcagatgtttgatctacattaatataaacataaatatgtttggaaatacttggacttttttctactttgcatccgtgcatttggagtgggttaatgctattaaaacacaattcttgacacccagatgcagtttatctatcagaaaaaataactagaagtgaaaatgccattaagttgtaagtcttatatgtggtttttgtacattgattacataagggaagcaatatctttatacttttgtcattttgtggggctgtaaggttaaatttgagtgttttcatttaaatcaacaaaaagatcttgccatcaattactatctaaatacctcactgctttgtgcacatcttatctggatatagagcagtgagcacatactggttcactgcaatggtcctaactctgtaactcatgaacatttcaaactggatttgggaggcaggcagttgctggcacattttcttccttccattatcagtacctataattctcctttgttgagcttaggacttcaagaaaatgacaagaagatccttcatacaaaagattcctatgtgtaaacaacccaatatgcatatgtagcttaatcttggcttctatagtaaatgcatttaacccaaaatggtctacagataaatatatatcaaatgttttcttattatttacatcatttcaaaaatgtatcctcacagaacaatcatctcatgttataaaaattatattcactatttctgctgtttacttcaaggagtattgtacccttttgttgcattttatacacgaatttactcttccacataacctttacaaggaaaattggttaaatgaacaatcttccaagatatttgcaagcttgttaaaagcacacacatgtctacacaccatggggttaatttccgtttccctagcagttctcactgtctgtgagactttcatttagtggattctgatggatatctgtaatgacggcacagccatagcagctacctaaagattgatggagacagcagaaatactgaatacaatttttataacatgagatgtttgttctgtgaggatacattttggattaaaagtactttcccacatagaacatgggctatacactaggtcctttggatcataatgtacttatatattaaatgcgcagtgcagagaggtaccatctcaagaaaacctgcttaactaagatagaagacagaaaatataattaaggattttatcatgtttcctaaatacttgagaatcctttagagccatgcttttctctgaaattgcattatcgggaatgtgtcttgttttcgagtttattgatattcacacctactttctttagtttctaactttgacatcatataacgctatgtttatccaatctgagaaagatttgagagggcattctgttcttgtatctataaggcagaaacaagcgaatttattttaactgaattgaccagtggtttctgtcaaacaatagtcaatttcattcgaattaccaataaaacccaggtatttaccaaaataaataaagcagtttaccaaattcttcacttttttcaattggttgttttggcatgtagatacccaacatggagtaaatggagaggaggaaagacggagaaaattggataatttacggggatctcttaagtcttcatatgagatttcattatttttctaagtgaattctaagaatttcataaatgaataccttgaatgtgataataataacacattctaaagacaaatgtaagctaatttttggttgagtgctgctttagattactcacacatttgctgtgctcctttagtttggattgggaattgactgattttcaaagactgatagctaaaaaagaagttttctaaatgaaatagttgagttgcagctcagtagctatttctgcactttctttgaaaatagttatgtctccttcagtaaaccttaaaaaggtttttaacccagatatgtaagtcaaataattttgttaattatataagataaaaatttcattatgcgaatatgctgggaaccaggatgtcctttgcttaaatctcttgtgagcaacatcaacttaaactctctaatataagtataagcatgtaagtctctaaacttgagttcactgtagagattttttttgtatttacattcatgtattattgtttgcatttaatttctaatgaaaattaacactggatgaacctttgatcactgcctagactgtaacttctgaaaatgcaaatacattgtcaatgtaaaagtagaggtattgggtttaaatgtttgttcatatcttatagtactaatctatggtaattattcaaatgttattttgtggtgacctgaatacttgcttcatttatttactcactcattcatttatttattcactcaacatttataaagtcttccactagacactaagggagcaccaagataagatacattaatgtccttccatgaattgtacatggataagtatttggagaatttttattttgtttaaatataaatctcagtacagataataagacagtaaaacagacgacgaaaatatttcccttctcctaagagcctaaatcagttgtacagttctactgttcaacattttattatgtgaagccatactacttagaactacacagaaatgcaggcgtagatggatcattccaatggccactaactgtctcttttgaatttatttctctctggacagagaagtgcacattatcattggaactccttcttcagctgatttatagttgtcttttagtgcaacgaagctaccatactaagctttgctttcttttaaaagtgaatatattatcatttattgaataaagtataaaggaaatctaagtctagcacaacctatatagtaaacagatttaaaggatggactctacacggtttttgcactcactttttttttcctgagatgccaaatattacagtctacattaaaatgcattgccactacgtttggcaacgtattcaggcgaagtgtttttcctaccccacatggaatggaacaagagtcacagaaaatttatccttcaggttccataaatgtgtaataaatacttttaatgaacccagtcttctgaactcaggtttttgcaaaggaataaagaaggaattgattttcaagggttttgttttcaaatacatactagttctcaattcaagaacccaataagtgcccctaaaaataccatattcctttacttatttggatattataccttctaaaagagcatcctgtccaccttttatagagatactcagaccttctctactgaaaatgcgaggtaacaagtgtttcatgcatttaattttcttccaaaaccagcatgtgctgaccccgtgcataatttagattcatgccaatatggcagaattatggatgtctcatcccagcaatgcatctaaagcataaaactatccagcaactgaactataaaccacaaaataaacctagcaatctatcacagggaatttttgtcaatgtgtaagtagaaagaatcagaagcaaggagagagaagcactttcattgatttggtattgaaatcattcccagcctcagtttcaaaaactacacctgtggtagagactctgcttaaatctatgttagcagaagtgtcatagagccattccaattttcaaatttgtatccgtcggccacattgcatctatacataagtatgagtggcaacagatctgtccagcaaacttaaaagttgcatagttctatttctatgcctgtaaacatagcctgagactatgtaaaatgaggtcaattcggagaaaaataggggcgccaaaacaactgcttggatttttaagtccagaaaaactggtatactgtttgtgttatttaggcatatttttgatccaatatttacactatctaaatattgggggggggttgttttctaacactctagtggcatatgttgtttgcaattgtcttattgaaagtgatacatcattttaggaagctaaggttttattttgttgtttttttttaggaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaatgattgttttctatattctctttattattctgacatatttttgaaagggacaaaattcagttctagtgatattgtgaccatttacagtaatttctattactctgttaggaaatatgtttccttggccaggtgcaatggctcatgcctgtaatcccaacactttgggaggccgaagcaggcggatcacttgaggtcaggagtttgagaccagcctggtcaacatggcgaaaccctgtctctactaaaaatacgaaaattagcctggcgtggtggcaggtgcctgtaatcccagctactctgtctcaaaaaacaaacaaaaaaaggaaatatgttttcttatgtaaataaactattctatttttatagtgatagctgagtagaatctttacaggttaaaaaattagaatatttcatggtcaattacataattgaaatatgatcatgaaatggttggtccacttacttcagtagtctgaaaaacttatgctaattatttacatttacactgtgatacaatcagttgcatagcaattggtcattattattaccagagaattttatttggttgctttttcattgatttgagcaaatgatttacagtgttctctgtttaggctctcactgttgttctggaatatacaggtaataaatagtttgatgtaccatactatcaacatatttacttgagtaaggaacacttttgtgcgtacagtattatttggcttcttcagttgtgcttttaatgcttggatatagttaggttaaaaacattttttatatgcactaataattattagcattgcctttttgggtactgtatttatatgtagtcaattgaaatccttgactttaaaataaatttaaagtgtggcacattt

SEQ ID NO: 3555 - DNA, 36216 bp, human
cacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaagtattacatgtcgtttgactgtaactatcaaaaggtggggaagtgtgaccaaaaaaattaaatctgagtgaagggagagaacctagtttgaccaaagagggaggagtcattactccttaagagcttcttgtgataaggattcagaacagagaccatatttcctgaagaaaggaaaaaaataggactagggagaaaatttaaagcacagcaagaaaatttgccaggccgagcgcggtggctcccgcctgtaatcccagcactttgggaggccgaggcgggcagatcacttgaggtcaggagttcgagaccagcctgggcaatatggcgaaacctggtctccactaaaaatacaaaaattagccgggtgtgttggcgcctgcctgtctggatgctgaggtgggagaatcacctgagccctggagatcgaggctgcagcgagccgtgatggcgccactgcactctagcctgggcgacagagtgagatgtggtctcaaaaacaaaagagttctcatactccacctgtatctaaaaagagtccctccaacttctttttagatagaggtggagtatgagacttgagatagataaacgaagagaaaaaaatattaagtgtattgtttgtctgaaatgtactatagagcattcgataattcaggatgggttctacagataccaaggatttgcctctccatattaaaactaatttttctgtcaactcagcactttgagagtcctaagcgagggatcacttgagctcaggagttcgagacccatctgggctacacggtgaagccccgtctctacaagtaataacaaaaattagccggcgaaaccccgtctctacaaataacacaaaaattagccaggtgcagtggcacagcctgtagtcccagctacttgggaggctgaggtgggaagattacttgagccagggaggtcgaggctgcagtgagccgagatcgcgccactgcactccagcctgggctacagcaagaccctgtctcaaaaacaaaaaaacaaaaaaacccctccattttcaaaaaggattgggatggtacagactccttatgaataaatgactaaaacagaggaaatattaaatcaaaagacgcaatttttttttttttttgagacggagtctcgctctgtcgcccaggctggaatgcagtggtgcgatctcggctcactgcaacttccacctcccgggttcaagcgattcttgtgcctcagccacccgaggagatgggattacaggtgcgtgccactatgcctggctaatttttgtatttgtagtagagacggggtttcaccctgttggcaagctggtctcaaactcctgacctcaagtgatccgccggcctcggcctcccaaagtgctgggtttacaggcatgcaccaccgcgcccagccaaaagacactttttttgatttagtaatcaataactatttaatttcttgacttctttttctatgaaagattctaggtactttcaaaaagcatcttccttaaatatattttaaatttgaaacgaaaactgttaagttcccatagttacttatgagttagtacatttgatggtagcgaaagttagagacctgaaaaagaaaccattcttagtattgtaaagataaattcaaaatgaattatttttaataggtgggaaatcattgatgagtatagttatcaaaaaatgcaaagcagaaagcaattagtcagtatattataatttaattcagacataggcagagatgatatcactgttgtgttctcaagaattttaatggaggaattgctaaataaggcactatataaataaagttgcttcaatctaggaaagctgatttaaaaaaaataaataaataaaaataaagttgcagaagaaatgccaaatttatttagagaataaatagattttgagtacttgcaaatcattgtgttaaagtcagtattttacatagggatatatctatttacttaaacaagttccaaaaggatattgcttggtgactttttttggggggcagggaattgagtttctctctgtcacccaggctggagtgcagtggcatgatctcggctcactgcaacggccacctcccaggttaagtgattctccagcctcagcctcccaggtagctgggattacaggcgcccgccatcatgcccggctaatttttgtgttttttagtagagtcggggtatcgccatgttggccaggctgatcttgaacttctgacctcaggtgatccacccaccttagcctcccaaagtgctgggattacagacgtgaaccactgcgcccagccctgcttggtggttctttatcaccctgattttatttaccatatatacttgaattaataaaatctattatctatttgaatagtctgtaattcagagttttcactaatttaacctagacttttctacaattaactgatgtcaaaagccatctttattgatactgtgaaggagacaaataaaatagaaagcatgatcccagccttagaaccagtctgactttaactcaaggttactgatgttgcttaagtgctgtgggtctggagccaatctggttgaactttttcagcccctgactggctccagtgttatggtaatgagctggttctggagtgtcagttgctttagctcattgtggctagtagatggtccaatcatgcctctatttatgaagaccccaagtactcaggttaatgtgggaaaatcaaaggctctgtctggaaaatgttgccattagcattggcctagcaaaagagaaggagagaaagaaaaacaaagggcctaaaaaatttattttctaaatacaaatctcaaataaaagacagtaatatattttgtttttactgaaactcttaaattttccttactttaagtttattcttggcctatttaagtgacagtgccagattcaaacattttaggcagtgtggctccagaatcttctttttcattttttattgttattattttatttatttatttatttttgaaacaggatctcactctgtctcccaggctggaatgcagtggcccgatctgggctcactgcaacttccatctctgggactcaagcaatcatcctgcctcgggcccctgagtagatgggaccacaggggcacaccaccgcgcccgtctaatttttgtattttttgtagagtcggggtttcgctatgttgctcaggctgatctcgaactcctgagctcacgtgacccgtgagctcaccttggcctctcaaagtgtttgcattacagacgtcagtcagccaccatacccggccagaatcttctttttaaaaatcgctacactgtactatccaataagtcagggcaaaaggaagaatgcactccaaggtacaaaggcaggaaattatagagtatgtttaataagcagtttagtttttaacagaatatgtaggagaataatagaagggaaggacagaaaattacgttgggactatatcctgaaggaccttgattgccagactcaggatgaacttaaatgtatatcacatttagaaataaaagatagagctataaactaacactgcatagttcattgtagtgaagatagttccctacaaatagttctttgtagttcctaaaaagtcctcctgttttagtttttcagctgtgatccacttgtgtcaaatgaattttaataaatgttttttaataaagttgaataagttattctaaatatgttagacttcttaaaaagctagtagaatcttcctttccattgaattttgaatgtttttttctaaaaattcacaaactgtttttctcttttgatactttgaaccatttaactagttagtcacaaaatatttgggattcttttgtttatcaaaatacaatatcaacaaacttgtcatgattgatttatttatttttgttgtcatgatttattaatttgtgtttacagattattattacatttgatatggcaaaaatattttggctaaagtggtaattttattattatatttctattttaattgagctatagtgcaaatctatggcattttattccagcataatttggaagtccaattgtactttaagaagtctaactcctaatatgcttcagatatataaagtgttactaagaattattgtgaataatttaacaaaaacaagtgtacacgttccaaggaggaccatccccttcgaagtagtcactttaggagactaatctatttactctaatgttgttgttattgctaaaattgcttttgaaacttctgttttagaatcaccttgaggcatgtagcacattcttttgaatatcctcaaagaagaaaatcttcatattttgaaagtagacatgatatctaaatatatctagaaatcacttggcgacaaatctgatgtgtaatcaaaccaaatgataccataatgataccataatgatacctattttcttggtgatacatatgaaggcaattccaaataaaaagaaaaatcccaaaatattttgagcattgatagcataatttacatcagtgtataaccttccaaatgactattttgaaatataacattcagatgaatttagtcatgcttcatttggtattaatcaactgctgactatgtgccagctgcagttattaaagacactaaatctacaggtatagcttcccactgctcacactggcctacttcccacctaatgagaaccaggccagagttcctttccaaataactggtagggattcagaattaatctggtttttctgaatccagtatccaatgtaccaaaggaaccataacattccttcataacctccactgtgggtacctaggtgacacgagaaagccaccgacacagtgcctggtttgttttctcttttccagctggaactttgagccctattctgccctattctgaaccttcatctctagtagtcaacttgtgcacaaacctcaagaactgtaccccaccttctataggccagcgtccttcttcactttaaataggtctccctgtaaccatgacttcaacctttctgccctgaagcactgctcatgtctaaaaaatatgttcccaaatgatgatacataatgtatcatacactttttctagaggtagggcttaagaatctgcattttaaaccaactcccccaagtgattattaagcacattaaaacccgagaaccactatactaggtgctcaataagtgcttgttagcttgagtatgacattttagtaaagcaggctgaatgtttgagtttacttggtgctccaggtctgtgagttagcaaaatacatatatttgaaggagtttaaaaggatttccaaggaagtataagaaccaatggagtgatccagggaaagaagggagatatgacaataaaacatcttcatgtcttaaataaaacagaaaagtaaaatacctctttctgattatctttttcttcagataatggaatctgaaaatatggattctgaaaatatgaagacagaaaatatggaatctcaaaatgtagactttgagagtgtttcttcagttacagctctggaagccctctctaagctacttaatcctgaagaagaggatgattctgactatggacaggtggtcatatacttaacagttgaattagttttgttcatgggaagttgtggaactgtatttgaataacctgttcccacctagctgtgggaacagagctgtgtcatttgatacattcacaggaagctacaaggctgattatgcatgacaatgtaacctgtagtacatttctagcaaagataattatatttttctaaaccacctgaacactgaataggaaaatagttctgtaactgtggtagcaatagccacatctcaaaatgttgtcatttatatttatagccaaagaatgcttgacaaccattgcagagtggtagctaggattgtttaagcctaggcaatatttctataaaacaaatattttcagttatacagtattaattggaccaccaagtaccagtcccttaattttttaatttgtctacacattaacgcagaacagaaagtttttgagccaaataatagggcaaactagtttcagcctaccaaaattggcttcccagtaatgcacaaataaagttgtggagtctaattagttgagtagcatttggggtcaagataggtaatgccagcaaggcttgcagtagcaagatgggcttcattttgggtagaagagttcattgaactgacctttgaccactccaaggttactgccagtattcccagaacaattaaaacacttttatataactccctgctctccattctcctatttcttaactatcggtgagccttggctatcagactgcctatgatagggcaaacaaaatttggggcaaaaaatcccatatcataacagaatctgtcaatttgcataaaattattttaatgaagtgttttgttatatgaccaatttatcatgaataaatcatctttcacaaacgtacatatcaatttactcctcccaaaatttatttttgccacaatgtggagaaaaaagcaagctatgaacaggcagcaaattcagtggctcagattgacactgaactgagctaccaccctaaggaagagcttaggtggaatagggcagaataaataagatgtgaaatgggaataacatttgtagaagaactgagtcagcttggagccaggatcaggaaccaggaagttttagtcagggaaaagtcttagtagaggctaaacaaagaaacatcaggatgttaatgacagcattagctatacacaacaaacaggatacaggagaaaaagttaggaacaatgtatcaatgaagttgggaaggcaagctcatttttgctaccttagttgagtagcagaataataattttctggagcctacatcctaggaaaggtaaggttatgccatatagaaaaagtatatcaagtatttgagaaacagtgaccttgaatatagtgaagtggaacttgtaactgggacagattcaaatataaggatttaccctggttacagagcctattccatttggtgtttatggctggaggtgtttatttgcatctagaggtgtttctaggagaaaagatgagtgcttatgagaatagactaacataatattactgagttgtacagtttataaaggaaaattactataataatgtatgattctgtatatctgggttataaacaattttgagataattggtcattcagacaccacagtacagatatcattagaggacatacagtatcagaacagtgggagaataattaatgtttctaatgaactattacattttccaggagagaaactgcttttcattttttaacatgtattaatcttgggaactgtgggatgattacaagagtgatgtgtttttgaaaatatgctctctgaaaacagcaagagaacagttgcatacacattgcttcatttacactatcccttttctatatgacttgttaagaatctgggagattgaggagagagtgtgtctgtcatttttcaaagccatgaggggatcttaaggcctgtgggaaataaggttcactgctcttcacagacattataacgaggatgttctgtcttacatattacaaagtggcatgaattgcagtgataaattgctcagataattggctgtagattcatggtaaaggctcaaatgatgttctaatagaaaacaattgccagatggtttttaatgtttttatgatcccattccatcttttaacttgaaaattttatttttaatcatttattttcattaaattaataaattgaaactcccatgtgttctgagccaatcactgtccatggaaagtataccaatttttgtcaagaatgtccaaggttttacttctactgcttttaattttctgtggaaggcagcactcaactaaacaagaggccctcatgttctgagaaatgctttactctgactattagtgttctgatgattaataatttaagaaaagtactacacatttacatgacattagtgattaaaaaagagggaaaaaaatgtcccaaatattatcttgggattttcacataaaaatgcctgtaatgccttaaccgcagacatagcacttttgaaacaccttttggaaaggaatagttactgtctcagacactgttgagagattatagattaatttctgatttataactcttggaatagtttcacataataaagacccacgtgagctgttccatcagctttcaagaacagacactactctccttgcccaaacaagacattctaacttttgtacatgtctaaagtcttaggagatgaggacaggggcctgagaaaagagagatagaggtgctagttggccagtaggcaaggagataagaattttttgactgccagcagtggagtgagttggagctgcagggtctgtcatcagcaaaaaacaattggtaagaaattgggattttcttgaaatatcaaagaatccctgagacgggccaatgaggtggtgtcgctatgtgttatacttagttgaaaaaaatgaagattgcttgtattggtgagtcagggcaagtcctttggggatgtgtatgcttgtgcagaagatggaaaaataaacttatgaagttatgaagactgaagtacatcagcatgtattagagactattaatttgtggttgctgtttaaatccactagttcagtgtcatgaggcggtgggacagggaagtgtttcatacctatagtggaaaaaagtaaaagcagttatcagggcttttgaatgattaatctgaagtctgaatacttagcttctgcttagtgttagtttttatttctataaaactttcacatactctgtcctccatctgactacaaccagacactgctaaaccccaaaagtgtcaatgcctttatactaatacttggttctaaccttcatagagatgaatgtggctcgttcctctatccccagggatacatgattcactgagctggaactagggttttagcctgactaaagatcaattctgctcttgagtctattaaaccaaacactttttgaaagaacaaggaaagcatattcgaaatagtacttgacatctgtctttctgttttataacaatgatgggtaattaaagtggaaagctccatgagtttttttatggaaatcctatcaaatttaaagtatcactagtcatataggttatacaagtattaattacagaatattgaactttttctcctccctcagacaaatggtttatctactattggagccatgggtcctgggaatattggaccaccccaaatagaagagctcaaaggtaagttatttaacaaagcaatatagatcaatataatcttttccttggtagagaaattatagggagagtaataagtactaatactagtatttattaagatgaactaaataacaatgtattgtatacttggaaattgctaagatagtagattttaagtattctcatcacaagtaaatgataagtaggtgaggtaatccatatgttaatcagcttgagttagtcatccactgtgtatacatatttcagaacatcatatggtatatcataaatatatacaatttttatttgttcattaaaaatggagaaatgaataaataatttttaaatagaaaaaagatgaactaaaataatcatggaaatgatgaatagccatttacatataaagatgctgtttttactctaccactgcaggtaaatagtttttctaataatggaaatatatttgccttgaattatccacattccttgcatattttctgagatagaagaccaagaaagtcacgtgtggttagatcattttttattttttaaggtctatttaccaagatgcttagcttctttaccttctaccttcctatattctagcaatttcatggaattcattcattgaattgtttaataaatatttattgagaacctattgtatcaggcagtatgaccatctctgatactacaatgcagatcaaaacagaaaaagtccctgttctgattgagctaatagacttttggagaagacaataaaacaaataactacacaattttatcttacattaagaggcttatacattaacatctttgagtttacttataaaaaaaagtccaataaataaggctaaataatatttttacatttccccagcattttgagctatacatttttacagagttgaacattttacaaatctttaaaaatataaaaggctctaattctgttggtcatgatcaccattaaccagaggataggaagggagaggaagtgaatttcattcatcaatttagttaattgcaaaagattaatctggacaaatgtttaaaataatggctaaaatgaggtctaaggatggttttaaaatttcagttattattgctatacatactcaagaggctatttgccttacccaagagatattcgctccatggcagtctaattcacatttcatgtatttctgtgctgcctgtatttctgataatgtaggtctaataatctttaaattctgaaggcaatgattcatatgtaaaatgttatatataaatctgtagttaggctttacaaagcccgtgctagatagaagctgatcatttcaaaagaattgccagaattgaaaacctaacaatcgggtgcatttctgggaatgcttaaaatgactcaaagcagtgctctgcacctaatgcaggtctccaccggatgctacaatagttaaaacaaatgtgagctgggtttttgcatgcctactggagcctatccatttttaaacatttaaagatgacatgcagaaacccaacctcatgctcagctctgcatgaggaaaatgctggactaaaaaatgatcattgtatccactgctttcagtttctttaattgatattattgagaattatgtcatgcttgcatggaaaagatatcaaagcgtttttatatagtaaaaacaatgcaagataagacatttctctccacatcagattgattgtagttgtaattttttcttttatataaaaatatttttaaatataatcctatttatgtttctggaaaaatgtgtaatatttctttgcatatgtatatggagagagagagagagagagactggaatgatacacaacagaatactaacattgattatctccaggcagttggattgtagattattttcttctttttgtttatgtttttgccaaattctctacagttgttattaaaattctacaatgtattggttctgtattgatagaaacatttagtcagtagttactaatttagtttgttttgatcaaaaaaaaaagctagcgattacaaataatgttttatttcaatgaacccaaactgagtgtgaagaagaacaggagcaatttagagaaggaaaaaagcatgagcttcagctttatcttccctttcttcacagtcatccctgaaaccagcgaggaaaataatgaggacatctggaattcagaagagattccagaaggagcagaatatgatgatatgtgggatgttagagaaatcccagagtaagtcaaatgaagccaggaatgtctttaggagtttaagttagctgtgtcatctgataacattttactttttacaagattcataaagtaacataccacataaaagataaaactacagtgacacacggaaggcatgtgtaattgattatttttttccttctagagcagaaacaaataataaagcataacaccttcctttcagttactatctagcaaaaatgaaaaatatagtcatttccattataaatttatatttaatgtcaatttgttgtataatgtggaactagcagttggagaaagccagcccattaaattgcaagcattcatacaaactaaattacaatgccatgtttatttgtcaagcacttgcttttaattactcaatgttccacaatttcggtaaaaggctatgttctctctccaattatcaattattacccagacttgtttactagatattctaagattatatttagtgttcagtgtattttgcaagcagggttcaagacttgctttgtagccttttcaatacaatcaagttgtaaatatgaaatttagaattattataaaaagccttttattctgattttaaaagcactcatacttttaagaaccttaaaatatatttatatacatagattaaattattggtcaaatagactaagctttacatatgtgtattttgaaataaaatttggattgactatttagaatagcaggaaaaataaagccaacacttactaaattataatgtactatataaattcttaaagacttctatggcaagtgatctgacaacttttctaatactgaatacaaaactatccagtatttttttttttttttagacagagtcttgctctgtcgcccaggctggagtgcagtggcacaatctctgctcactgcaacctgcgcccctcctgggttcaagcaattctcctgcctcagcctcccatgtagctggaactacaggcacctgccaccacgcccagctaatttttgtatttttagtagagacggggtttcaccatgttggccaggctggtctggaactcctgacctcaggcaatccgcccgcctcagcctcccaaagtgctaagattacaggcatgagccactgcgcccagccaaaattgtccagtataaaacaagcaaataaacaaaaactccatgcttctgccttctacataagttctgaaaacagaagcagtgggagactgcagacaattaactagaaagaagtatccagctttcaaataaacaatgtcaagaccataaacctcataaaaaatcaaaggagattttaaaacatttcttagagaacgaagagagtaaatttgaagttatgtttatatagtgtccacgtatcatatgaaaagtaataattaagtcacttatttgtcatattgtctaacaaatgtcaaatatccatatgcagcaaacttcaaatttgagtaatttttcccttttcatcctgatgtttgatgttaggtagatagaacatccatgaaagctttaaatgaataataacttcaggttattatgaggaaaattgctttataagattttaaaaatcttcatcttctaccttatgaaaatacatttcaacatttctcagtggatgcagaggaaaataggtaaagaacatgaacaggcagttcaaaaaagaagaatcacaagtggccaagtaaaagaataacaaggagctgagctaaggcactggccttggggagaagtatgagggtctttatttgagtgagttttggatgaagagttggtatttggttagataaaatggatgagaggagagcgtcaaagatgatgctgaagttattagcttgggtgactgaggaaatgataatgccattaactttgataggaattataggttaagaagaagcagtgagtttgtttttgttttctttctttctccctttctttctttctttctttctttctttctttctttctttctttctttctttctttttctttctttctttctttcttccttttttctgagacagagtcttgctctgtcgctcaggctggagtgcagtggtgtgatctcggctcactgcaacctctgccttccgggttcaagcgattctcctgcctcagcctcacaagtagctgagactacaggtgcatgccaccaggcctggctaatgttttttgtgttttttgtagagacgaggtttcaccaagttggccaggctggtcctgaactcctggcctcaagcagtccacctgcctcagcctcccaaagtgctgggattacaggcctgagccacagtgcccaaccaaatttgttttttttcttcgccaaccaccgcccccccggccccgcccattgttcactgcagcctcaacctcccgggctcaagcaattctcccaccttactctcccaagtagctgggactacaggtgcacactttatttttgtgaagactgcgtctaaccgtgctgcccaggctggtctcaaactcctggactcaagcaatcttcctgcctcagcctccctaagcactagattacagttgagagccaccatgactagctggtttttgatatgtacactttgagttgtctttgggacatccaggcaaacctttgtagtagacagttggaaaattgcgtctggagctcaggataagagcaggagcttgagcaaatccattaggagcaatgaacatatagatcaatcctctgtttgttttaacctggcttcaccttcataaataattggtagatgttatagcctattaagagaaaagtgccccatagcaaatagctgcttattgttagccatgttcaaactcagagaaatcccttttttatttttgggcattcctattggcaaatggtcagaagttcaatcaagtcctttagtcttactatccagagatctacaatttcttcattaaggtagcattaagcataataataataataataataataataataataatttgtaaatatttgtttcattctatctgaagagatggggtaccttgtggtgggtgcttctataaaccattgtattcctggaggcccaaatttggagggaggaatgatttgtgaattgtcatgtgtggggtgaaatatcaggaaaacctttcattacactcagaattctgtaagactagattctaagcactatggtgtagctgtgctgactacattaccagtgtttctattgtagaattttagccgtggagatcattcagttcaaactcacccctccctcccataaatcatacaaatgtagaaactgagaccccatgagtttgtgacttgaccaaggtccacagttaatgacagaaacagtactaaacctgaattttctcctctgctctgtggtttaaacttggcagaggaaggtttctatcaatccctaggttatggactcagtatttttctgagctattgtttttcaggaacagactttccttttttttcttctgcttttaatcttattagaatcttattacaagttccctcaatctattttatttgtctagctctgaaacagttaaagctttattttagaaaataataacaatcctgcctttcagtgtttattttgaccacatttctagacttcttttcctttatgttctattatatgcctgaagacctgcaagcactttatttgtttagtccttttattttacctaatagcatatcctcataagttactagttttcttttctgtgacaggaaattgctctttcatctgagtccctataatcattgattttttttcaggtatgagattatattcagacagcaggtgggaactgaagatatatttttagggttgtcaaaaaaggactcctcaacaggttgttgcagtgaactagtggtaagcctctcctccccttcttcattttctatacaaccattgtagctaaattgactgactattatttacataatattgtaggcaaggttgtaaactctttaaaaatcgtggttgctatgtttcacgtactagggtaacaatgggatagacagtttaaaattgttaacttgtacaaaataaactaagtttacacatttggatgagatttacaaataaacataatggaatcatatgacacaatacacaatttctatttttatccctattaaaacttcccaattggattggactggattttcttccatcctagttccgtcccatgcatgccaactgattggttattaacttatgatgaattgacaggcaatcagaatgaagtatctccttccccgcatctgtcttatctcttatttctgtatttctcgtaatgactcagcttacaatgtgggacttaaaaagggattttcttaattttgggatctgacttctgattaaaaacactaagaaagacatctaaaatgttactttgctttcttatctgaatgacgctaccgaatgttggagagcatcctttaccaggtcactgtttctgtataacagttgtggcaataccaacaatatcaatgataccaccttacttttgcttatttcatcctgataatgaccttgttgaaaaatctgggcctaacccagagtgtggaatttgattcattttagcaacattaacaagtaattcttgtgttaaaattttattttttgagatcaggaactttgcttctattttttttcctcctttcttacaatacattatagaataccatggtgcccatgggagatgtgtaatatttttttcttaagcaaatgataaatggaatttctcttttgcatgaacttcaggttttctcttattagcaaaatctaagacattcaattcaatcaagtaacataatgggaatagtggctttaagtacctcaggagatttttcaaactctaatgagttatgctttcaagtaatcttgaagtaattagctcccagggttttaccagtaatattcaaattcctctcttttaaattattgtaaaattgtgtttttgatgtgtaatgttggggattgctctaaattctggaggaattctaggccctaaataaataaaactgttgcaagccttacagtttatctcatgcaaaaattgccactagttttaataataaaggtatcctgaatgaagaatcttggaaactaaatcatacctcataataggaatatatggtttatctaaaactcaataagtatatacagaagacttgatatttctctcaaatgaatttataatcaactggggagacaaaactaacataaatgaaccaattttattattaagaattaaactcagtgtaaacaattataagtcgaatagaagttcagaaggttgggataagtcatggacaccactgaaaggcagcagcaaataacacatttgttgatactgtggcactttgtcacgtgtatactgttccttttctctttctttcctttatttctctttgtttcttcatttattacatctttaaatacttagtgaatgttactacataccagggactgtcctaagtactagagatacaaaaataaatgataaacaatcaattgtcctcaaggaatttacagtaaaggagattgacacctaataaatcactgcagttcagtatggtaagtacatatttagaggcaaacaccatgaacagaatgatggttaccagagactgggaagggcagtgggcagtgggagttggaaatgtggggatggttaatgggtacaaaaatatagttagatacaataaacacgatctagtatttgatagtacaacagaaggataacagtcagcaataatttgttgtacattttagagtaactgagggagtacaattggaatgttcataacacaaagaaatggtgaatgatttaggtgatacaaacccaccccatttaccctgatgtaattattatacactgtatgcctgtatcaaaatatctcatgcaccccataaatatattttcctattatgtacccataaaaattaaagatagaaaaataaagacatatatcaggtacatagtgacataaagcaggaagagatcaacttcaagtggataatattactacagtggacaacattctaaaaagggcattccaagcagaagtaagagcacgtggaaaggtatccaggcatgaaatagcatggcatatttgagtaaacagagaatataacaagaataaagagtaagtgtcggtaataatggactagtaagctgactctcaaaaaagataaaagcttgtagcttttatttgtagcttgaatgttatcctgtaggcatactaatgatgacatccactatcattgcttactccactgacaagactcagagtaaataggttgttgagcccatctcaagtatttcttgctcaaatgtatatgcttatcattcttcttgataatatggtgtttccttgaatctaagacatcataaaattgtaaatgtgccatttatttaacaataacaatgtttcagaggaaaatagttataatgccatattataccaccattgattgtgcagttcgtctcaatatcataaacattaaaatgtggggaaaattgtacctgagaattgcctaaatatgttatttgtgtcctggacctggtctatatgtaacaatccaatccaaaaactttaagaaaaaatccttacttaaaccgagtaaggcaataggagtacaatctgtttacgtacaagaagtgatttggggtttaaaaattcacaaggaccatcctttcctttaccctccccagactccaaataagaaagcaagatttatgaatcctaaatcaaagcaacggtcctaaacaaaattatgaattaggaatgtcttcagcaaacccttcgaacctcaaacccaaagagccccattaaccaaacactccctgccctattgttatcctctgcaactgctttactcctgagtttgtagccaccaagtttcccttgccttaatctatatttaggtattttagagctagagctagccagtggtttacaggtttgttttgttttgtttctagctctcaagcttttttctttccaaataaaattctatgagtaagcccagtgtaataaacataaaaagtaccactgccttgtttaagaaggtactatcacccatgaggcagctcttaggagaatggctgaggctccttggaacacagttagaaagatgctgatctaatttctcatcctgatattacagttgataaactaaggtcaggcttacaaggtttcaaatactcatatacattaatggaagaataataagaaatctagagggcttctttttccttggtgacatatatgcttttctttaaaccccacgagtggaaggccctagcttatttcattttgttttggttgtttttctttttatcctctagccatattctccatccctctccccaaagctctcactgtaatgggtgtgatattaggttggtgcaaaagtaattgcagttttgctattgctgactactggttattgccagactgactgaagtactggacctcttgggtgccagctgaggagcatggaaaaaagaactataggtataaaaatatgtagcaagataccctaattctccataggattatttgtggcaggaaatgggatgggtgtattggaaaaataggtcagcagattctcattttcacccatggtgccaaaatccaaaaatgaatgggcctagggttattggtattctgccaaattaccctttgtttgttctaggagaggggaaaggcagcttgcagatagcttgatgctctttgacctagaatgaacacatattttgatgttttactttgatagatctatattgataaggcgacattctgatatgacccaagaaacaagccactaagcctattttttcccaacatcacctcctccctaggatatgattcttcccccatctttaaatctcactgagaatgggatgagagtcagggatgggatagaagtcagtcaccatctggcaggcagacacaaccaggagtcacatgtttatcatacatatttatctcagaaagtgctatcaatcattttgagcaaagtatttgctcatcctctaagaattcacttgcttcctgaatggtctgctcttcaaatcctgatttctttcttaaggttaaaacagttatatttgtttacttttttattttttgagacagaggctcactttgttacccaggctggagtgcagcctcaactcactatagcctcggcctcccagattcaaacaattctcctgattcagcctcccgagtagttgggattccaagcatttaccaccaagcccggctaatttttgtatttttagtagagatggggtttcaccatgttggccaggctggtctcaaactcctgacctcaggtgatccacctgtcggcctcccaaagtgctgggattacagccgtgaggcaccgtgcctggcctatatttgtttacttttaatgaaaaaatgtatttggctgcttgataatgaaataggttttgttctccattctattcccctctagaggatggacctagttttttttttttggtaggcttcctgattatgttaaccttgtttgattggttgtataccagaccatgtggcacagggaaggatatctgatctgtactatgattccttattgtcagttccaggcagcacagtaaaccttcacttaaatttctaatcgctgtctcagtaatatattcataatatatacatttatagttaatgtcataacactccttcataatgatggtggttgtgggacatggtaacaaatacttccttaaaagctaatctaatcatatagacagtatatttctgattatggaagtaatatatatgtaaaattttaagcaataccaaaattagtagagttgatgataaaagtccatcataatgagatggagaaaaattgagagagagagtgtgtgtgtgtttgaaataggctatggtcaaggatggaataaaggtaaaagatgtcatatacatattacttcatatatgtatcagtaattttacattttgatgatgtcattttgaggtttcatcaaaatatctgaatcacatggtctggaatccttgagctggacctggcagaaactcccgattccatgcaagcagattcacagattgaccttggaaattaccaatacttgagggatcaataaaggtagaggaactgagaaggatattcagagatgggagggaaaccatagtagtatccgctgctgtcaagcaggattaggatgcagaaagaactttgagatttgtcagttaagaagtctttggtgatctttggaagagagcagcttcagtggcatggccaacaccagattgaagaaagctgagaagtgaagaggaagtgaggaagagaagccagcaaatatagattgttctttgaggaagtttagtggtgaagaggaggagaatgaggaaatgatttttgagaaggaggcaggatttaggggagtttttttaagacaggagagatttatgtatgcatttcagctgatgacaagaatccatgcattcatccatgtaatatttatttagttcctactgtgtgtcactagagctaatgaacaaacagtaaaaaaaaaaaagtagtcatggtgtgggcccctaggtggaggcatttttggttgtcacaatgattacagaattttttgtttttttgagataaggtcttgctctgtcacccaggctggaacgtagtggcttgatctcagttcactgcagcctcaacctcctgggctcaagcgatcctcccacttcagcctctctggtagctaggactacaggcatgcaccacaatgccctgctaatttttcttttttattttttgtagagacagggtctcattatgttgcccaaactggtctcaaactcctgggatcaagcaattctgtcacctcggccttccaaagtgctggcattacaggcatgggcccccatgcccagctgattacaggatattattgtcatttagtattcagggccagggttgccttaaatcttgcaataagaggtatagtcctcaagaatgaagagttgtcctacacaaaatgcccatattgctttcctctagtttaaaaacactgattagataaagagggattgaagatatgagggtgctgctactcagcagcattccaccctgttgactactcttttttttttttttttttttttttttttgagacagagtcccgctctgtcgctcaggctggagtacagtgatgtgatcttggctcactgcaaactccaccttctgggttcaagctgttctcctgcctcaaccccctgagtagctaggacaacaggcacgcgccactacgcctggctaattttcatatttttagtagagacgggttcccaggctggtctccaactcctggcctcaagtgatctgcctgcctcggcctttcaaagtgctgagattacaggcatgagccaccgcacccggcctgctctctccttgaaacacagttttctctttactttaatgaccccattctcactgaggagtgaggaaagacttcactcttttcttccgaaatcactaggcattcctcctctctttcactcccaaatcactggctcttcctattctgccttaagttctctggagatttgacctatgtctttttttttctctacctattctcttttcacctagtctcatagctttaaatatcatttatctctctagtcctgaactctcccatgggctttggattcatataactcttttaactctcgctctgtcacccaggctggagtgcagtagcgcggtcttggctcactgcaagctccacttcccgggttcacaccattctcctgcctcaggctccggagtagctgggactacaggcgccccccaccacgcccggctaattttttgtatttttagtagagacggggtttcaccgtgttagccaggatggtctcgacctcctgacctcgtgatccgcccgcctcggcctcccaaagtgctgggattacaggtgtgagccaccacccccggcctcatataactatttacttgccatctcttacttgtttaatagacaactcaaacctaacatgtctaaaacagaactcttaattgtcttccataaacctttttctcattcatcttctttgtggcaataacattcacccagttgctcaagctaaaaacctaaatcagccatcattcctctttcctttatacctcatgtctaatccatcagcaagtattactggctgtaccttcaaaatatattctaaatccatctaattttcattaccactgcaattgctatcatgttactaacgatcatcatctctatctggaccattctgacgagtctctaatgacattatctccctgctttgactcttccttccctatagcctttccacacagagtgtaagagttcctttttaaaagtaagtcaaggccaggcacagtggctcacacctgtaattccagcactttgggaggctgaggcgggtggatcacctgagatcaggagttcgagactagcctggccaacatggcgaaaccctgtttctactagaaatataaaaattagccgagcatggtggtgcacttctgtagtcccagctacttgggaggctgaggcaggagaattgtttgaacctgggaggcagcagttgcagtgagcagagatcacgccattacactccagcctgggcgactccgtctcaaaagaaaaagtaaatcagaccatatcacctcttcgcttacagccctcaatggcttcctgttgcacttacagaacaaaatccaaactccttatcttaaaagtagggaagggccccgtgtgatctgacccttacctacttttacagtttcatccaatgtgacactttcttccttgtttgttatgttctgcttatcctgaccttctttttgatccttcaatatgccaagttatttcccgattccttgttattcattccacctgggtattccacctagtccctcagataatgaaattttacttcttcctttccaatcattttaacctatttcttgtttaattgcatgttagtacctccagaactatattatgtaataatagtgaatactgaactttatttcttatttctcactttaaatttttaaaaattaaaaaaatatgagtacgtaatagagatacactattcagccattaaaaaaagagatcctgtcatttgaaacaacgtgatggaactggagatcattatgttacgtgaaataagccaggcacagaaagacgaacatcacactttctcacttatttgtgggatctaaaaatcaaaacaattgaactcatggacatagggagtaaaaggatggttaccagagaatgggagtggtcattgagggaggggaagtgtggggttggttaatgggaacaaaaatataaatttctcactttaattggaatggttctagtgtttcttcatttagttagatactgatttttggggtatgtgttaaggatctgttcatctattctgattttaagagttctaagcaagaatagatgatgaatttaatcaaatgcctttttaccatttgtgaagatcatatgatttttttagtttttatctattggtaaattatattagcaaatttcttaatatggaaccatccttgcattcattcattcagtcaacaaatatttgttgagtgcctatgatttgccactaagtattttatgaaaactctcattaacaatgataagctgtaggaaaatgaaaaaaaaattaaaggtgatgggtctctgttttgaaattataaaaatatttacctctgaagtataaaaatgtagaggtatgtattgtccaaaaccagggcaaaaaaccagtaggtcatctttttaaattgatagataaatttcttttttttctttttgttttttgagacaaggtctcactctgttgcccaggctagggtgcagtggtgcaatcttggctcactgcaacctccacctcctgggttccagcgattctcccacctcagcttcctgaatagctgggattacaggtgcatgccaccacacctggctaatttttgtattttttctagagatgtggtttcaccatattggtcaggctggtctcaaactcctgacgtgaagtgatccacccaccttggcctcccaaagtgccaggattacatacataagccactgtgtctggccagatggataaattttgataatgctaccactttgaaacagtccagtactatattaccatacctgtctttttaaaaatagtttatagatgcatgactcctctcccatcacaggagtcaagagtcctcagaggcctcttgtggctttccacaacttattgtcccatatttttatggccagttcatgcaggcaccccataaacctttttcccaacatattaccatacctgtctttttaaaaatacttcatagatgcatgactcctctcccatcacaggaatcaagagatactgttctaagtatagaggatagcatagtaaacaaaacataaacatcactgccttcacagagcttaccttattgtggaagagataaataaaataaacacataaattgtattgtacattagaaggtgaaaatgctctgaggagaaaaggaggaggaagtgatagggcatactagagttggtggtggctgaaattattaatagtgtggtcacgaaagccttcactaagaaggcaatatttgagcagacacctgaaagagatgaggaagtgaggttccaatgttagaaagggttttgttgttgttgttgttgttgtcatttgagacagggtcttgctctgtcacccaggctggagtgcagtagtgtgatcttggctcactgcagccttgatctcctggactcaagtgatcctcccaccccagcctcccaagcaaatgggagtacaggcgcgcaccaccatgcccagctacttttgtattttttgtagagacggggtttcgccatgttgcccaggctggtcttgaactcctgagctcaagtgatctgcccatcttagcctcccaaagcactgagattataggtgtgcacaccacacccacactagaaaggttaatctaagtgaatatttaaaactccaagatttaagacaggaggtaatcttagaaatatcaataaagaacaagtaactattcttagagaaatcaggggaagtgtcccaggaattagtaaacgattccagcaagatgggtaataggtggtatcgtgtaagaacatgagtttttacgttgtatatgttttaggtgtacaacatgatgttttgatatacatattctcagtaaagtgattactacagtcaagctaattaatgtatttatcatctcaggtagtatcttttgtgtatgtgggggataagaccacctaaaatctactcttagaagagttccactacttggtataatattaactatagtcctcatgctgtaccttagagctctagatttattcatgctaaataacccaagtttgtatcctttgacctgcatctcttcatctcccaccccacctctagtaaccaccattcttctctctatttctatgtattagatattttttaggttccacatttaagagagatcatgccgtatttttctttctgtgtctggcatttttcacttagcataatggaggacatgagttttttttttaactggaagaaagggacaggcccagtgttataaaggaaataggagagaaaaaaaaactggcgccaactgagaagactataggggaagcagtgtaattggggagatccagatttcagttagattaagaagctgagaatattcaaagaggctaaagagataagggatgatgtactatgtattccagaggacctaatggaaaaggctcaggatttgatgagggatggaaaatggagacataataggagatatgaagatccatatggtagttatgtgataaggaatgatttgggagtctgagacttcttgtggttattgacaaatagagttaaaagtataatgaatttagttctggtggtctcaagacaggtagtggtggtgaggctatgattattttgggggagagggtgagtgccagtggagatgtggatgcctgtagatgaatgttcttactgcagagtgagttgactcctgtggtggagaggaggtatgcatctatgaagcatttttaaaaagacaggtgtggcaatatagtactggactgtttaaaaatggtagcattattgaaatttatccatcaatttaaaaacatgacctattgggcctttgccctagttttgtacaatacatacctctatatttttatccttcagaggtaaatatttttataatttcaaagcagagatctaatgcctttaattttttaaaattttcctatagattatcattcttcatgagagtttttataaaatacttagtatggctgcagtggaaaaaaatatcttatacatgtttctgtagttaaacaatgggaaattaaacagttgaagcaattcagaatgaaatctacccaaactttttctgttaatcaaaatttcctaatattgttaagtttcaaatgggaactcaaatagccttctttcctaagaatcaaatgtgtgaggagtggtttctgtatttctgtcaaatggaaatattcttataatatctagaacccataaataaattaatttagaatatcttccaaagtgtcagtccaaaccctccagtgaagcagcttcactgaaatatcagtaaatagtgctggtcaagttacatatattttttacttattcttatcgtggtgatgaagtgacagttcaagaggaaacctagaatggatgacctccatgaaacacctgctatttggacttctcttgtcaattttcaaacatcttataatataattgtagacatttatctgaggagctgagaagcctgttaatcacttacaaattatatgacctttcaggaaccatcttgtcatacacatctctcataagaacacgacaggaaagaagagatttgaaactcacaataataatcactcaataatgactccctagtaagtcagctctcttacagcacatagaggacaataaatgaaggccaaggaaaacgatttgcaagcactttaaccttcctttacctctcttgagggaagcctcaaagtaaattcccagagagagactgagtagtttttactacttgcctgaagagaagctgaaagtgggaagaagggatctcacaaaccttaaattatgggcttttttcctgttactttttatttataaggacagaaggcagatatttgaaataaagttagtgatggatactggggtaaccagcttccagcatggcacccaataattctcacctccagatattcttctctttgtgtagccccctcccacattgagtagggctgacctgtataactaataagattttttttaatgaaaaagtgtaatctatgaggctacattctaaaaaaggcattgcttctgccttcatcttttggatcctttactctggggagaatacagctgttgtatcctaaggacactcaagcaacactatggagaagtccatgtggtgaagagctgaggccgcttacaaacagccatgtaagtgaactatcttagacacagatcccctagccctagtcaaaccttcagatgtctacaaccacagccaacatcttgactacagtctcataatagagcctaagccagaaccatctagctaagccattcccaaattcctcatacacgaaaacatgtggcataataaatgtttattgttgttttgaattataaattgggggggggaggtataatttgttatgcaataatagatgaccagtaaacaataaataataagtggctgggcatggtggcttacacttgtaatcccagcactttgggaggccaagatgggaggatcacttgagcccgggaatttgagaccagcccgagcaatatagcaagaccccatctctacaaaaataaaaataaaaataaattagccaggtgtggtggtgcacacctgtggtcccagacacccaggacactgagtcgggagaattgcttgagcccaggaggtcgaggctgcagtgatccatgatcacaccactgcactccagcttgggtgtcagagtgagagcctgtctcaaaaataaacagttaatttttaaaaagtaacagaaccagaatttaaacctaagtttgattccaaaggttgagttctcagaaggttaaaagtttcccaatgaatttttaaagttttccttagtttacctgttaaaataacttattctttaaaacaaattcaatttgcaccctatgtaaagaaaggaacatcaatccctttaaattgtttggtcagtgacatcatcctatatttactaatgtttaacaagttaggtcttgagcgcaatcagttagaggtcaattaatatccatgtctgtattccaggtatttgttttaaagtattgctggaaaaatctcatgcatgtgtcaggagttgtttttctattaagattcctcattgagtcttctgtcttgcaagatattaatgtgtgcgattccacctaatttgtcccttctcttgtctcttctctgaaaccactgtagtatataattttaatttccttaagaagaaaaattagtgagttgtttctgaattgcccttcactagaacagcaaatgattttaagaaccattttaaagttctacccagaaattgtatctatttttgtctttctcaattggcattttaaccctggaaaaataatattttgccatgaaaattctaaacatttcagactaaagaaacaaatatttgtatctcttctttgaggtgacatgagttaacatgtgacgttaaagatctcaatttgactatcagacctgagtattagagtaaaaatgggtgggactttctttgtcgaatagaatgcctatttactttgaggcagagcacctgtaactaccccctgagaactgtacgtctctcacttgaagcatctctgattatgaagatccaaattttcaaaatataaattaggaggcaattttttgttgaatgaaaatgttaaccgtagtatttagatagtagcacctgtagagctctatttacaaatctttgtttatatacagatttaataaagtaaaatataactcacaagcatgtattgctccaaacacattatattgcaaaaacacaactgcctactttaagcttcttacaagaaatctcaatttgtcgcattatttatttgatatgtattttcctcataacttactgctttccctctggccattagagccatgaattcaccagatgttcaatatttcaagtcttctatctcattttacagaaagcttcataatttacctgaaccttgggctgcattttcttcatttctttgtttatggaaaccatatgccatgctatcctatatatagacatcaacttccatcagaaagagaaagcatgtagagagtaagagatagactttgtgttgtggtaaaaatacacatagtataaaatttaccattagtgacatttagtatattcacgatgttgtgcaaccatcaccagtatctaattccagaacactttcatcagtgctaaaggaaacaccatacccattaagcagttacttccctcttctccatttccgcagcccctagcaaccaccaatctcttttctgtctgtatagatttgcctattgtgggccgggcgcgtggcttacccctgtaattccagcacgttgggaggctgaggcgggcagatcacaaggtcaggagatcgataccatcctggctaacacggggaaaccccgtctactaaaaatacaaaaaattagccgggcgtggtggcacgcacctatagtcccagctactctggaggctgaggcaggagaattgcttgaacctgggaggcagaggttgcagtgagccgagattgccccactgtactccagcctgggcaacagagcgggactgcgtctcccacaaaaaaacaaaacaaaaacaaaaatttgcctattgtggacatttcatataaatagaatcctataatatgtgacattttgtccctggtttctttcacttagcataatgttttcaggattcatccatataacagtactttactcctttttatggctgaataatattccattgtatggatacaacacattttgttttttccattcatcagttgatgcacatttgggttgcttacaccttttgactgttatgaatagggctcctataagcaaaaacattatgtacatgtttttgcttgaaaacctgttttcagtgctcttgggtatatacccaggagtggaattgctgggccatgtggtaattgagatgaaacatttaaagtgaaatcttactaaaccaatatgttgtccttttggggaggtgggagtcatattgttatttctcttttgttttgataacataacacctgaactcccacacctccctagaaaatgtggtatggaaatttatgccagaagactattagatggcatcaccaactcatacccaacatgagaactaaactttttttatacaaattgccaactgatataaaggcagttgaaggtccccaactctaacaggtgtactactatgtaccttcagaaaatgaaggttacagtcaagtaaccaaagtgtttctgtatagctttggagccagaaaccttagtcagattacaggaggttgcccttgggccactcactaaatttctctgttgtagtttctccatctgtaaaatggggataataatctctgctgctcaagattgacataaagatagggcatagcctggcacatagttgacaataaatattagtctcttttccccatatattcttatattcttcaaattaattgctctccaagatatcactatttttcttctcattttctctttcaggctaaaattaaattgccaaatacaaacccttctgatattcaaattgatatccaggaaacaatccttgaccttcgtactcctcagaagtgagtaaaacttagaactggaatagtgtattataatattaaagagtcttcagtcaatattattttttaaaatgtacagttattttgtatcacccctaaagtctgaagaaaagtggaaaattttgtattcagatgtttgatctacattaatataaacataaatatgtttggaaatacttggacttttttctactttgcatccgtgcatttggagtgggttaatgctattaaaacacaattcttgacacccagatgcagtttatctatcagaaaaaataactagaagtgaaaatgccattaagttgtaagtcttatatgtggtttttgtacattgattacataagggaagcaatatctttatacttttgtcattttgtggggctgtaaggttaaatttgagtgttttcatttaaatcaacaaaaagatcttgccatcaattactatctaaatacctcactgctttgtgcacatcttatctggatatagagcagtgagcacatactggttcactgcaatggtcctaactctgtaactcatgaacatttcaaactggatttgggaggcaggcagttgctggcacattttcttccttccattatcagtacctataattctcctttgttgagcttaggacttcaagaaaatgacaagaagatccttcatacaaaagattcctatgtgtaaacaacccaatatgcatatgtagcttaatcttggcttctatagtaaatgcatttaacccaaaatggtctacagataaatatatatcaaatgttttcttattatttacatcatttcaaaaatgtatcctcacagaacaatcatctcatgttataaaaattatattcactatttctgctgtttacttcaaggagtattgtacccttttgttgcattttatacacgaatttactcttccacataacctttacaaggaaaattggttaaatgaacaatcttccaagatatttgcaagcttgttaaaagcacacacatgtctacacaccatggggttaatttccgtttccctagcagttctcactgtctgtgagactttcatttagtggattctgatggatatctgtaatgacggcacagccatagcagctacctaaagattgatggagacagcagaaatactgaatacaatttttataacatgagatgtttgttctgtgaggatacattttggattaaaagtactttcccacatagaacatgggctatacactaggtcctttggatcataatgtacttatatattaaatgcgcagtgcagagaggtaccatctcaagaaaacctgcttaactaagatagaagacagaaaatataattaaggattttatcatgtttcctaaatacttgagaatcctttagagccatgcttttctctgaaattgcattatcgggaatgtgtcttgttttcgagtttattgatattcacacctactttctttagtttctaactttgacatcatataacgctatgtttatccaatctgagaaagatttgagagggcattctgttcttgtatctataaggcagaaacaagcgaatttattttaactgaattgaccagtggtttctgtcaaacaatagtcaatttcattcgaattaccaataaaacccaggtatttaccaaaataaataaagcagtttaccaaattcttcacttttttcaattggttgttttggcatgtagatacccaacatggagtaaatggagaggaggaaagacggagaaaattggataatttacggggatctcttaagtcttcatatgagatttcattatttttctaagtgaattctaagaatttcataaatgaataccttgaatgtgataataataacacattctaaagacaaatgtaagctaatttttggttgagtgctgctttagattactcacacatttgctgtgctcctttagtttggattgggaattgactgattttcaaagactgatagctaaaaaagaagttttctaaatgaaatagttgagttgcagctcagtagctatttctgcactttctttgaaaatagttatgtctccttcagtaaaccttaaaaaggtttttaacccagatatgtaagtcaaataattttgttaattatataagataaaaatttcattatgcgaatatgctgggaaccaggatgtcctttgcttaaatctcttgtgagcaacatcaacttaaactctctaatataagtataagcatgtaagtctctaaacttgagttcactgtagagattttttttgtatttacattcatgtattattgtttgcatttaatttctaatgaaaattaacactggatgaacctttgatcactgcctagactgtaacttctgaaaatgcaaatacattgtcaatgtaaaagtagaggtattgggtttaaatgtttgttcatatcttatagtactaatctatggtaattattcaaatgttattttgtggtgacctgaatacttgcttcatttatttactcactcattcatttatttattcactcaacatttataaagtcttccactagacactaagggagcaccaagataagatacattaatgtccttccatgaattgtacatggataagtatttggagaatttttattttgtttaaatataaatctcagtacagataataagacagtaaaacagacgacgaaaatatttcccttctcctaagagcctaaatcagttgtacagttctactgttcaacattttattatgtgaagccatactacttagaactacacagaaatgcaggcgtagatggatcattccaatggccactaactgtctcttttgaatttatttctctctggacagagaagtgcacattatcattggaactccttcttcagctgatttatagttgtcttttagtgcaacgaagctaccatactaagctttgctttcttttaaaagtgaatatattatcatttattgaataaagtataaaggaaatctaagtctagcacaacctatatagtaaacagatttaaaggatggactctacacggtttttgcactcactttttttttcctgagatgccaaatattacagtctacattaaaatgcattgccactacgtttggcaacgtattcaggcgaagtgtttttcctaccccacatggaatggaacaagagtcacagaaaatttatccttcaggttccataaatgtgtaataaatacttttaatgaacccagtcttctgaactcaggtttttgcaaaggaataaagaaggaattgattttcaagggttttgttttcaaatacatactagttctcaattcaagaacccaataagtgcccctaaaaataccatattcctttacttatttggatattataccttctaaaagagcatcctgtccaccttttatagagatactcagaccttctctactgaaaatgcgaggtaacaagtgtttcatgcatttaattttcttccaaaaccagcatgtgctgaccccgtgcataatttagattcatgccaatatggcagaattatggatgtctcatcccagcaatgcatctaaagcataaaactatccagcaactgaactataaaccacaaaataaacctagcaatctatcacagggaatttttgtcaatgtgtaagtagaaagaatcagaagcaaggagagagaagcactttcattgatttggtattgaaatcattcccagcctcagtttcaaaaactacacctgtggtagagactctgcttaaatctatgttagcagaagtgtcatagagccattccaattttcaaatttgtatccgtcggccacattgcatctatacataagtatgagtggcaacagatctgtccagcaaacttaaaagttgcatagttctatttctatgcctgtaaacatagcctgagactatgtaaaatgaggtcaattcggagaaaaataggggcgccaaaacaactgcttggatttttaagtccagaaaaactggtatactgtttgtgttatttaggcatatttttgatccaatatttacactatctaaatattgggggggggttgttttctaacactctagtggcatatgttgtttgcaattgtcttattgaaagtgatacatcattttaggaagctaaggttttattttgttgtttttttttaggaagctgttgataactcttcctgagctggtggaatgtaccagtgccaaagcattctatatcccagagactgaaactcttgaaatcactatgactatgaaaagagagttagatattgctaatttcttctgaaactgcatgaaaaagataaaaagtagtaaaatggcattggtaacaattaaaaaactttgaaaaaaa

SEQ ID NO: 3556 - DNA, 32838 bp, human
ccacctgctcagaaaatcgaaccttcacaggattggacctcaacttggccttcttcgcagcactgatgaaagcagatttgggggactggaaaaagaacagagagatggtgagttctccatatctagggaaagcctaacctttgtcacgtcagagttaagatgtcccagtacaggtacactttgcattactgatcaaggagtcaataaacaaatattaattacctattagttgcaaggcaatgtgctaaatgcttccctatgtaattggtgtgttctgaaacagctgggcatgaattgaatttgggtagattgaaccccattattaatactctaggcctaggggagtttgcaaaagttctttagtaataacatacattgagtttttatatatttggttttcttacagtgagatagacctaaagggtgtctttttattattattattatatctgaatataagcatcccaaataatttacagaaatgatcttgttcacctcacagacatgtcctgcccctaggaaggagttgcataataaatactattttagatgtgggagaaaggagacctagcactccaaaaggatttatccacagttactacactattggggaatagagatgtgagagatttaacccaagtcttctggctttctagttttgggctctgcaccactttgtttatccaattctgtaagaaatgcccaaaaaatcagccaggcttgtatttatttatttatttttagacggagtttcactcttgtcgcctaggctggagtgcaatggtgcaatctcggctcactgcaacctccgctccctgggttcaagcgattctccagccttgcctcctgagtagctgggattacagtcatgtgccaccacacccagctaattttgtatttttagtagagatggggtctcaccatgttggccaggctggtcttgaactcctgaccttaggtgatccacctgcctcagcctcccaaagtactgggcttacaggccaccatgcctggctggctttttagttcttgaaaactctcccacaattttatcagaagcatgattagcaaacactggaaactaagcctttcctgggtgccccttggattctagctccctgctgagctctgtaaggcccagcaattaggaatacaggagtcgtgctgaggggcatcctcattgtctttgggggggcgtttattcattcttttgacaaatttagcaagggcctactacatgccacacactgttctaggtgatgagggatagagcagtgaataagacagacaaaactccctggcctcatggagcatccattccagcaggaatagacagacgataaatatcttttaggtagcaaagaaggactttgaggaaaaataaggcagggtaaaggactacacaagagaatgagtgagttagagtgggagtagtgagggtattattttagcaattttgaaatacataatacattattattaactatagtcatcatgctgtgcaatagatctcaaaaacttattcctcctgtctaactgagcctttgtatcctttgaacagcatctccccactccctcccaaccttagcctctagtgatcaccattctatgctccacttctatgattttgacttttttagattccgcatgtaagtgagatcatgtggtatttgtctttctgtgtctggcttataataattattattattatttcacttaggataatgtcttccaagttcatccatgttgtagcaaatgacaggatttacttcttcttaaagactgaatagtattccactgtgtatttataccacattttcttcatccattcatctgttgatggcagacacttaggttgtttccctatcttggctatggtgaatagtgctgccacgaacatgggaatgcagatggctctttggcatactaatttcaattcccttggatatatatccacaagtaggattgtgcgggttatatttttaattttttttttttttttttctgagaaggagtcttgctctgtcgcccaggctagagtgcagtggtgcgatctcggctcactgcaacctctgtctccgcggttcaagtgattcccctgcctcagtctcccgagtagctgggattacaggcaggcatcaccatgcccagctaatttttgtatttttggtagagacggggtttcaccatgttggccaggctggtctcgaactactgacctcaagtgatccacccacttcggcctcccaaagtgctgggatacaggtatgagccacggcgcccggccactgggggaggttattttagacaggatggtcagggaagacctctctgaggatgagacattaagcagaaacttaaggaagtgagggagagacagccaccaggttatctggagaaaggcttctgggcagaaactacagtaaaggccctgaagtgaattgaggtgtatgaagaacagcaaggaaggccaaggtggctggagtggcgtgatggagggggagcaagaggggagatgctcagagaggcagctgggggctgggtcatgtaggaccttgtaaaccacggtgagaactttggatttcactccactagagggatttgattgaacagagtctgatgtgcattttaaaaggaagcctctggttgctgtgtggaaaacagagtgtagaagggcaatggcaagagcatggagaccagttgggggtctctaagtacaatatttgtaactgcaataatatggttaaaacataatggaggcttgggctaggatggtactgatggagttgaaaagtgaatgaattctggatatattttgaatactgaattaggatgatatgttgactgattggatatgagagtgagaaaaagagagacttcaactgaaagaatggacttgccatttactgagatgaagaggactagggagtgaatcaggtttggggctacttcaaaccaccacccctatgggccttgccatggagcctgagtcctacaatcaggaatttctttgtgttaaggccctgaaggtccctgccagctgggaatacgttaagctattatctaccatttacactgcagttgagattcatttacccaatcagccacaggagggcagggccctaagatacacatcagaaacaaacgtcctcattgtgtcttgggccctggtcccagctggctctgtcagagccagcaatctcattcccacagaggggagattgcaaaaaaccacttctttcacctgagtccagcaggaactcaggcagtgagtgtcagtcctggctgcatagtagaaatgctgggaggagcttttaaaaatcctgaagcccagggcccaccacagaccaattacatcagaattcctgggggtgaggtctgagcatcagtatttttttcaagcttctgatgatttccaaatgcagccaagattaagaaccattgagctaaaggaaccttagacttctcatcctgagccaaaggggcaatttgttggcagcagacaatatagcacaatgaaatccagagctggagatcactgcagaaagtgattacagtattgattatacatggagttgataaatgcctttgtgtgttgcacagcctggtgctccaatcctgagcaggggctgcaggctgaggcagaagcaagagaaaggggcaagatagaaagatctgtagctatgctcaggcagctgtgtttgattccatctccacagtcatccaaagttccaccaaggtgccacaaacatgaggcaagtggaatctttctacctgacagtcacctctcttctctgccatcatctgccctcagatgcctgcatggcacagtgtgtagaacgaggcatctctagagacctgaatgggccatgcagctcaaccttcatttttcacatgtgaaacagaagcctgggaagaggatatactttacccaaagtattgaaataattgagtagcagagccgaaaccagaacccaggtttcctgagcctttgcttagtggttgttcccccacagcaggctaaagctgggagtcctttcctgatctttcatccactggttctggttctaccttggtgttatgtaatggactcaaacaaatgaagaaccccaactggtatccttttatgtattcaccacagtgaagagggtggcatccttgctatccctaccaaagatgcaagattagatcctgtcctagagagtttctgtttgtaccactgaaaaccaaagattcagttaattataggcacaaaccacaaaggaggaaatgaaattgccaatattttcagggattataatcatttccaggtgtctgtttcagagttattttcagcttgtttatacttcagtcctcattgacccttgtcctgttggtctctaagattccatcctattctcagtcttcagccttgatgctggtgactcattcattgccagctggtctgtgctagatgtcatggagtcacatctagccttatgctcagacacaggtgaggcctgctttgcagtgtgatatgaggagcctctcagaggcctccgtgtcccaaagcatcttcaaagctcagctctggggcttgaagttcgtaatattaggggcactcctttgaattacaatgttgagaattgggaaggcccgggtcaaaatgtgaatgcggtagcaggaaggcataatacacttcaggggccagcaaattacaggcctacataggccaaatcttgctcaccacctgtttttgtaaataaagctttactggaacacagccgtgatcttcatttatgtattgcctatggctgcttttgtgctaccacatatggcctgcaaagcctaaaatacttattatatggcccttcagagaaacagtttgccaacctctgcactaattcataaccatgcactaaccagctgtttttaaaacgtgcctgatgataagaatcactgaggagtgcttgttaaagcacagatgcctaggctcacaccagattttaaaagttagaatctctggaagagtggggcccagaaattgacattgttgaagagatcccaatccattaagcatagattaattgagcaccttaaggctggaatgtttgagctcttcactgaccctatttttttctccaagcagctgggaatctcactttgcaacaggcaccctttctggctaaaatgaattttggcttgaaacatgggactagaattgctaagtacctctggggccactgcaagctgcttgaagcaaatatgaagccagcagcttggtggaataaggaatagaagagagtctgcctttccctcagtgcagaattcagcagctggttattttttgaccattttttaaatttgttgtctgtattagtacagatgtcagggttgtgatcactcaaatcttgaccaaagtcagatatagggccaaatattttagaacaagatagggccccgctttggtaactgaaaaaaaacgaaactcagcttcttgaagctttgactgatttgcccttctggctacactgcctttgacacctgagcctacttataaccaattcctatagcaaccactgtgggagcctaggacaatggaggaccatcctggtttcaccagatcactactaggggaaccagggggccttccttcccacactcaagactgcctggacatgaacatatcctctgcctgacttccaaagcccgccacaaactacacctgactctctaaccacctctctccaagatcaccttttgctgcacttggtagttctatccacagctccctgcacacactgggcttgttatcattcctggacccacctcacgctgtttcctccctgtccccatccttcagggtctagagtgtccctttgactagctaaatgccatcactttacagcttagttcaaactctacctttatcctcaatccttccccaactcctcaattccccttcttggatttcctatagtactcctgttaatccacactgccattgctcacatccccaaccaggctgtataagcagagatgccattttatgttaatatgtctccccctagtaccaagcacatagtagacatggcataaaatatattagttgattgctaaaattagtaatgaattagttcattaattcagcatatatggttggagtatctaccatctgacaaacactatacgtcaggaagctctgtagaaaaccagtttctctgaggtggttcccattattttggctttctttttctgggcaggtggctccaagcagaagggattccagttctttaagtacaggctgttttcagaaccagaaaactgggtttcatttgaaacagattgtctgtacttgctttatcagggtcattcttggtcataatccggtactttatccgtttaaaaatatttactgagtgcctactgtgtgccaaggtctaaagatttcaagattaataaatatccagtcagtcatgaggactagttggtaattcaaagattaaggaatacccttaagtacacagaagcttattaagtggctatctatgcagtatggtttgaggggccctgggaaagaactcctgtgacccctctccccaattgtctgccatgctatgagtcactcttacaaggaaaatgtcatctgagagagactccatatcagaatcatttggtgagccttttcaaaagaccaataccagggcctcatctccagagcttctaattcaatgagtcagggcaagagcccaagtatcaatattttcatgttttctttttttttttctgtctctgctgctcgaatgaatcagaagtgactattaatagttttcagagcttctcagatggttataatggataaacagggtcaagaaccattaccaggccaggtgtggtggctcacgcctgtaatcccagtactttgggaggccaaggcgggcagattacttgaggtcagggattcgagaccagcctggccaacatggcgaaacatcgtctctactaaaaatgcaaaaattagccggtgtagtggcacatgcctgtaattccagctcctcgggggctgaggcaggagagtcacttgaacccaggaggtaaaggttgcagtgagctgagatggcaccactgcactccagactggataatagagtgagactctatatatataaaataaaattaccagccacagtatgtaggagtaggtattaggccattatcagccacataatgtaggagctattaatagaaggagacttgcagattgtctggtccagtggtttttttttttttttttttttttttaacaaatatagattcctaggccacatcctggacctattaggaggttgtcttctggaagtagtggtaatcaaactttaacatgacaagagttctgtaataggtagcagtctccttgcacccatgagatgccaagtgcctgctgtgaacacagtagtattttctgtgatgtagggggtataacattaaacacatattgggggtcttcaagaagctttcagtatagctaaagagagaagatctgtcaatggagacttgttaaggtggttacgttctatgacatttccataaacactgaattagtgaatactgaactgttgctccaatatttcacataaattatggtgttaaaatgtaaaaacaactcatcctagtagcttctatgttctttattttacaaagagaaaatgaagttcaaaagtgttaagtgacttgcctgaggccactccactcacaggtgccagagtcaagattcaaaccccgtccaactggccccagaactgcagtttctttcttgcactacactgcactgccccctatcgtcttcatcctctgattacctctgtatgagatctgacacaagaaggcagagcatcaccttgtccgacctcggctgggaacgtgtgcatggggtaaatcaaaattttcacactctgcacatgtctgcaaatgaccaggaaagtgccgtgattattgattttgggggttataaataaatttttgggagtaggcaaatttgcaaatagggaatctgcaaataatgaggatcgactgcacatgtaggtaaggctgacattcaattggcatgcactgggatggccataccagttgtaaaatacagagagattctttcacactgattggtaaataggcactgccctatgcttcctggatgccacctgacctctccccctggacctccttacaaacgtagatcaactacagggttaacatctggcacaactaggaggccttcaagattctgctccggtgttattactggcttatattttgactggattggctcctactgtacaggtcattaaatgttttgacaattagccccgtgtgtgtgtactcgtccacttctatgctccaaggatttagagagcacaagactgagaactagaatgtaagctctgtgagggcagggactatgtttgtcctgtgcactgctatattcccagcctagaagagtgtccagaatagtaggtatttaataaatgcttgatgagtgaatgaaaaaattagggaaatgctcattgagattagtcaggcaaagctgtttggagaacatgagtatcaaacaaggtcttaaaagaaacagacatgtattagaagagatgtggaatagcaaaaggacaaaagtccacggggcagtaagacctaagaaggaaatgtacctaagaaggagaaggaaatcagcctggccgcagcaaaggggccatgggttgggacctgcagagtaagcagaacagggggtaagaaaatgttggaggcactgggatgggaaagtcgagatagagattggggtgagtgttacgccctttattctgcacctaagtttggacacttgagttttgtttaggttgctttgttggctagaaactgggtttccttccttccgtcaaccaatatttattagcacctactctgtgccaggtgctggggatacagcagtaacaaaacacagtctctaccctcatggagctgacattctaatgagggacagagacaataaacatgtaaatataatatctcatgggaatgtaaaatggcaccgccactttgaaaaacagtctggcagttttttaataggctaaatatacacttactatttgatccagcaatcgtactcttgggcatttatctcagagaaatgaaaacttatgcccacaaaaatcctgtacacaaatattatagcagctttatttgtagtagttcaaaactggaaacaacccaatgcccttcaacgggtacatgattaaacaaactggtacatccacaccatggaataccatgggtactactcagcaataaaacggaacaaaatattgatacatgcaacaagttggatgaatctcgaggacattttgctaagaggacattttgctaagtgaagaaagtcaatccccaaaggttacatattatataattatatttatatattatttttgcttgttttttagagaagtggcctcgctctattgcccaggctggagtacagtggtgctatcatagctcaaagcagtctccaacacctgggctcaagcaatcctcctgcctcagcctctcaagtagctgggactacaggtgtgccctaccacacctagctaaattaaaaagaaaatttttagagacgaggtctcattctatgttgttcaggctgatctcaaattcctgacctcaagtgatcctcccatctcagcctcctaagtagctgaaattccagacaggagccacagtgccttgcttccatttatataatatttttgaaataaaattagggaaatgtaaagtggttgacagggattgggtgtaggcggtgaagtgagtgtggttataaaaggacaacacgaggaatcctttgggtgacagacttgtccagtgatttttttaagttttaaatttttgtgagtacatagtagatatatgtatgtctagggcacataagatactttgacacaggcatgcaacgtataataacaatattatggtaaatggggtatctttactgtgttggtggagacataaacccacatgtgataaattcatattgaatcatatacatacgttgtgtcattgttgatttcctggttttgctattgcacatagtttttgttctgttttgccttttttttttttttttttgagatggagtctcgctctgtcacccaggctggagtgcagtggtgcaatctcagctcactgcaacctctgcctcccaggttcaaatgattctcgtgccttagcctcctttgtagctgggactacaggtgcgttccaccatcccagcctaattttttttgtattttgtgtagggacaggatttcaccatgttggccaggctggtctcgaactcctggcctcaagtgatcaacctgcctcggcctcccaaagtgctgggattacaggtgtgagccactgcacccagcctattgcacatagttatgtaagatataaccactgggagaaacagggtaacagtacatggtatatctctgtactatcgttgcaacttcttgtgatctacaattatttcaaaagaaaagttaaaaaatataatatttcagctctgatgaaaaagtaagccatatcagaagatagtgaaggtagatgctattttagaaagggtactcaaggaaggcttctgcaaggtgagatttgagaagaactgactaacaaagtaaacccacattgggtctctgatcgcagtagtaaattctaaccacacatcaagcatgttttagtgggagaactggtggtcattttcaagacaggaggttgggaggttgggactgactgcctactgcccactaggcaactgcacacatgcagcaaagtggtggggaggggactattggtaacaacaatggagtggtggggcttgcctgcccagagacaagagaactggaactgagaaaggcctatctgcctgggaccattgtgtgtacatatgtgagagagcacatgagtgcgtgtatatgtgagtagtgtgtgtatatgtatgggtatgagtgggtgagtgtatgtgtgtgagtgtacgtgtgaggatatgtgtgagtctattatgcatgaggttgtgaatgaatgtgtgagtgtattgtgtgtgtgtgtcagtgtgtttgtatatgtgtgtgagtgtatgagtgtgtgagtgaagttcacactgatgcagaagaggtctgggagctgggggccatggggagaggcagttagtttgaaccaagattgatttgaatcttgctcttgcctggtgagcccatgctgtgcacctgtgttccatccctcgctgtgtcatctctctatggaaaatcttgccccatccctcaaggtccagctcaggtgcagcctcctccttgaagccttccctgatttcatgtccctcacccccaacagatgtgatctctcctgtggctatatattgagggtatggcatccatgctggggtgcagaggactgttgttggggacattaataaggggacaggtaggctggaggtagagtgagggctctgaattttgcacatggaagttgtgcacctgggtttgtgcatttaagttaagattgctataagggtacaactaataatggacactgaactttctaaatccaactcttgaggagagggggctagaaatttttacttttaataagtagtcctggcaacgattatgatcaggcatgtttaggtaacactgttatactttaaatctctcaatgtacagatgatgaaacaggtccagaatggggaactgactcattcaaggtcacacagccagttaagtgactgtaccaggacaaaaatgaatctgtttgtccaagggtaccccccagcaaatttatattaaattctctcacatatggtgctgtgtctcatacattgtaggtaacttatatgaatgaataagattggcacctatcatcgtccaggactttatgagagttcacattggacagatacattttaatggagtacagccaaaaagaagtggaaactgtatttggaattgaggcagtgggcagcttaagtgggtaaagaagaaggcacaggacagaacacagcacagcacagcccttcaaagtcctcagctttggacatgagcagagacatgctgttcagaaggtattctttaagttcactcctaaatccttggctcatatgttggttgtagtctctgaacccccaaccccatcactgttgctttccaatatggaaatgtcatctcttctcagtcaggaggaagggcagatggcaaagaggctcactcacctgatgagtgtgcagaactgtaagaacgatgaattccttagcgctcctacagagaaaagagggaataggagagtagtgtatcatgcactaggtattcatctagtacaagaagcaacaccagaatcttcccctggctttattcaggtatatggattaggatagagggcaatctgagtgtctgcatggacacttcacctcccatcatttgtggaggctgacacaaaccatccatattaattcacacaggtatccgaagatggtataatcattacctctggggttgtcattttttaggtcttcttttcatattccttctcacatactctctgtagaaatctccaaaccttagtagcaattttatctgtagactacaaaattctcaaggaaaactaaaagcctgcattatggaactcaaaatcagagagtcctgggaaccacgtacaatgattattggtaatttggtatttaagtgagaagagaaattcaaaggaaaaacccaaaggaggtcatttggtcaccatgactcatactcatcagatttgttttaattgagggaccaaaaaagagagccagggagcaacagatggaagccaaaactctccagatagcaaatattcaaaagaatgaagaatatgaaactcttctggcaagaattatgccagtgatcaaacaggctgtgaagtatgaaaattctctcccaggaatacataatcttttaaaagaactaaaagaaatggaaatagtttgccctgaaggagcttcccctctccttattggcccttttcaaatgtttatgtgaacaaagtcatttaagaagtagagtcaagctgcccttgattctggatattcaagaaatgccaaggcccgcagctcaagaactttgaacatctcccacatttggtgaggcaaattacagggattaatcagccccagggtttgggaagttaccagaagtaaagagttattctccaggaaaaatactaaagaaaatcctttatcttgaacagggaaggggcataacataagttggattatgtgactcgtctcctccagccccttgccatgtctccccatttcatttataacaaagccacagtccctatggtggcttcaaaggttctccattatctggacttattttctacaactctcctctttccttaccaactccagtcctactggcttctcccctgttccacaatcgtgccaaacacactcctggccttagggcctttgcactggctgttctctgtccaacaccttctcctccttcaagtctttcttcaaatgtcaccttttcaatgaggccaacattgaccctactgtttagttgcattttgcacccctgtgcccagcactcctgatcctctttacctagatctactttctattcttaataacatttatcagcttctaatatgttgtagaactacttataatcttttctgcttatgatgtgtctcctttcactaaaatgtaaactccagtgagccagggatctttgtctgtcttattcactgctgtatcttcggtgtgtggaacagtgcctggtgcatcgaggacaacaataaatactggttgattgactgactgactgaatgaatgaatgaataatccactggctcccaaggttatcaagagtgtgctctgctttaaccctgaaggagctctggaacccctcacgaaatcagcataccttgttctagagggcaaagaaatctactaaaaacaaagcagtgacttctgagggaccaggctgaaaaaaacccaacatgccctaataggatagaaagaactcacctcatattggtgtggtagcagagggtggagggtggagggtagggaaatgcaatagacaactgaacttggagaagagtcaaagaaaaggtcattagggatcagacacatttcatggtattgagctggaaggagcatgccaaggaagacatgctctggacttcaggagggaacattccaaagccctccagagctagttagagggtgctgttccatacacagaatgctatgtctgcctttgaaggcaagggaagagctctgggaccaggtgggcttttgggagcctggaaagatgagtgggatgaaaacactctgaaccaggaggacttgaaggagatggtggcagagatgaagtcagactaagcaagggggtgagagagaggaggagagagagagagagagagagagagggagagagaaaaggagagtgagagaaagagcgagcatgtacatggttccatttggagtgagatagccaagctcccccaaactgaggttagcccatgcaatttggagcctttacctcttattctctaattccttttcaacaaatctatgccagggtgtgtgtatgtggtgtgaatgtggggtaggagagtgtgtatggtgtgtgtgtgtgtgtgtgtgtgtgtgtgtgtgtgtaatgtgcacaggggtaaaggataggtaaagacaatgtgattactctccatgtacaaacagtggtaatcccacaatgttccttttgtcatctgctcccatctgcggagggcatttaggggacacaaacactatggacagtatccacattgggaggttctcttcctcaacccattggccagggattctgagttttttctggagttggggagttggtcaatatcttgcttgcactgtgcatatctaggatgttcttttaatggcttgattctcatctgtcacttggtctgtcccgctggaaaaaaacaaaggggctggggtgaagagattgtttgggtggaaggaggtaggggtgagactccagcagggagttctttgcgtctgttcacatcattggagatgctaagccagtgtgtatgaaggctcctgctgaccctgaatagctggcccctgaagttctgggttagccaggagccctctatagggcttctctgcctggaaggattctgctctcagagcgagggggggatagtggtggccccatgtcactggtgagtcaggggtggggatactgatcagttcctgccaaaaggcccctgttacctgataagttctatgagtctctccctcggggcttcactcacgtcttcctcattaatagccacaatctggtcaccagccaggagcttgttctcagaggggcctcctgcaaaggagaggagagaggtgtgagggcttagggttactgctgggaaagtccaggtctgggcaagtcccctgtgcctgtaggagctgaagcaggtgctgaggcctggagatggtgcaggctgagctgtggtggtgtagagggtgctattcgagctctctgctgctgttgctgccgctgctgctgcctataagcagatagagggcagaggaatgaagacagagaatggagtggacctcctttagttccatgccaagaaagacatgctctggacttcagaagcgagcattccaaagccctccagagctagttagaggatgctgttccaaacacagaatgctaagtctgcctttgaaggcaagggaggtactctagaaccaggtgggcttttgggagccccagaaagataagtggggtgaaaacactttagctgggtatggtttggtagcaaaaggtaccaaactcagataaggtcaataaacattttactggcttgcttcttaatgaggaacgcagacttccatttcacaggcgggacttgcttaggtacaaggaatgacttccagactactggaggtggtcaggcgaaaggaggacgaggaaggatcttcttacttgaatattattcatacttactagtctggaaggacttaggcattcacttgtctgaagacagaggaaaaagacctaaagggttatttttttttctacactgagaaatgccactgtccaataaatgaggggaacaaagcacatacttttgggcagttggatatttgttttttctccctcccatttcttttcttttctttttttatttttttgagatggagtcttactctgtcacccaggctggagtgcagtggcgtgatctcggctcactgtaacttgcccctcccaggttcaacagattctcccacctcagcctcctgagtagctgggatgacaggtacactccaccatgcccagctaatttttgtatttttagtagagatggaacatcatcatgttgcccagagtggtcttgaactcttgacctcaggtgattcacccacctcagcctcccaaaatgctgggattacagacgtgagctactgtgcctggctctccttcccatttctactgcaaggttaagaaagcagacctatctgagggctgtaccttcttggttggggcaaagggtgagggtagagggataccacaaggctatgctgcttctgatgtttagcaaagatcttcttggagaaaagcttctcagagacttggagagaatgagaagtcagaaccagcctgactcaaatttgaaagaaatgttcactgacattacccagtatcaaaccagccttgactctagtttgtgtccactttgaagggccagatcccaacttctccctctctctccaaagaagggggctgcccaaattccaaaaacatgaacatacacaacaaatacatcacttgagcacagctcaatggctctggagtgtagagcctatgtgctgaggatggctgtgccagcacaggcagcaggattcattgctcgaggagcaattgccctaaacacactaggccaagtctcctgacagtgcactggcttcaggagcaaagtgtggtggctaacagaacactctttacagccagacagacttggactctaactccaaatctgcaattcactggttgtgtgaccttgggcaagacatttaatctctctgagtctctcttacctcatctataaaatgggaaaataacagtacatatgcatcatagaaatgttgggaggatgaatgagatgataaatatacagcacttaaaacagctgattgacattgctaagaattggataaatggtagttattataccatccaagggacaattccttcaactcatttcattccttctatctacttctgccaaaaatgtcagtctcttaggtggaggccactctatctatcttcttcttcccttccctcccctccctttcttccgtctaacagaagaggtcctcatggaactcaacctcctttatgggccttggccctttgatggtaccggtaacatcagtctactactgctttcacaaatggtttgttggcttgatcaaccataattgctcctctgtaggacactttttttgtctttattacggcctcaaataaagaaccaaacaagtcctgtgcattcaggagccacctgggccagaagcagcactacggatcagctttttatagggcttttatagggctatgcatgccagccccatggctttttgtggttcgtgcctggggattttcttctcttgacccctccaactccttcttcattgttatacctttggcagctgaacccctctaggcctgggggcttccttcagctgtgcagattctgtctcatttgaagttaaagtaggggctcctggtggtctattactgaatgttagctggtccccctttcctctgatttctgatcagagattcaaaacctttttgccaaactgcatggctgactccagagccttaggtcagccacggactcctgtactaaattgttgttgttgtgtgtgtgtgtgttttttttcctctgtgccctctagttgaagagagagcttacaaaaatctttttctttcccttggaggattgcaaaattcatcaaatttctgcaagaccagtttgtactctggctgctcctcttgactgagcgagaaactgttgtaaacatctaaagcctcaggcccagcaagtcaggaataaagctccattccgtctgtcttttttgtcaatgcctagcagattcgaaacaaaacagtacttcagtctttttccatttcattcatgatagcagggcttcatagcttaggtggggctttgcttgttccatcccacatggtccctttcaggccctacttcccctgcatggcatcaaacaggcccaggtgcaaaccctggctctgttgctttatagctgagtgacactggacaagccacttctctttcattatgcctcagtttcctcgtttgcaaaatgggaatgatattacttatttactttgcaggggtggctgtgagaattaaacaatatgatgtaaagcacattgtagatgcttaatcaatggtagatgtttgttactgccactcaagcattcagagattccattatcctctcctctcctatcccacctgtggtctgtatcttgattctggtcttcaatggctgacctgtttcatgagtatatacatgtctccacagcctgatggttaggttcttgagaacaggaactgtgtcttgtacttcccgacaacattgctgggcttagagtaggcaatctatagatacttgttgaattaaatagaataggtacattttttttttgcaagacattatggttcttttatgaatgttctatgcaaagggaagctttattaagacccagacactgttaaacaatcaactgcagcctttttctagggccccaaacagcctcaattgttgtgtctatcagtcttaaaaggccagctccctcacacagttattggttggcaagtcttcaaccagtcttcatgaattcttcagcaagacagttagaatgcttggaagctctgctttttgggaagatatgtgggtgttgggagacaggagtcagggctaggggaacactctgagggacacctacctggcctcacagatcgaaccaccacaggcctctcactgccagccacgaagccaaagccatatatagggtctcggtgaacggtcacttgtcgcagtatctctgctggcagctgctcacattccatatcatttgcgctctcttcctgcatcacatgactggggaaaagggaaggtgggagcaaaacaagatgcacagggaactaagcctcagaaccagcagggagagatgccagttagggttctggccctggcacccaggagtttacagcttagcttcctacatcctctggagccaacagagatgatgactgcctcatatttcagattggagaaagagaaatctagaaagtagaagctactgtcttcagggctacagccaatagaagaaactgacgtcatgagcctgaaattagagtcagacccttcctctcagatattggaactccagaaggaacccaatgcaaatattctgcagaagttaactgtcatcctccactgacttagctattaactccgtaaaggaaaccaaagccttgcaggaagagaccacaagacaggcaagtaagtggcggaagaaatgtaaagttgttccagaagatggagcatcttcatgaagccctgatgcaatattttaaattttttttttaatttttattttttttgagacagagtctcactctgtcacccaggctggagtgcagtgacacgatcttggctcactgcaacctccacctcccggggtcaagcgattctcctgcctcagcctcccgagtagctgggactacaggcatgtgccaccacgcctggctaatttttgtatttttagtagaggtggggtttcgccatgttggccaggctggtctcgaactcctggcctcaagtgatcctctcacctcagcctcccaaagtgctgggattacaggcgtgagccaccatgcctggctcatcttgatgcaattttaaacttgaatacatcttaagttgtatacaaaaataaatgatttaagtagcatatataaataaatgtgctaatgtctgggaccaaaattgtccataatgccaacttctttcagttaatgagacacctggaaaagagttcctgttggccagaaggggagctgcatcctggggctgccagcaggcctgaaagcccagaggaactgggagaagagaaattactgccctaactccagggagagattacacattgttctcccgatttccacaacttaagtaactaaagcttaggaattccacaaaagcttcataaatgttctccatcaagggccaggggaggcatactgcaggcaagaaggggtctgagtgtagtattcaaacaaagagcactgaaggataagggtgtagagacactgaggcctgtgatagcactggtgccaaggccagggaagaaggtaaaaggaggaatggatggtcaaggagaagggcagggcaggtggagatggaggagagagggccagggccaagtggcccagagccttagctcactcatctggcaccactacagccccagaattttaggccttctagatagacgggtttaagttttctagcctcagtatgtgtatttgctaaaattatggttccaggcagagccctttggaacaagatacagagggccagtagctaattaatgaaactagtataaggtttgtaaaagaagtaggaggttttgacattctgagagcaatgcaattcttttttttttttttttttttttttttgagatggagtctccctctgttacgccagctggagtgcagtggcacgatctcggctcactgcaacctccacctcccaggttcaagcgattctcctgcctcaggctccaggagagtagctgggattacaggcgtgtgctgccctgcctggctaatttttatatttttagtagtgacatggtttcaccgtgttggccaggctggtcttgaactcccgacctcaggcgatccacccgcctcggcctcccaaagtgctgggattacaggcgtgagccaccgcgcctagccgagagcaatgcaattctttattagctaagaatatcaaattcatcagtagcaaatgcttcaaaccatttaggttatttatcaggacacagtttcagtaatagagagaagctttaggactatttataggggaaggggaaaagatttagaataattgtataaaagagaaattcatagtccagcaaagaactctgaagttgtctctatcatatgagatctctctggctacacctcacactggcttggagtctgtctgtcaccccttcgggaggtggaaggggatgctaggatgaggtcaagtctctggaaggcaaattcagaaacttgctccttccctctcacaccactaagataaatggtcacttttcaatagaaagtcactccgaagctggaatgtggctgattagtgtcctggacaggcacactcctaggacagggaccctctgagggtggccacaggctggcgcctctttcattttggctcctggtggcaggcaggagctcgtccttgaaggaagccagagaacatcttcctgcagctgccgtcttgcctcacccctagggctatttggaaaatgagccctttgcttcctgccacccggacttgttggcgctaaaaggacttcttgggatggcaccagctcatttccgacatgggcatcagccagggaaggctctgcagactgtggcgtggggagaaggaactccggcaaggaagacagacacaggtgtgctgcagaagcacttgggatactgtcctacgctcagtgctcccccttgatccctgccactgcagcctcccctttgcccttttttccttttttgaagcagaggacatctcagtttccactgggccttgaggtactaccacttctgaagaaaatgggcactcctggagccagaggaatcaataagcaaacagcgttttgtgacacaagtgctttgctttactcttttgactcatattaattaatcaacaagtatttatcaagtgcctactcagacagtccagcactctgggggacacaggagaagtgacaggtctctgccctcaaagagctttcagtctagctgggggagaaaagacaagtgggcatactgaacaagacaattacagtgctaactgagactggtagatgagatctacaactaagttccaacttgggtgttcagaagatggggcagagaagctggagaagactccatggaggaagtggggattgtactcactggccaagaaagggcagagttggggagagaggcaagaaccaaactctgtccataggtgcattccatcttcctgcaggtggcccagctatgtggttcataggtgcaggcatatctccaggtgtggctggagcacattcatccctgggttgtccctaactgagctggactaactgcccttaactgccttcaattctgcaagcagccctttcctcacaccactcccaggtatcttgggacaggggagaaacacctccattaacagaccagaaggccattttacaattcaaatggaagttgttccttccctcctggggtttgcctttttcagtgtctgcagctcagtccctctgaaatttgctaagtgcctggagacttgggagtgacactgaaggcaagcagtgatggatgacaggagctcagctgtccatgggtcacatgactatcctcctgggggaaacaggcaatttgactttgaaagatgtttggcttctggtcccttcaaatagggcatccctgaacaaaattgtgaagcagccaatgcttatcccccaccccccgccaccccacgaggtttgtttctgaggcctgctatttgcttctgttatttgccccaaagtatgtagtgccttcattctctccccttcttaccaaagtccccaaaggcattccctcaccttgtgccaggcttgccctctctatttagtgacctgggtaaaggcctagcctttctcttctgcctaatgataacaacactttatattcgtgtggttcttttcatttttacactcattacttcatttgagaaaagatgctttcacatccattatctcctctgtcctgccaaatacgctaggtgactgttcctcctccatcccagccttctaggtaggagatgaagaggcacagacccacagtggctaagcacattggtggcccagctggggccacatctctatgctaggacccacaattgcagcaccccctacctgctcccactcacggtcctggaccctctggctatccagagtctccattgcaagctgccccaaccctacagtcagcagcactctacgtcctagcccagcctgtatgctcagcccacatcataattaacctgtctctgagcctgttcactccgtgttgttgggagaatgaaatgagatcatggttacagaagcacttaggaaggttaagcatatcacacaaatgtagaggtggcgatgttattgatagcattattcggggtggctggaggagcagagaaggggagccaaatataaacttcacccgcttcacacagccgaagccctacccccaactccttgcctctaagagacagccccgcaacgtactctgtccgctcattctcccagcagctctttccctgacccaactacgagacaacctggctccctctagatgccctgattcctccgtgggctaaactgatccctccatcactgtccaaagagggactggtagctcgagctcatgctaacaactgttgctaggcagatgtggctaaaggacaaatgaaccgagaagaatatggaatgattctaagctgatgctctccctacttgtgctctcatgcaggaagatggaaatgtaacagctaaatttccaggcatccacttttagttctccagccctctttgcctttggctcctttttctttacatttggttggctccttggggagtcttgtcactcccctcaagactggcaggatttggaaccatgtggggccaattagccctctgattccggtaacagaagcctgactctactggaagctctagagatccagcatggcaggctagcagctgggcccccatgagatgcaacattcccctggtggcagagatggcagcccatccccagcgctgtgaagtagctgctctgtgtgcccttttgtaaggagcttgggcacaaacctttcttcctgtaaaggagtacttgcttgttattttggctagctgctccttattctagtagtgttgctcaaactttaaagtacatacaaatcacttgggagtattgctaaaatgattctgatgcagtaggtctggagcaaagtctgagactctgacaattccagggtcgtgcccaagctgctggtccacagaccacactttgaaaagccaggactgaaaagagtgctatttttagacaatggaagagctacagtcaggtgggaaaactgaggtgcttttattccactgggttatggcattgaaggcctgggttaaaacataaatgttatcttttgtggacacataaattcatgcaaacaaaggacttgctggttgaatcagatttaccccaggagagaacagggagggctctaaactgacatgaaataagacagatatggttgcactgaggaaaagtagagagaagatctgaaagactgggcactgtttaagtccagctgaagagtttggtcagcaaaaggacagcctgagaacactggcatctgggaggaaagtgaggaaaatgctgaaaaaagggacagtgccgaaaacaataatatcagctgccatttattgaggacttactatgctccaggtgctgtccataaattatgtcaccccattttcactataacctcatgagctaggtggtattatgtccattttacagataaggaaactgagatttgggaagagagattaagtaatttgctgaaggatatacaactatatatattgtgtggcaccaaaatgtgaacccaggtctgcctaactccagggccaatcatcttccacaatttgtgccaagaacctgtgcataaagtaggggttttgttgttgttgttgttgttttgtttttgaggcagcgtctcactctcattgtccagtggaaccatcacagctcaaggcagcctcgacttcctgggctcagatgatcctcccacctcagcctccccaggagctgggactacgggtgcatgccaccatgcctggctaatttttgtgtgtgtttttttttttttgtatttttagtagagacagggttttgccatattggctaggctggtctcgaactctggggctcaagtgatctgccagcctcagcctcccaaagtgctgggatttcagacatgagccaccacacccagcttaaagtagttttctagaaggcaatgagataggcttcgtaggaggatttggcagactactcttccctaagtgagctgagggccacttcaatgctgtctgtaagagcagcctcccttgaagcccccacacccagcggctcacctattagagactccagccccagaactggctttctacatgcctctaagcccaccctcccatatgtgagactcatcccataaggccttgcctttctgttcacttcagtcaccaccagaaagaagtctacttgcctctggtccttagaaccctgactctcctccccatagcagtctgtttacactcttatcccatttttctcctccctttcaaatccttccagtgtgtccactggaactctcagtcaacaacaaactctcctatagcctcaatttattcttggaaagtgtccttcaccttctttcccggttcagacctgtgtattccttgagggcaccacttccccaccagccctctcaaatggaaactggggtttttggttttgctttgttttgtttttcttttgcaaaattcaagtcctccgggacctgcaggtgagataagtatcctccttgcttgccaatgctgcctccaggccattactcctccttctttctgcaaaatatcctgcgtctttgaggaacctgcctgccgcccacctctaccactctctttctcctcattgttatctacagatttcctaagttggtcccacattcactgaggactttagttcccagtcacatgtgatttttccttccactccttaaaagaaatcatggtaaaatatccataacataaaagttaccattttaaccatttttattattgattgattcgattgattgagacagggtctcactctgttgcccaggctggagtacagtggcagaatcatagctcactgcagccttgacctcccaggctcaagcaatcccacctcagacacccaagtagctgggaccacaggcgtgtgccaccctgcctgactattttttatatttttttgtagaaatggggttttgccatattgcctaggctggtcttgaactcttgggctcaagcaatccacccacctcagcctctcaaaatgtcaggattacaggtgtgaaccaccatgcccagcctaccatttttagaagtacagttttacagcattaagtacactcacattattatgcaaccatcaccatcatccatctccacaactttttcaccttcccaaactgaaactctgtacccattaaatagtaatccctcattacccctcccttcccaacccatggaagccacaattctactttctgtttctatgaatttgattactgtaggtatctcatataagaggaatcatacgatatctgtctttttgtgactagcatattttgcttagcataatgtcttcaaggttcatccatattgctgcatgtgtcagaatttccttccttttaagactaatagtccattgtatgtatgtatcacattttattaatctgttgatgcatatttgggttgtttctaccttttggttgttgtgaacaatgtagctatgaacacgggtgtacaaatatctgttgcagcccctgtattctttcaggtacatacctagaagtggaactgctgaatcgtaaggtaattctatgttttactttttgaggaatcatcatactgttttccacagcagctgtaccatttatgttcccaccagcaatacacaaagattccaatttctccacagtttgccaacattccaatacttattattttctgtgtttttcatttttttttataatagccttcctaatgggtatgtccactccaactcttgatatcattattggtgaattcaacattcacagggtgacgaggagacctctaacaattgcttcttccgcttcactcactccatcatcacctacctagactttgggttatcagatattgcactacccccaaatctcaatgcccaatatcccactctctacgacaccatccattcttccagtttacctccacaagggctcccactgcaggaagcatctgaacgcgtcatgatcacctattcacttcccacttgatattcccttttactagaaatctcttccctcatttttcacagagctggctcttcatcctttaggtctcagcttaaatgtcaccttttcatagatgcccatctgccagcactttctcctacttattaccattcttactctccttcaagttcctttttattttcacttctcttcatgtccagcttagagttcctggtctatcattatgatcattcccttccaaacaccttcaacttccttacttcctctccccctgctatatctcatccctcgatgaactcaattctccatgcctgcattggagtagctgaagggtgctggagaaaaatcacacaactgggtagctggatttcactttaaaatccatgggtatatgctctcaattctgtctggccatttatctccctccctccctccctccctccctccctcccttccttccttccttctttctttccttcctttccttcttttcttttcttttctttctttctttttttttttttcccagagtttcgctgttgatgcccaggctggagtgcaatggcaccatctcggctcactgcaacctccacctcccaggttcaagcaattctcctgcctaagcctcctgtgtagctgggattacaggcacctgccaccacacctggccattttttgtactttttagtagagacaaggttttgccatgttggccaggctgctctcaaactcctgacctcaggtgatccgccctccttggcctcccaaagtgccgggattacaggcgtgagccaccacgcccggccatggtcaacactttctctgtctctaaaatgactatttcatcactcgccctctctcctccatcttcctcactttcccattttccccaagaaatctcagctgacgacctcatcccatagattactgaaaaaaacagaagctatcagatgagagctccttcatcttaccgccaccaaatctatacactaccctgtctacatctgtacccatgttttattttttccctattaaaatggaggtactggtaccaaaacagagatatagatcaatggaacagaacagagccctcagaaataatgccgcatatctacaactatctgataaaaacaagaaatggggaaaggattccctatttaataaatggtgctgggaaaactggctagccataggtagaaagctgaaactggatcccttccttacaccttatacaaaaattaattcaagatggattaaagacttaaatgttggacctaaaaccataaaaaccctagaagaaaacctaggcaataccattcaggacataggcatagacaaaaacttcatgtctaaaacaccaaaagcaatggcaacaaaagccaaaattgacaaatgggatctaattaagctaaagagcttctgcacagcaaaagaaactaccatcagagtgaacaggtaacctacagaatgggagaaaatttttgcaatctactcatctgacaaagggctaatatccagaatctacaaagaactcaaacaaatttacaagaaaaaaaaaaacaaccccatcaacaagtgggcgaaggatatgaacagacgcttctcaaaagaagacatttatgcagccaaaaaacacatgaaaaaatgctcatcatcactggccatcagagaaatgcaaatcaaaaccacagtgagataccatctcacaccagttcgaatggcgatcattaaaaagtcaggaaacaacaggtgctggaggggatgtggagaaataggaacacttttacactgttggtgggactgtaaactctttcaaccattgtggaagtcagtgtggcgattcctcagggatctagaactagaaataccatttgacccatccatcccattactgggtatatacccaaaggattataaaacatgctgctataaagacacatgcacacgtatgtttattgcggcactattcacaatagcaaagacttggaaccaacccaaatgtccaataatgatagactggattaagaaaatgtggcacatatacaccatggaatactatgcagccataaaaaatgaagagttcatgtcctttgtagggacatggatgaagctggaaaccatcattgtcagcaaactatcgcaaggacaaaaaaccaaacaccacatgttctcactcataggtgggaattgaacaatgagaacacatggacacaggaaggggaacatcacacaccagggcctgttgtggggtggggggaggggggagggatagcattaggagatatacctaacgttaaatgatgagttaatgggtgcagcacaccaacatggcacatgtatacatatgtaactaacctgcacgttgtgcacatgtaccctaaaacttaaagtataatttaaaaaaatggaggatgtttcttttcttctatcatggcgaatctccttacttatgttctggtaccatcccctcttatcttctcaaggattttactcctttgggcattcattctctttcctaaattaccaatctctccaccgctccagaatcatgctagcatgctgatggaaataatccatccttaagaaaacaaacaaaatacacctccctctactccacaattcccttgcagtgtctgccccattttcctggtcccttgggcaacaaaattcctcaaaaacgttttctacacatatgtctccacttcatctcttttttttcttttaaggacattgcattaaggacacaagacttcttcatctcttatttgctccccaatccactatcccctggcttccacatctatcactctgcagagttgctcttgttaaggtccgcattggcctccatggtcatctctcggtccttacctactcaacttctcaatagctgtagacagttagccacttcatccttgccgaaacattctcctctcctggcttctaggactacctccagactgtcctccaacctctctggccactttttcttagtctccttcgtgggtttctccttcccgacttaatcactagatattggggttccttggaactcagttccaggccttctagtctctctctattctttttcctaaggtgatctcatccagtcccctggttttaaatacaatctatattcagacaactcccaaatttgcattctaaccacacctcctctgtgagctccaaaactcatatactctgacatgtttaattttatgcctcacaggaatctcaaacttatcatgtccaaaactgaactcttgatttattttccctctcaagcctaggcttccctcagccttcctcatctcagcatatggcaccatcatctctttaattacttaagccagaaacctgagagtcattcttgaggcctgtctctccctttcccttacctccccacctagtccctcagtattgtataagtattgtcagctgtcacctaaaaacccatccaagaccgggcacagtggctcacacctgtaatcccagcactttgggaggctgaggtgggcagatcacctgaggtcagaagttcgagaccagactggccaacatggtgaaaccctgtctctactaaaaatacaaaaattagctgagcgtggtggcacgcacctgtaatcccagctactcgggaggctgaggcaggagaatcacttgaactcaggaggcagaggttgcagtgagccgagatcgcaccactgcactccagcctgggtgacagagcaagattctgtcaaaaaaaaaaaaaaaaggaaaaggaaaaggaaaaaagaaagctcatccgggatccgacaagctcgctccctctccatggctgtcacccagttcaagccaccatcatctctcctgtgagttgctgcagcagcctccttactggtctccctgtatccactgctgtccctttccaagtctggtctctacagatattgcaaaaagtccatatcagatcctgtcactcccccgcttaaaacccttcagacatttcctactgcaagcgaataatatccaaactccttttgtgtggcccataaggccctgcgtgatctctttctgccctacctgccaactcccccacccctccatgctactcttcctcttgcctacaatctggccctcctggcctccttttagtttctcaacacaccaaggtctttgccaccttaaggcatttccacttggtcttcctttttcctggaaacctcttttcccattcttcatatggctgaatttatcctttaggtctccacttaaatatcacctcctcacagagaacttccctggaaacttcaccttggttattctctactattgcaacctgttcatttcattctgcagactcatcacgatttgtagttatatattcatttgtgtgattatttggctttaaaccccataaaagtaggaactctgtcttttttgtacaacagtatatctcctccacttgatatgatacctggcacacaattaagtgcttagtattttttaaatcaaccaatgaatgaatagaagtgaatttgaggcatacagattagaatcctctggcctttacatgcagtttattatcaaatgcctacggtttgtgtctcagcctgtgaaaggcaggtttctgaatgggaagtctggcccatgggagaaacccctcaacatctctgtgcaaagacaaagtcagagagagaatgcagtcaaagaaagagtacagggagggctacaagctaagaaggaatgggagacggcatggttccagcctttttaggggagtgacagtgggaaatccaacagctattccttctcagggaaggaattttttaagggtagacaactatcctttcagaatggcaaggggcaggaggatgggcagggtgactttgaatagtccttcccactctgagagtctctgggtagatgatttggttactttcctagggctttctctctatttcccttgcaggtcttcatggccctgcaacttcctcttcagctgagcttggagaggcatcgtctggaaaacatggtggtatctggattctttttctggttgtccaaacagttgcttttccccagtgggctggaatggagacacctgtcacccattctagcaggtcaggagggagcagggggagagaccaaggtcatctttcctttcacaaatacctggaaacctggagtcaccttgcaaaagaccaaccccataatgcttcaaagagggaactgcagaggaccctctatacagctgtcccctcccctgtcccctcctccctcctgaagctatagtcaataaattcagacatgttgtctaa

SEQ ID NO: 3557 - DNA, 80923 bp, human
tggagactctggatagccagagggtccaggaccgtgagtgggagcaggtagggggtgctgcaattgtgggtcctagcatagagatgtggccccagctgggccaccaatgtgcttagccactgtgggtctgtgcctcttcatctcctacctagaaggctgggatggaggaggaacagtcacctagcgtatttggcaggacagaggagataatggatgtgaaagcatcttttctcaaatgaagtaatgagtgtaaaaatgaaaagaaccacacgaatataaagtgttgttatcattaggcagaagagaaaggctaggcctttacccaggtcactaaatagagagggcaagcctggcacaaggtgagggaatgcctttggggactttggtaagaaggggagagaatgaaggcactacatactttggggcaaataacagaagcaaatagcaggcctcagaaacaaacctcgtggggtggcggggggtgggggataagcattggctgcttcacaattttgttcagggatgccctatttgaagggaccagaagccaaacatctttcaaagtcaaattgcctgtttcccccaggaggatagtcatgtgacccatggacagctgagctcctgtcatccatcactgcttgccttcagtgtcactcccaagtctccaggcacttagcaaatttcagagggactgagctgcagacactgaaaaaggcaaaccccaggagggaaggaacaacttccatttgaattgtaaaatggccttctggtctgttaatggaggtgtttctcccctgtcccaagatacctgggagtggtgtgaggaaagggctgcttgcagaattgaaggcagttaagggcagttagtccagctcagttagggacaacccagggatgaatgtgctccagccacacctggagatatgcctgcacctatgaaccacatagctgggccacctgcaggaagatggaatgcacctatggacagagtttggttcttgcctctctccccaactctgccctttcttggccagtgagtacaatccccacttcctccatggagtcttctccagcttctctgccccatcttctgaacacccaagttggaacttagttgtagatctcatctaccagtctcagttagcactgtaattgtcttgttcagtatgcccacttgtcttttctcccccagctagactgaaagctctttgagggcagagacctgtcacttctcctgtgtcccccagagtgctggactgtctgagtaggcacttgataaatacttgttgattaattaatatgagtcaaaagagtaaagcaaagcacttgtgtcacaaaacgctgtttgcttattgattcctctggctccaggagtgcccattttcttcagaagtggtagtacctcaaggcccagtggaaactgagatgtcctctgcttcaaaaaaggaaaaaagggcaaaggggaggctgcagtggcagggatcaagggggagcactgagcgtaggacagtatcccaagtgcttctgcagcacacctgtgtctgtcttccttgccggagttccttctccccacgccacagtctgcagagccttccctggctgatgcccatgtcggaaatgagctggtgccatcccaagaagtccttttagcgccaacaagtccgggtggcaggaagcaaagggctcattttccaaatagccctaggggtgaggcaagacggcagctgcaggaagatgttctctggcttccttcaaggacgagctcctgcctgccaccaggagccaaaatgaaagaggcgccagcctgtggccaccctcagagggtccctgtcctaggagtgtgcctgtccaggacactaatcagccacattccagcttcggagtgactttctattgaaaagtgaccatttatcttagtggtgtgagagggaaggagcaagtttctgaatttgccttccagagacttgacctcatcctagcatccccttccacctcccgaaggggtgacagacagactccaagccagtgtgaggtgtagccagagagatctcatatgatagagacaacttcagagttctttgctggactatgaatttctcttttatacaattattctaaatcttttccccttcccctataaatagtcctaaagcttctctctattactgaaactgtgtcctgataaataacctaaatggtttgaagcatttgctactgatgaatttgatattcttagctaataaagaattgcattgctctcggctaggcgcggtggctcacgcctgtaatcccagcactttgggaggccgaggcgggtggatcgcctgaggtcgggagttcaagaccagcctggccaacacggtgaaaccatgtcactactaaaaatataaaaattagccaggcagggcagcacacgcctgtaatcccagctactctcctggagcctgaggcaggagaatcgcttgaacctgggaggtggaggttgcagtgagccgagatcgtgccactgcactccagctggcgtaacagagggagactccatctcaaaaaaaaaaaaaaaaaaaaaaaaaagaattgcattgctctcagaatgtcaaaacctcctacttcttttacaaaccttatactagtttcattaattagctactggccctctgtatcttgttccaaagggctctgcctggaaccataattttagcaaatacacatactgaggctagaaaacttaaacccgtctatctagaaggcctaaaattctggggctgtagtggtgccagatgagtgagctaaggctctgggccacttggccctggccctctctcctccatctccacctgccctgcccttctccttgaccatccattcctccttttaccttcttccctggccttggcaccagtgctatcacaggcctcagtgtctctacacccttatccttcagtgctctttgtttgaatactacactcagaccccttcttgcctgcagtatgcctcccctggcccttgatggagaacatttatgaagcttttgtggaattcctaagctttagttacttaagttgtggaaatcgggagaacaatgtgtaatctctccctggagttagggcagtaatttctcttctcccagttcctctgggctttcaggcctgctggcagccccaggatgcagctccccttctggccaacaggaactcttttccaggtgtctcattaactgaaagaagttggcattatggacaattttggtcccagacattagcacatttatttatatatgctacttaaatcatttatttttgtatacaacttaagatgtattcaagtttaaaattgcatcaagatgagccaggcatggtggctcacgcctgtaatcccagcactttgggaggctgaggtgagaggatcacttgaggccaggagttcgagaccagcctggccaacatggcgaaaccccacctctactaaaaatacaaaaattagccaggcgtggtggcacatgcctgtagtcccagctactcgggaggctgaggcaggagaatcgcttgaccccgggaggtggaggttgcagtgagccaagatcgtgtcactgcactccagcctgggtgacagagtgagactctgtctcaaaaaaaataaaaattaaaaaaaaaatttaaaatattgcatcagggcttcatgaagatgctccatcttctggaacaactttacatttcttccgccacttacttgcctgtcttgtggtctcttcctgcaaggctttggtttcctttacggagttaatagctaagtcagtggaggatgacagttaacttctgcagaatatttgcattgggttccttctggagttccaatatctgagaggaagggtctgactctaatttcaggctcatgacgtcagtttcttctattggctgtagccctgaagacagtagcttctactttctagatttctctttctccaatctgaaatatgaggcagtcatcatctctgttggctccagaggatgtaggaagctaagctgtaaactcctgggtgccagggccagaaccctaactggcatctctccctgctggttctgaggcttagttccctgtgcatcttgttttgctcccaccttcccttttccccagtcatgtgatgcaggaagagagcgcaaatgatatggaatgtgagcagctgccagcagagatactgcgacaagtgaccgttcaccgagaccctatatatggctttggcttcgtggctggcagtgagaggcctgtggtggttcgatctgtgaggccaggtaggtgtccctcagagtgttcccctagccctgactcctgtctcccaacacccacatatcttcccaaaaagcagagcttccaagcattctaactgtcttgctgaagaattcatgaagactggttgaagacttgccaaccaataactgtgtgagggagctggccttttaagactgatagacacaacaattgaggctgtttggggccctagaaaaaggctgcagttgattgtttaacagtgtctgggtcttaataaagcttccctttgcatagaacattcataaaagaaccataatgtcttgcaaaaaaaaaatgtacctattctatttaattcaacaagtatctatagattgcctactctaagcccagcaatgttgtcgggaagtacaagacacagttcctgttctcaagaacctaaccatcaggctgtggagacatgtatatactcatgaaacaggtcagccattgaagaccagaatcaagatacagaccacaggtgggataggagaggagaggataatggaatctctgaatgcttgagtggcagtaacaaacatctaccattgattaagcatctacaatgtgctttacatcatattgtttaattctcacagccacccctgcaaagtaaataagtaatatcattcccattttgcaaacgaggaaactgaggcataatgaaagagaagtggcttgtccagtgtcactcagctataaagcaacagagccagggtttgcacctgggcctgtttgatgccatgcaggggaagtagggcctgaaagggaccatgtgggatggaacaagcaaagccccacctaagctatgaagccctgctatcatgaatgaaatggaaaaagactgaagtactgttttgtttcgaatctgctaggcattgacaaaaaagacagacggaatggagctttattcctgacttgctgggcctgaggctttagatgtttacaacagtttctcgctcagtcaagaggagcagccagagtacaaactggtcttgcagaaatttgatgaattttgcaatcctccaagggaaagaaaaagatttttgtaagctctctcttcaactagagggcacagaggaaaaaaaacacacacacacacaacaacaacaatttagtacaggagtccgtggctgacctaaggctctggagtcagccatgcagtttggcaaaaaggttttgaatctctgatcagaaatcagaggaaagggggaccagctaacattcagtaatagaccaccaggagcccctactttaacttcaaatgagacagaatctgcacagctgaaggaagcccccaggcctagaggggttcagctgccaaaggtataacaatgaagaaggagttggaggggtcaagagaagaaaatccccaggcacgaaccacaaaaagccatggggctggcatgcatagccctataaaagccctataaaaagctgatccgtagtgctgcttctggcccaggtggctcctgaatgcacaggacttgtttggttctttatttgaggccgtaataaagacaaaaaaagtgtcctacagaggagcaattatggttgatcaagccaacaaaccatttgtgaaagcagtagtagactgatgttaccggtaccatcaaagggccaaggcccataaaggaggttgagttccatgaggacctcttctgttagacggaagaaagggaggggagggaagggaagaagaagatagatagagtggcctccacctaagagactgacatttttggcagaagtagatagaaggaatgaaatgagttgaaggaattgtcccttggatggtataataactaccatttatccaattcttagcaatgtcaatcagctgttttaagtgctgtatatttatcatctcattcatcctcccaacatttctatgatgcatatgtactgttattttcccattttatagatgaggtaagagagactcagagagattaaatgtcttgcccaaggtcacacaaccagtgaattgcagatttggagttagagtccaagtctgtctggctgtaaagagtgttctgttagccaccacactttgctcctgaagccagtgcactgtcaggagacttggcctagtgtgtttagggcaattgctcctcgagcaatgaatcctgctgcctgtgctggcacagccatcctcagcacataggctctacactccagagccattgagctgtgctcaagtgatgtatttgttgtgtatgttcatgtttttggaatttgggcagcccccttctttggagagagagggagaagttgggatctggcccttcaaagtggacacaaactagagtcaaggctggtttgatactgggtaatgtcagtgaacatttctttcaaatttgagtcaggctggttctgacttctcattctctccaagtctctgagaagcttttctccaagaagatctttgctaaacatcagaagcagcatagccttgtggtatccctctaccctcaccctttgccccaaccaagaaggtacagccctcagataggtctgctttcttaaccttgcagtagaaatgggaaggagagccaggcacagtagctcacgtctgtaatcccagcattttgggaggctgaggtgggtgaatcacctgaggtcaagagttcaagaccactctgggcaacatgatgatgttccatctctactaaaaatacaaaaattagctgggcatggtggagtgtacctgtcatcccagctactcaggaggctgaggtgggagaatctgttgaacctgggaggggcaagttacagtgagccgagatcacgccactgcactccagcctgggtgacagagtaagactccatctcaaaaaaataaaaaaagaaaagaaaagaaatgggagggagaaaaaacaaatatccaactgcccaaaagtatgtgctttgttcccctcatttattggacagtggcatttctcagtgtagaaaaaaaaataaccctttaggtctttttcctctgtcttcagacaagtgaatgcctaagtccttccagactagtaagtatgaataatattcaagtaagaagatccttcctcgtcctcctttcgcctgaccacctccagtagtctggaagtcattccttgtacctaagcaagtcccgcctgtgaaatggaagtctgcgttcctcattaagaagcaagccagtaaaatgtttattgaccttatctgagtttggtaccttttgctaccaaaccatacccagctaaagtgttttcaccccacttatctttctggggctcccaaaagcccacctggttctagagtacctcccttgccttcaaaggcagacttagcattctgtgtttggaacagcatcctctaactagctctggagggctttggaatgctcgcttctgaagtccagagcatgtctttcttggcatggaactaaaggaggtccactccattctctgtcttcattcctctgccctctatctgcttataggcagcagcagcggcagcaacagcagcagagagctcgaatagcaccctctacaccaccacagctcagcctgcaccatctccaggcctcagcacctgcttcagctcctacaggcacaggggacttgcccagacctggactttcccagcagtaaccctaagccctcacacctctctcctctcctttgcaggaggcccctctgagaacaagctcctggctggtgaccagattgtggctattaatgaggaagacgtgagtgaagccccgagggagagactcatagaacttatcaggtaacaggggccttttggcaggaactgatcagtatccccacccctgactcaccagtgacatggggccaccactatccccccctcgctctgagagcagaatccttccaggcagagaagccctatagagggctcctggctaacccagaacttcaggggccagctattcagggtcagcaggagccttcatacacactggcttagcatctccaatgatgtgaacagacgcaaagaactccctgctggagtctcacccctacctccttccacccaaacaatctcttcaccccagcccctttgtttttttccagcgggacagaccaagtgacagatgagaatcaagccattaaaagaacatcctagatatgcacagtgcaagcaagatattgaccaactccccaactccagaaaaaactcagaatccctggccaatgggttgaggaagagaacctcccaatgtggatactgtccatagtgtttgtgtcccctaaatgccctccgcagatgggagcagatgacaaaaggaacattgtgggattaccactgtttgtacatggagagtaatcacattgtctttacctatcctttacccctgtgcacattacacacacacacacacacacacacacacacacacaccatacacactctcctaccccacattcacaccacatacacacaccctggcatagatttgttgaaaaggaattagagaataagaggtaaaggctccaaattgcatgggctaacctcagtttgggggagcttggctatctcactccaaatggaaccatgtacatgctcgctctttctctcactctccttttctctctccctctctctctctctctctctctctcctcctctctctcacccccttgcttagtctgacttcatctctgccaccatctccttcaagtcctcctggttcagagtgttttcatcccactcatctttccaggctcccaaaagcccacctggtcccagagctcttcccttgccttcaaaggcagacatagcattctgtgtatggaacagcaccctctaactagctctggagggctttggaatgttccctcctgaagtccagagcatgtcttccttggcatgctccttccagctcaataccatgaaatgtgtctgatccctaatgaccttttctttgactcttctccaagttcagttgtctattgcatttccctaccctccaccctccaccctctgctaccacaccaatatgaggtgagttctttctatcctattagggcatgttgggtttttttcagcctggtccctcagaagtcactgctttgtttttagtagatttctttgccctctagaacaaggtatgctgatttcgtgaggggttccagagctccttcagggttaaagcagagcacactcttgataaccttgggagccagtggattattcattcattcattcagtcagtcagtcaatcaaccagtatttattgttgtcctcgatgcaccaggcactgttccacacaccgaagatacagcagtgaataagacagacaaagatccctggctcactggagtttacattttagtgaaaggagacacatcataagcagaaaagattataagtagttctacaacatattagaagctgataaatgttattaagaatagaaagtagatctaggtaaagaggatcaggagtgctgggcacaggggtgcaaaatgcaactaaacagtagggtcaatgttggcctcattgaaaaggtgacatttgaagaaagacttgaaggaggagaaggtgttggacagagaacagccagtgcaaaggccctaaggccaggagtgtgtttggcacgattgtggaacaggggagaagccagtaggactggagttggtaaggaaagaggagagttgtagaaaataagtccagataatggagaacctttgaagccaccatagggactgtggctttgttataaatgaaatggggagacatggcaaggggctggaggagacgagtcacataatccaacttatgttatgccccttccctgttcaagataaaggattttctttagtatttttcctggagaataactctttacttctggtaacttcccaaaccctggggctgattaatccctgtaatttgcctcaccaaatgtgggagatgttcaaagttcttgagctgcgggccttggcatttcttgaatatccagaatcaagggcagcttgactctacttcttaaatgactttgttcacataaacatttgaaaagggccaataaggagaggggaagctccttcagggcaaactatttccatttcttttagttcttttaaaagattatgtattcctgggagagaattttcatacttcacagcctgtttgatcactggcataattcttgccagaagagtttcatattcttcattcttttgaatatttgctatctggagagttttggcttccatctgttgctccctggctctcttttttggtccctcaattaaaacaaatctgatgagtatgagtcatggtgaccaaatgacctcctttgggtttttcctttgaatttctcttctcacttaaataccaaattaccaataatcattgtacgtggttcccaggactctctgattttgagttccataatgcaggcttttagttttccttgagaattttgtagtctacagataaaattgctactaaggtttggagatttctacagagagtatgtgagaaggaatatgaaaagaagacctaaaaaatgacaaccccagaggtaatgattataccatcttcggatacctgtgtgaattaatatggatggtttgtgtcagcctccacaaatgatgggaggtgaagtgtccatgcagacactcagattgccctctatcctaatccatatacctgaataaagccaggggaagattctggtgttgcttcttgtactagatgaatacctagtgcatgatacactactctcctattccctcttttctctgtaggagcgctaaggaattcatcgttcttacagttctgcacactcatcaggtgagtgagcctctttgccatctgcccttcctcctgactgagaagagatgacatttccatattggaaagcaacagtgatggggttgggggttcagagactacaaccaacatatgagccaaggatttaggagtgaacttaaagaataccttctgaacagcatgtctctgctcatgtccaaagctgaggactttgaagggctgtgctgtgctgtgttctgtcctgtgccttcttctttacccacttaagctgcccactgcctcaattccaaatacagtttccacttctttttggctgtactccattaaaatgtatctgtccaatgtgaactctcataaagtcctggacgatgataggtgccaatcttattcattcatataagttacctacaatgtatgagacacagcaccatatgtgagagaatttaatataaatttgctggggggtacccttggacaaacagattcatttttgtcctggtacagtcacttaactggctgtgtgaccttgaatgagtcagttccccattctggacctgtttcatcatctgtacattgagagatttaaagtataacagtgttacctaaacatgcctgatcataatcgttgccaggactacttattaaaagtaaaaatttctagccccctctcctcaagagttggatttagaaagttcagtgtccattattagttgtacccttatagcaatcttaacttaaatgcacaaacccaggtgcacaacttccatgtgcaaaattcagagccctcactctacctccagcctacctgtccccttattaatgtccccaacaacagtcctctgcaccccagcatggatgccataccctcaatatatagccacaggagagatcacatctgttgggggtgagggacatgaaatcagggaaggcttcaaggaggaggctgcacctgagctggaccttgagggatggggcaagattttccatagagagatgacacagcgagggatggaacacaggtgcacagcatgggctcaccaggcaagagcaagattcaaatcaatcttggttcaaactaactgcctctccccatggcccccagctcccagacctcttctgcatcagtgtgaacttcactcacacactcatacactcacacacatatacaaacacactgacacacacacacaatacactcacacattcattcacaacctcatgcataatagactcacacatatcctcacacgtacactcacacacatacactcacccactcatacccatacatatacacacactactcacatatacacgcactcatgtgctctctcacatatgtacacacaatggtcccaggcagataggcctttctcagttccagttctcttgtctctgggcaggcaagccccaccactccattgttgttaccaatagtcccctccccaccactttgctgcatgtgtgcagttgcctagtgggcagtaggcagtcagtcccaacctcccaacctcctgtcttgaaaatgaccaccagttctcccactaaaacatgcttgatgtgtggttagaatttactactgcgatcagagacccaatgtgggtttactttgttagtcagttcttctcaaatctcaccttgcagaagccttccttgagtaccctttctaaaatagcatctaccttcactatcttctgatatggcttactttttcatcagagctgaaatattatattttttaacttttcttttgaaataattgtagatcacaagaagttgcaacgatagtacagagatataccatgtactgttaccctgtttctcccagtggttatatcttacataactatgtgcaataggctgggtgcagtggctcacacctgtaatcccagcactttgggaggccgaggcaggttgatcacttgaggccaggagttcgagaccagcctggccaacatggtgaaatcctgtccctacacaaaatacaaaaaaaattaggctgggatggtggaacgcacctgtagtcccagctacaaaggaggctaaggcacgagaatcatttgaacctgggaggcagaggttgcagtgagctgagattgcaccactgcactccagcctgggtgacagagcgagactccatctcaaaaaaaaaaaaaaaaaaggcaaaacagaacaaaaactatgtgcaatagcaaaaccaggaaatcaacaatgacacaacgtatgtatatgattcaatatgaatttatcacatgtgggtttatgtctccaccaacacagtaaagataccccatttaccataatattgttattatacgttgcatgcctgtgtcaaagtatcttatgtgccctagacatacatatatctactatgtactcacaaaaatttaaaacttaaaaaaatcactggacaagtctgtcacccaaaggattcctcgtgttgtccttttataaccacactcacttcaccgcctacacccaatccctgtcaaccactttacatttccctaattttatttcaaaaatattatataaatggaagcaaggcactgtggctcctgtctggaatttcagctacttaggaggctgagatgggaggatcacttgaggtcaggaatttgagatcagcctgaacaacatagaatgagacctcgtctctaaaaattttctttttaatttagctaggtgtggtagggcacacctgtagtcccagctacttgagaggctgaggcaggaggattgcttgagcccaggtgttggagactgctttgagctatgatagcaccactgtactccagcctgggcaatagagcgaggccacttctctaaaaaacaagcaaaaataatatataaatataattatataatatgtaacctttggggattgactttcttcacttagcaaaatgtcctcttagcaaaatgtcctcgagattcatccaacttgttgcatgtatcaatattttgttccgttttattgctgagtagtacccatggtattccatggtgtggatgtaccagtttgtttaatcatgtacccgttgaagggcattgggttgtttccagttttgaactactacaaataaagctgctataatatttgtgtacaggatttttgtgggcataagttttcatttctctgagataaatgcccaagagtacgattgctggatcaaatagtaagtgtatatttagcctattaaaaaactgccagactgtttttcaaagtggcggtgccattttacattcccatgagatattatatttacatgtttattgtctctgtccctcattagaatgtcagctccatgagggtagagactgtgttttgttactgctgtatccccagcacctggcacagagtaggtgctaataaatattggttgacggaaggaaggaaacccagtttctagccaacaaagcaacctaaacaaaactcaagtgtccaaacttaggtgcagaataaagggcgtaacactcaccccaatctctatctcgactttcccatcccagtgcctccaacattttcttaccccctgttctgcttactctgcaggtcccaacccatggcccctttgctgcggccaggctgatttccttctccttcttaggtacatttccttcttaggtcttactgccccgtggacttttgtccttttgctattccacatctcttctaatacatgtctgtttcttttaagaccttgtttgatactcatgttctccaaacagctttgcctgactaatctcaatgagcatttccctaattttttcattcactcatcaagcatttattaaatacctactattctggacactcttctaggctgggaatatagcagtgcacaggacaaacatagtccctgccctcacagagcttacattctagttctcagtcttgtgctctctaaatccttggagcatagaagtggacgagtacacacacacggggctaattgtcaaaacatttaatgacctgtacagtaggagccaatccagtcaaaatataagccagtaataacaccggagcagaatcttgaaggcctcctagttgtgccagatgttaaccctgtagttgatctacgtttgtaaggaggtccagggggagaggtcaggtggcatccaggaagcatagggcagtgcctatttaccaatcagtgtgaaagaatctctctgtattttacaactggtatggccatcccagtgcatgccaattgaatgtcagccttacctacatgtgcagtcgatcctcattatttgcagattccctatttgcaaatttgcctactcccaaaaatttatttataacccccaaaatcaataatcacggcactttcctggtcatttgcagacatgtgcagagtgtgaaaattttgatttaccccatgcacacgttcccagccgaggtcggacaaggtgatgctctgccttcttgtgtcagatctcatacagaggtaatcagaggatgaagacgatagggggcagtgcagtgtagtgcaagaaagaaactgcagttctggggccagttggacggggtttgaatcttgactctggcacctgtgagtggagtggcctcaggcaagtcacttaacacttttgaacttcattttctctttgtaaaataaagaacatagaagctactaggatgagttgtttttacattttaacaccataatttatgtgaaatattggagcaacagttcagtattcactaattcagtgtttatggaaatgtcatagaacgtaaccaccttaacaagtctccattgacagatcttctctctttagctatactgaaagcttcttgaagacccccaatatgtgtttaatgttataccccctacatcacagaaaatactactgtgttcacagcaggcacttggcatctcatgggtgcaaggagactgctacctattacagaactcttgtcatgttaaagtttgattaccactacttccagaagacaacctcctaataggtccaggatgtggcctaggaatctatatttgttaaaaaaaaaaaaaaaaaaaaaaaaaccactggaccagacaatctgcaagtctccttctattaatagctcctacattatgtggctgataatggcctaatacctactcctacatactgtggctggtaattttattttatatatatagagtctcactctattatccagtctggagtgcagtggtgccatctcagctcactgcaacctttacctcctgggttcaagtgactctcctgcctcagcccccgaggagctggaattacaggcatgtgccactacaccggctaatttttgcatttttagtagagacgatgtttcgccatgttggccaggctggtctcgaatccctgacctcaagtaatctgcccgccttggcctcccaaagtactgggattacaggcgtgagccaccacacctggcctggtaatggttcttgaccctgtttatccattataaccatctgagaagctctgaaaactattaatagtcacttctgattcattcgagcagcagagacagaaaaaaaaaaagaaaacatgaaaatattgatacttgggctcttgccctgactcattgaattagaagctctggagatgaggccctggtattggtcttttgaaaaggctcaccaaatgattctgatatggagtctctctcagatgacattttccttgtaagagtgactcatagcatggcagacaattggggagaggggtcacaggagttctttcccagggcccctcaaaccatactgcatagatagccacttaataagcttctgtgtacttaagggtattccttaatctttgaattaccaactagtcctcatgactgactggatatttattaatcttgaaatctttagaccttggcacacagtaggcactcagtaaatatttttaaacggataaagtaccggattatgaccaagaatgaccctgataaagcaagtacagacaatctgtttcaaatgaaacccagttttctggttctgaaaacagcctgtacttaaagaactggaatcccttctgcttggagccacctgcccagaaaaagaaagccaaaataatgggaaccacctcagagaaactggttttctacagagcttcctgacgtatagtgtttgtcagatggtagatactccaaccatatatgctgaattaatgaactaattcattactaattttagcaatcaactaatatattttatgccatgtctactatgtgcttggtactagggggagacatattaacataaaatggcatctctgcttatacagcctggttggggatgtgagcaatggcagtgtggattaacaggagtactataggaaatccaagaaggggaattgaggagttggggaaggattgaggataaaggtagagtttgaactaagctgtaaagtgatggcatttagctagtcaaagggacactctagaccctgaaggatggggacagggaggaaacagcgtgaggtgggtccaggaatgataacaagcccagtgtgtgcagggagctgtggatagaactaccaagtgcagcaaaaggtgatcttggagagaggtggttagagagtcaggtgtagtttgtggcgggctttggaagtcaggcagaggatatgttcatgtccaggcagtcttgagtgtgggaaggaaggccccctggttcccctagtagtgatctggtgaaaccaggatggtcctccattgtcctaggctcccacagtggttgctataggaattggttataagtaggctcaggtgtcaaaggcagtgtagccagaagggcaaatcagtcaaagcttcaagaagctgagtttcgttttttttcagttaccaaagcggggccctatcttgttctaaaatatttggccctatatctgactttggtcaagatttgagtgatcacaaccctgacatctgtactaatacagacaacaaatttaaaaaatggtcaaaaaataaccagctgctgaattctgcactgagggaaaggcagactctcttctattccttattccaccaagctgctggcttcatatttgcttcaagcagcttgcagtggccccagaggtacttagcaattctagtcccatgtttcaagccaaaattcattttagccagaaagggtgcctgttgcaaagtgagattcccagctgcttggagaaaaaaatagggtcagtgaagagctcaaacattccagccttaaggtgctcaattaatctatgcttaatggattgggatctcttcaacaatgtcaatttctgggccccactcttccagagattctaacttttaaaatctggtgtgagcctaggcatctgtgctttaacaagcactcctcagtgattcttatcatcaggcacgttttaaaaacagctggttagtgcatggttatgaattagtgcagaggttggcaaactgtttctctgaagggccatataataagtattttaggctttgcaggccatatgtggtagcacaaaagcagccataggcaatacataaatgaagatcacggctgtgttccagtaaagctttatttacaaaaacaggtggtgagcaagatttggcctatgtaggcctgtaatttgctggcccctgaagtgtattatgccttcctgctaccgcattcacattttgacccgggccttcccaattctcaacattgtaattcaaaggagtgcccctaatattacgaacttcaagccccagagctgagctttgaagatgctttgggacacggaggcctctgagaggctcctcatatcacactgcaaagcaggcctcacctgtgtctgagcataaggctagatgtgactccatgacatctagcacagaccagctggcaatgaatgagtcaccagcatcaaggctgaagactgagaataggatggaatcttagagaccaacaggacaagggtcaatgaggactgaagtataaacaagctgaaaataactctgaaacagacacctggaaatgattataatccctgaaaatattggcaatttcatttcctcctttgtggtttgtgcctataattaactgaatctttggttttcagtggtacaaacagaaactctctaggacaggatctaatcttgcatctttggtagggatagcaaggatgccaccctcttcactgtggtgaatacataaaaggataccagttggggttcttcatttgtttgagtccattacataacaccaaggtagaaccagaaccagtggatgaaagatcaggaaaggactcccagctttagcctgctgtgggggaacaaccactaagcaaaggctcaggaaacctgggttctggtttcggctctgctactcaattatttcaatactttgggtaaagtatatcctcttcccaggcttctgtttcacatgtgaaaaatgaaggttgagctgcatggcccattcaggtctctagagatgcctcgttctacacactgtgccatgcaggcatctgagggcagatgatggcagagaagagaggtgactgtcaggtagaaagattccacttgcctcatgtttgtggcaccttggtggaactttggatgactgtggagatggaatcaaacacagctgcctgagcatagctacagatctttctatcttgcccctttctcttgcttctgcctcagcctgcagcccctgctcaggattggagcaccaggctgtgcaacacacaaaggcatttatcaactccatgtataatcaatactgtaatcactttctgcagtgatctccagctctggatttcattgtgctatattgtctgctgccaacaaattgcccctttggctcaggatgagaagtctaaggttcctttagctcaatggttcttaatcttggctgcatttggaaatcatcagaagcttgaaaaaaatactgatgctcagacctcacccccaggaattctgatgtaattggtctgtggtgggccctgggcttcaggatttttaaaagctcctcccagcatttctactatgcagccaggactgacactcactgcctgagttcctgctggactcaggtgaaagaagtggttttttgcaatctcccctctgtgggaatgagattgctggctctgacagagccagctgggaccagggcccaagacacaatgaggacgtttgtttctgatgtgtatcttagggccctgccctcctgtggctgattgggtaaatgaatctcaactgcagtgtaaatggtagataatagcttaacgtattcccagctggcagggaccttcagggccttaacacaaagaaattcctgattgtaggactcaggctccatggcaaggcccataggggtggtggtttgaagtagccccaaacctgattcactccctagtcctcttcatctcagtaaatggcaagtccattctttcagttgaagtctctctttttctcactctcatatccaatcagtcaacatatcatcctaattcagtattcaaaatatatccagaattcattcacttttcaactccatcagtaccatcctagcccaagcctccattatgttttaaccatattattgcagttacaaatattgtacttagagacccccaactggtctccatgctcttgccattgcccttctacactctgttttccacacagcaaccagaggcttccttttaaaatgcacatcagactctgttcaatcaaatccctctagtggagtgaaatccaaagttctcaccgtggtttacaaggtcctacatgacccagcccccagctgcctctctgagcatctcccctcttgctccccctccatcacgccactccagccaccttggccttccttgctgttcttcatacacctcaattcacttcagggcctttactgtagtttctgcccagaagcctttctccagataacctggtggctgtctctccctcacttccttaagtttctgcttaatgtctcatcctcagagaggtcttccctgaccatcctgtctaaaataacctcccccagtggccgggcgccgtggctcatacctgtatcccagcactttgggaggccgaagtgggtggatcacttgaggtcagtagttcgagaccagcctggccaacatggtgaaaccccgtctctaccaaaaatacaaaaattagctgggcatggtgatgcctgcctgtaatcccagctactcgggagactgaggcaggggaatcacttgaaccgcggagacagaggttgcagtgagccgagatcgcaccactgcactctagcctgggcgacagagcaagactccttctcagaaaaaaaaaaaaaaaaaattaaaaatataacccgcacaatcctacttgtggatatatatccaagggaattgaaattagtatgccaaagagccatctgcattcccatgttcgtggcagcactattcaccatagccaagatagggaaacaacctaagtgtctgccatcaacagatgaatggatgaagaaaatgtggtataaatacacagtggaatactattcagtctttaagaagaagtaaatcctgtcatttgctacaacatggatgaacttggaagacattatcctaagtgaaataataataataattattataagccagacacagaaagacaaataccacatgatctcacttacatgcggaatctaaaaaagtcaaaatcatagaagtggagcatagaatggtgatcactagaggctaaggttgggagggagtggggagatgctgttcaaaggatacaaaggctcagttagacaggaggaataagtttttgagatctattgcacagcatgatgactatagttaataataatgtattatgtatttcaaaattgctaaaataataccctcactactcccactctaactcactcattctcttgtgtagtcctttaccctgccttatttttcctcaaagtccttctttgctacctaaaagatatttatcgtctgtctattcctgctggaatggatgctccatgaggccagggagttttgtctgtcttattcactgctctatccctcatcacctagaacagtgtgtggcatgtagtaggcccttgctaaatttgtcaaaagaatgaataaacgcccccccaaagacaatgaggatgcccctcagcacgactcctgtattcctaattgctgggccttacagagctcagcagggagctagaatccaaggggcacccaggaaaggcttagtttccagtgtttgctaatcatgcttctgataaaattgtgggagagttttcaagaactaaaaagccagccaggcatggtggcctgtaagcccagtactttgggaggctgaggcaggtggatcacctaaggtcaggagttcaagaccagcctggccaacatggtgagaccccatctctactaaaaatacaaaattagctgggtgtggtggcacatgactgtaatcccagctactcaggaggcaaggctggagaatcgcttgaacccagggagcggaggttgcagtgagccgagattgcaccattgcactccagcctaggcgacaagagtgaaactccgtctaaaaataaataaataaatacaagcctggctgattttttgggcatttcttacagaattggataaacaaagtggtgcagagcccaaaactagaaagccagaagacttgggttaaatctctcacatctctattccccaatagtgtagtaactgtggataaatccttttggagtgctaggtctcctttctcccacatctaaaatagtatttattatgcaactccttcctaggggcaggacatgtctgtgaggtgaacaagatcatttctgtaaattatttgggatgcttatattcagatataataataataataaaaagacaccctttaggtctatctcactgtaagaaaaccaaatatataaaaactcaatgtatgttattactaaagaacttttgcaaactcccctaggcctagagtattaataatggggttcaatctacccaaattcaattcatgcccagctgtttcagaacacaccaattacatagggaagcatttagcacattgccttgcaactaataggtaattaatatttgtttattgactccttgatcagtaatgcaaagtgtacctgtactgggacatcttaactctgacgtgacaaaggttaggctttccctagatatggagaactcaccatctctctgttctttttccagtcccccaaatctgctttcatcagtgctgcgaagaaggccaagttgaggtccaatcctgtgaaggttcgattttctgagcaggtggcagttggagaaacagatgcagtaagtgtagctttggctccctctcctcagcccctggccataatctgcctggctgtcaagctctcgctctggggcttcttatagtggacagctttccgaatgggttagagtgggagcgtccaggtgctggagggggaaaagtagtgagtgaagagggatacgtgacatccagagaggccccaggcattgtggggagaaggaatatatattgattcactcaagatccttctgatgcttagagaaatttccatccctaacacagtagcttacactcaaagcaagtgctccataaacatcttttgctacttgatagaaacaggaaggaaataatggcttcctgaagactcagggaatgagtggctggtgaaattgagctctcttcacatttaagtgatcttgcaactccacatcttgaccagaaaaggccatgcagtggtgagtaaagttgcctaaaggaaatgatacagactctcattaagtcaccaagtttttattaggcacctgctatgttcttagcaccagaggggaggcaaaataaatacctgttccctgctaccagatacctctcagcaatgttgagggggacaagaggttcagattgagacaatacaaaatctactacggggtggtattgtttcgaaagacaggtaatatttgacagcccatgccatgcagctgccaatttggggagtcttggccagccacagtgtttctcactgctttgggaggtttacatgcagtgaactgtcggctccagatgtgcaaatgagaagaggcaggtgaagagcagaaaagaagtgtgttaagcagtcatgcattctggccgagtccttcaggaatctgcagaagttagtgataacctggtggggacagaggggatagctagagctaacaggcacttgtgtgcttttgatagctgtgatgggcagagctgtctggaggcccttggcatttacgtactgaggaacagccacagttgttgggagaagatagcaggcccagagcagggaaatcagcagggtgccaggcgcttctatattatttaaggcagaattagtgagaagaaggtatagaggacacaggtgtcttccatctccatttccctgactctcattcccaaactcagtctatgccctcctccatctctgcatgaggaaggctggcaaacccaggggactacaggaccccactgggcaagctgtctgaataattgatggttgggatctgtgtcaatcctagaagaaaagttttaagagaagtgatcattgatgagcagaggggaaaaggagtaatatggagtccctgcaaatcagggtgaaacagaccccgaggtccaagtcaccaggaggatatgtgtgtcctgaatgcttgaaaacccagaggacgtatgacttggatttggtaagtatgaacaggcttatcctatgccatctcaacattgcagagtaatcagtcaagggcaggccacccagtgaagaactccttcccttcctccccactcccctcccctctcttctcttcctctcccttctacttccccttctccactttctccttcttccaccatgattcccctctccatacgtcacagctaggttacaggcacagctagtctacaggcgtaacgatgccccccactccagtctattctgaatgcaaatgccacagagtagctaggacccacctagagtgacctcattctctcggacaggccaccaggcatagtgtgaggctcttgtctgggtgagagacagacatcaatcttccaactctcactgcactcgtgaaattacctggtgttacaacatcaccctcctccatgctgccgccagtatggaccatagcagcctcatcacaggtcgggagccgggggagtccaggcccaagtgactccaggctctcctatcaaccctttcctttcgtgttccaaggctttattaagcagccagagcaaaaataaatcctgtgggtgatccttgccagctctatttttaagcaaattcaattaagtaattatctgagtccaacccagtgtgctaaataaaacctgccaccactgggatccggggccgctgggcctggcaggagcaaggcatctcaagatcagggaggggaccagggagtcacactcttccaattttatatcccaccacttcccaccttgtttccacagccaagcttgtctcttggctcctcaccaccatcaaccataccccaacccaggaggatttgcttgttcctctttccatgctttgtccatgatccatgacagtctctaggtctagactgttctcatctggcttctcaaatcatccacacccactgtctccttcaaaatcaaaatccaatttgccttatctaggaaactttagccatcttatacctgttggtttgctttggttttataatgtgtatgtgtgccaagtcactacaacaagaatttaagactggatttaaatctcctgtagctctcatagagacttagcatagtgttgggcatacagtagaggttcaatgaatgcccagtgaattaaggaatctggttatctctgcagcttttccattcctatagaactgatgatgatgttggcccagggaaatggttgggatgagagtgatcattcagtaagtgcacatcaagcacctactgcccattcattcagcagccatttattgcgcaccaaatgtgtgccaggaactttgtttagtgttgggactacaaagataaataggacatggtctttgtgctctcatttcaccatttgattgtgaaagacaaatatccttcaaaaatatgataaaggtgagtttcggcagcatagtgagaccctgtctctacaaaaagtaaaaaatttagctaggtgtagtggcacatgcctgtagtcgtagctatttgggaggctgaggtagaaggatcacttgagcccaggagtttgaggctgcagtgagctgtgattgcaccactgcactccagcctaggcaatagagcgagaccctgtctcaaaaagaaatcaaaacaaaacaaaatacggtaagagcattgtgagaagcgtgcataaattgctataggaatgcatggaaagaccaggtccaagtatctgatgatattagaccaaggctttacagaatacatatttgagctgggttttgaaggataaataggagtttgccaaagaggaaaagagaaaggcagagggaacagctttttttctttctttcttttagagtcctcagagaaagagaacagtctttatttaatgaatttttattaagaatgtctcaatcagagtcagtacctcccattgctagagagcttttgaaaatgtctgagggccaggcatggtgactctcgcctgtaatcccagctactactagagaggctgaggcaggaggatcacttgaactcaggaggcagaggttgcagcgagccgagatcacaccactgcactcccacctgggcgacagagcgagactctgtctcaaaaaaagaaaaagaaaaaaaaaagaaaatgtctgagggtgtttcaggtcatcccaatgctttggtgtgctactggcacttcatgtctcagggtcggagatgctaagtgttgtgcagggagggggacatccctgaataatgaagaatcatcagaggtatggaggtgtgaaagaggtgtgggtactaggaatagcaagacgtgactctggagactaggcaggggccaggtcagaaagggcctagggaggggaaaaggcagagcaaaggccttgacaggacgtgatcttggcttgtgaagggcctcagggaaagggaggtatcaggagataagatcagtctagaagctttgtagaaggtgtttaaaaaaatgtcagagataagatcaggtgggtgaggtagactccaaaggaggcctctcatcagcccttcagcgggtgtgtggtgatccctttgctctgatctgtggaggtttgaactacagtagaatgtgggtgctccgtgatgtcaaatggaggcgggcttttgatatggctcagtgtcttgttggggagtttggttctggtccccatgtattattgatctgctctttcctctgtctctgccctcctacacctttggctctctgtctccatcaccttttctctctcctttttcacacccttcctctggcttcctacttccttctaaatgagccggtctccttgtcctttccctgcttgttcacagaaaatgatgaagaaggaagctctcctcctcatccctaatgtcctgaaggttttcttagaaaatgggcagatcaagtcattcacatttgatggtcggaccactgttaaggtacatacagtctcctccccctggtcagcattgccctctccagagtacatgcagttgtgtgtcctgtgttcctctgagtctgcacatagctgcttgccactggagtaaggtggcctttaagctctggatgcttgttagcacaaggctgcaaaaatgcacagtcccagatgagagtggtggtagaagtttgcatgcccaactgtgtgctagtaattgttaaaccgtgtgtgtgcacttatacttgtgaactgctctgtgtttgcgttacatggggtccttcaggacttttaagaactaaagaatatgaagatcattaagccatttataaagcaaaagtgatttatattgataccataacacctacacaagtttatgcacagaaataaacacagtctcttgggagattagcttagttatggcttgctttttaaataacaacctgatctcaagcactgaaccaagatttgaaatgtccagccacagcctctttggctgttcttttcacaggaagagcaattactgagctgtgattcttcacagctcagccaggtgtcagaaagtcctagtgactttcctctaatccttaggaatagaagtgatgatatgattcacccccagattcaactctgctctgggacagaaatatccattcctgcatcttctggactctctccagaaagagaatgccatccccagaatgagtattttaatgcaactaatgccgcccaaactgctgggcagctacggtgtctacccagaaaacctaggttggtccacaggtaccctgtggttcccatactgggaccaaggcaatcctataagtaaagaaactcttggaccaacaaacgtttgctaagaggagttatcaggtactcagaatgggtcttgccagtgattttcaaccaggattcctacttcccactcttagagagcttttggaagtgtctaagggtgttttaggtcatcctaatgatttggtgtgctactggcattttgtgttttagggtcggagatgctaagtattctgcagggagtgggacagtccctgaatggagaatttttttgaaaggcttaggcctaggtgggtcccccaggggacctaggaccaaaacatactacttagggtgccatagaatgttcttttggctattgaagggggcatgggagggggcattgaaacagaactagaccacccaggaggtgtccaaatgtgccttctccagatgtgaatatcgctttgtgtcagaatcctccttggtggtttattcatgggttggtatgtccattgtggactctgtctccatactggagtgtttagtgccctctctttccctttggagtcttctctgaagttctcccacctcacatcatcagcgccattgtggcttccaggtagccccagccttccaagacagcagtgttcccctcgcttgtgatctcaatctgactccaggaagggtgtgctggcgacttattggagctttgacaggctgccaagccacttgtcccagagaggtacctgggtgaattgacagcctggcacaggggctgttacacttgtaacaccagttggcaatcgccggattggctgtccacaatcccagtgcagccaaactgcaaagaaaacctcatctgtccctgacagagctccagcaacactggcgcctctgtgactacttggacaacacaagagatgctctgaagtacccaccaatttccagcttaacatttgaataactgaacgtctttcagtgttcattgaggggcttgtttggcaactgcggttgtaaagatgttttatattcccaagcttgattctttccagcctttgggggctgagagatgctgactccatgaacacacacattggagcccagtgtataagccaaagtcacagcaaatcagtggcagaagtctcagaactgacatttgtgcagccccttctgaaatgttttcagacaccctaatattaaaagtagggcagcagagcagatggaacccagaagtagtcagatttatgactgtacacaaaacacatgacatagttcctctgcatggatacatttttcgagttgctaaattgatcatctataaaatccagttatggtcaaaaatgaacattttgccagtaactcaagtcatttgatttaaattatgaatccagaaatagtatgctttttaatcatataaatgtcacttttgcttttgttcattcctaagagttgacagactatcccaagtggatattctgacttataagagaaggtgaagggagaaccaacacagtgcctggcacttagtaagcatttaaaagataattttttgagtggaaggagagaggtagggagggagagacatgaccttcttttgccataagcctcgccaggtgaaattcagaaacacctacctctaaccccctgcacctctccccagggcccaggcctctgagcagcactcatgggtcactttactcattgtggatcacagagcctgggctactataaaggccagtgttgcagccttctccccaggactatatttcttttcttggtgtttaatcccccctcccatgtttgatgcttagaatagcttagggccagaactaatctccctctcaaggctcttttctgtcccacaggatgtgatgttgacattacaggaccgcctttccctgaggttcattgagcactttgctcttgtccttgagtatgccgggccagaacagaatcacaagtttctgcttcttcaggacaagcaacccctggcttatgtaagtaactcttttttacagatagctttgcatgtggcctctagtagagaagacccaaggcactccctgtctggaaaatttataatgatatgctcagccggttcccagaagtcacagttctcacccaaagctggtattatccacctccagagggcttttggcagtggcctttgtgagctgagaagagcatgaagatcattagtcttggtctctagggggaagagtatggggtgattcaccacatggcacccagaatgctgagataaggagcagttgcaagtctcctgtctcctggaaaccccacatgatagatttttctgctttctgggagaaaacttggccttttgcatgaaggctgttatggaagggtcagggagtggatcctactcagccaattcccaactcccacttatcctaggacaagtgggagttgggaattggctgagtagagccaaaaataggcggcatgtcacccacatcaatttacaaggtagagtaggaaaaagtatccggtcttcctagccctcaccatatggaaaagggctggggaaatccaggattcctggatagcatttcatctacagtgaagcaccaagaagtgtcagagatgcaatcaaagccaatcagtactaccaagtagggtgggacagagttggaaaggaacagtggaagaaataccttttcagagcctacatgaaagccaaacaaaaccccaaatcagacacaaaaagatgaaaggatttttggaaagagagattcaagtttagctctcagccaaatgcaatacagagactcactggtgggaaggaaaggttgtgggagtcctgcctggagggaggcctaagcacctccctcacccccaagcaaccctttgaattcagttggtctgttgttccaaatgggattttaaacttttttattatgaaaactttcacacatacacacaagtaggaggaatatagtatcattaaccctattacccattcccaggttcaacaattatcaatacagtgccaagatgtttcatctgtaccttgaaataatattttaaacctttgatttactctaatcagcaatttactctgcttgaggctgagcccctctgtaaggtaaaggcatgaatcccacagcaagaaaagaggagtctgagccattgccaggagccctcccttcctgcctagtgtcttgggctttagacccaatggttgataaaggtcatgtcctagataagtgatttgaaaattcctcttattttgggtcagaagtgtagaaaagacctgactcctcactactttcctctgagggtaattagaatcagccaggtcggagacagagtaggaaacaacagcttagctctgccccaagccccaccttaaagagccactgagctgccagcccaacaccccagccattgattccagatctcttttcttctcccctttcatccctggaattcaggtggtacagcggacacactatcatggaatgaaatgcctcttccgaataagcttctttcccaaagaccctgtggagctgctgcgtcgggatcctgctgcttttgagtacctatacatccaggtagagtctggcttggggatacacagacagaccagtggacaaagaagcaggcaggctgttctgccatcacaatgaaatagctatgtaagtttttccaacctccaggtagccctgaaggccctttccttccttttctgctaccatcgtaggccatggccaagttggctggcctggtgacctgagctggctgtggctcaaagtcctgtctatttgtccactcagatctcatcagttttcagaaacaagcaatcccagtaactctggcatcctcacaggatcctaaagtttaacaagcccatttcggtttcaacgggtcccaacccccaatacctagctccagtatgagatgattcccaattcagtttatccagaaacatttactagacacttactctgggttaagccctatgctaggtactagcaatcagaagtgaatgaagaactgtcctggctcactagagcttatatgtgcctgaataaatatgacagcagcagggtgcaatgaagatgagggcactcaggaagcatttttccaactctacacaagagagatggtgcaggcttcatggaaaaagtgatatatgcatgctcttagccttgaagaatgaatgagagtttgttgtgtagagagatggaatggagggggcatactctaagcaaagggccttgcatttacaaagccatggtggcatgaaacagcatgggatcatgagagaagcatgagtgattttttatggctagagtacaggatgtgaggtaaagaggagtagggaataaaattggagagacaggaagcagtgatcaaaggcttttggtaggccaaggcaagcatagactttatgattgagcctgggcagcggttcttaaagtgtggctgttatagattctttgcaatttcatgcttcctggagtggtagcatcagcatcaactgggaccttgttagaaatgcaaattcttaggccccagcccagtcctactgagtcagaaactctggaggcagaattcagtactctgtgttttaacaagccttccaggggattccgatgcccaaaagactttgagaacctctgctttatgatggtggtttaaaccttagatgcacattaaaattatctgggaggtttgggaaaatgctgtgccccatccaagaccagttgaatcaaaatctatgggagtggggtccaaacactggtatttttttaaattcctcaagtgatcctaatgtgcagccaaagtaaagaaattctgtgggagagtaggagagcagaaattattaaaagagaagaatagcctggtcagatgagcaaattcaaaagaccacacagtgctaaggaagtacaccagctagggagcaatggcagttatccagaagaaatgacaagggctagaaccagggccatgatgaaggaggtgggatgggtttcaagagagatttaaagggtagaatggataggctttaacttaacaagtgtcttgtagaggtggtatcattccccaagttagagaatacagacaatggaatgggtttagggtaaagatgagttcattttgggaaatgttgagttttaggtgcccataggacatacaacagcacttaatgagagaaaaaaacctcaaacttcatctgtctctgatggtgatatccagggaggtgctatgagacattgtcgttgtcctttttgactgttctgacaacctaaaatgttaggaacgtttcccagacagcctcaggttcatttaccaaccttctaggaggcaatgagttgtggttgctctgtgaattttgtaagtttagttctcattttttttttttgccctgaatttcttaattcaagcttccaaggattaccttggtttgaatattttagaatttagtgacaagatcatgtccatcctatccttctgcttcatgatgatatggacttcagctgtattctttcttttttacatgtaacagctttattgaggtctaactgacaaaagataaaccgtacatgtttacagtacacaataccatacgttttgacctatgtttatgcccatgaaaccatcaccacaatcaaaatattgaacatatccaacacacctaaaagtttattcaggccactttgtaattcatccctcccagccctaggctaccactgacctgctttctgtcactatagattagtttgcactttttagagttatatagaaatgagatcatatggtatgtatacttattttgatctgacttatttggctcggcatactgattttgagatccatctatgttgttgcgtgtatcaattatttcattcatttttattgtcaagtagtatttcatggtgtggatattccagaatgtgtttattaattcacctgttgatgaacatttgggttgtttccaggttttagttattacaataaagcttctatgaactttcatgtaccagtcttcgtatggacatatgccttcttttctttggggtaaacacttagaagtggaatggtctgagcatatgctagatctctttctttaattttgtaaagaaactttactgttttcaaatgtagttgtaccatctttcattcccaccagccatgtatgagagtttcattttcttacatccttatcagcacttggtattttcagtattctttttttactttagtcattctgatagtgcgtagtggcatctcattgtgattttcatttgcattttcctaatgactaatgatgttgagcatcttttcatgtgtttatttgatgctacgcatcttctcgggggaagtgtccatttagatctttgcctgcttttttattgggttgttttcttattgagttttgagagttctttatatactctggatacaagctgtttgttagatatattatttgcaaatattttcttccagtgtgtagctttccttttcagtctctaaacaacgtctttcacagagcaaatgtgtgaattttgatgaagtccagtttgctaatttgttcttttatggacagtgcttttggtgtcatatctaaaaaatctttgtctaacccaaggttacaagaattttcccctatttttttctagatgttttatcatttacagttttatatttaggcctatgatccatttgaattaacttttgtatgtggtgcaaggtatccatcaaagtttcgtgtgtgtgtgtgtgtgtgtgtgtgtgtgtttttttttgcatatggatatccaattgttatagcaccttttgttgagaagagtatccttcctccactgaattgcctttgtacttttgttaaaaatctgttgtctatatatatatatatatatatatatatatatatatatatatatagatctattcctgtactctctattctgatctgttggtctacttgtctgtcgttatgtcaacatcacactcttgattactggagctttataataattcttgaaatcaggaagtatttgttctccaactttgttctttttcaaagttggtttggctattataggtcctttgcattttcatgtgaattttagaatcaccatgataatttctaccaaaacctgctgtgatttggattaggattgtgttgaaactatagatcaatttggggacaattgacatcctaacaatattgagccttccaatccctgaacacagtatttctacatttaattataccttctataattttcctcagcagtattttgtagttttcagtatataggtctttcatatgttttgtcagatttgtccctaattatttcatattttttgatgctattgtaaatgattttgattttaattccaattttcaattatttcttgctagcatatacaaatagagttggggttgggcatgttggctcacgtctgtaattgcagcactttgggagactgaagcaggaagatcacttgagctcaggagttcaagaccagcctgggcaacatagtgagacccccatctctatacaaaaagatttatttttaaaagaatagaaatacaattgatttttgtgtattgatcttatatcctgaaaccttggtaaactcactacatttggcccttcatatctacaggttccatatttgtggattttgaaaatattcaaaaacaataaaaaataacagtgcaataataaaaaatacaaaatttaaaaatataatataataactatttgcatagcatttttattttagtttagtttgagacagagtctcgctctgtcacccaggctagagtgcagtgccatgatctcggctcactgcaacctccacctcccaggttcaaacaattctcctgcctcagcttcccaagtagctgggactatagacatgcaccaccacgcccagctaatttttgtatttcttaatagagacagggtttcaccatgttggccaggctggtctcaaactcctgacctcaagtgattcacctgcctcaacctcccaaagtgctgtgactttaggcatgagccacagcatctggcctacatagcactatagcaatttttttttttttttgagatggagtttcgctctcggctcattggaacctccacctcctgagttcaagtgattctcctgcctcagcctctcaagtagctgggattacaggcgcccgccaccatgcccagctaatttttgtatttttagtagagacggggtttcaccatgttgtccaggctggtcttgaactcctgatctcaggtaatccaccagtctccgcctcccaaagtgctgtgattacaggcatgagccattgcacctggccttatatagcattttaattgtattaggcattataagtaatctagaggtgatagaggtatacaggaggatttgcataggttacatgcaaataccacagcattttatataaaggacttaagcatccacaaatttcagtatccatgggggtcctggaagaaatcctccatggataccaagggaaaactgtagttgtagtagttttttgtaatagaatccactgaattttctacatagatgatcattgatgatgtattccttttccactctctcctatattatagtgatatcactgtggcttcctagtcccttagtccatactggttccactttaacaaaatgggaaactggtctaaccaaggctgactcattgatagctggggctgtgaccctcagggtttgggggttgtcatacccttggccagtagttcctggagacctcctctaggatagcatagggaagattgactcatcaacatttttgtccttcagacaccaagaagaagaatgcctcccccatccctgcaattcagctctcaccctgggcttctgggccagggccctgtggagagtccctcccagtatctttctccccttgtttccatctgagctagtaaaggagccttgtatggcttgggggtgagtataacccccatgaaaaaaagtaggaaagtctcttataaaaggaggaaagaaagggagtggtgccatgtctcacttttgcagtgaactggactgtctgcttgtaccttgccattgtgtgcccctgtcactgagaaggctatctagtatctgctgaataaagtgaacagtgtctatgagacctgagcctcctctgttgtctcttctccaaggggagctccttcctctgtcccttgatctagcatgccttactgatactatgagtattgtctgggatgtaagggagtagatcagggggtggggaaggaatgtctccttcagctgataggtttggactgccctctctcacagagtcggaatgatgttattcgagaacgctttggaatggatcccaagccagagatgcttttgggccttgctgcgctccacatctatatcactgtctcagccactcgacctagtcagaagatctcgctcaagaatgtggagtgagttgtgctgcggcccgttgggatggggggcgaatagttgcgtagggaaaaggtacactggttgagctatgctatgcttttcagaaatgtaggacatgggatgggagtgagaattggagtccctcatatctagactatgaagccctagagctacagcttctactagggagctgtggctaatgttattttcctatccctgtccctttttctttctcccagtctctattcctccatctctacctctcagattcagtcaatttctgtcttaccatcttctctctgtcccactttgcctctctcactaatctcttacttttcttctgcttttaggaaggagtggggcctggaaccctttcttcccccctccctcctgcaggtcatcaaagagaagaacctccggaaatctctctctcagcaactgaaggctcaccaaacacatccttcctgcggcaccaaggtatccagagtagaccactgggcatggtgctccaggcactactggccacagggagatcctgggtggtttcccagcagagtctggtcctctagggatcctcaccactgcttttgactcaggtgcacatacggcttggccaggtgtggggcagttgtggagaggagtcttccccaagcctgagcatcccaaagagacagctgagtgacacatcactgagagagctcagggtcctcaaagcaaaggggccaagatgcaggagataattctcaggtccttttcaccaattagtcagtgccgactgagcatgtatcatgtggaaagcactggaccctagggaggcacatgttttccatggaaatgactaggctggtgtggtggctcatgcctgtaatcccagcgctttgggaggccaaagcaggaagatcacttgagcccaggagtttgagaccagtctgggcaacatagtgagacagcgtctttacttttaaaaaaataatttaaaaaaaatgtaaaaaaaggaaatgtacctctgtacctctaattcatcagtcctagggtgtggaattctgggagacaaaaccccagcccaggggaaagtgggagagttgggggcacaagacctgacctggagaatgggtcactgggtggaatggtgagggatcaggttactgcctccactttctagtgctctgagggactcccactgtctgctttcccaagccccgcagcagcttcttagctttgtaagattcaatctgcctgtgcttcctgccctagaagcaggagagtggtgagacgcactagaatcagcatgcagatgtacatatgggacgcaatcgccccatacattcctcccattccagatttcttgcattaccaactagcttctcttttaagatgcaaatttccccggagagttaagccattcccaccttgctgtgaatatttaatcagattgttttcttctcaactgagagcatcagtgctcaccaccatctcctcaggtaacatttttttcgaggcaccccagtgcttgggttggaaatatgaagatgaagagggcctggtcttggcccctgagtcaggcacagtctaatggggaaacacattagtcagtcccaacacagtgcattaggcacaggtgctctggaagcacagaggaagaacactaagcccagcctgagggaggtggaaaaggccagagctgggtcttgaaagacagataagagtttgtctagattaatccgtgggcatgggtcatgggaggaagtgtttcccaggcagagagatccatctgtacaaaggcccagagatatgagaaaccatggtgcaaggacagaaatgcaaatcattcagcctaagcaagtacagaaaatgcaagctgtgtgcaaggggtgaagataggggcaagagaagaggccagagaggttggcaggagccagttcatggagggccttgtgtgccaaggaaagaggttgtacttcatcctctaggcagctgggagccattgaagggtttaaagcagggagctgatgtgattaaacttatgttttaggatgctccctctaacagtgtggaggcacttgagggaaagagggaaacaagtgtcagtcctgaaggtaacctggctgtcaccctgacacaggtgggaatgtcaaggcaatgactggctagagaagagggatggatagattggaaaaggagctagggggtaagtatccagatgatctggtaactgctggctctcacatgaggcgattaaggaggagtccagtgtgactcacaggtttctggcttgattgcccaggggatgctgatatagaccaggaatgcctgaagtgcaggcttgggacttaggaatgcttagtatgaacggtattgagtgggacccccagctggggaatgaccagcatgtacatgactctaggggtctgaaacatctcaggagagaggtatggattaggtggggcgtcagttagttggaattaaaccaaaaacaaaatgagtaagctggatactttaggaatgaagatcaggaggtaggacaagattttagaaagggagatgagatactagagggaagagctgtccaaactagaaccttgctgctgttttaagaagggcatcttcacatctccacagtgtcacttgctgactggtgcctgtcctaggatgttgagactcctcgttgagaacatgggtttgcttttcctgtgcccctcaggcttctcatatttctggatgggtttttccacagggctctgcaattcaggcaaagctccagtatctacgaattctgaatgaacttcctaccttcacgggcgttttgttcaacactgtaggcctggtcagtggcgcaggattgggggatgtggggagggagccccttgttggctcttgtccttgggtgtgggggcaggaggggcaaatatttctaaaggccttcgttcctcttcctcctccttctacctcttacctccctggccctgcctctgccaaaatgataaagtgggaggagatatttgttttgagtatccctccatgacctttttttgttcctcttcctcgatttgggggcgcagcatactttttccataaagggccagatagtaaatattttaggttttgcaggcgggccatactggcaactgtggcaactactcagccctgctgtcagattatgaaagcagccacagacaatgcataaacaaatgggtgtggctgtttaccaataattatttatggatacgaaaatttgaatttcatgtacttttcacatgtcacaaaacatgcctcttctgattttttttccctaccattaaaaaatctaaaaaccattcttagctcctgggccataaaaaataggtggtgggtggtatttggcccatgggccatggttaggcaacccctgctctatttcatttttgttccacatactcccacagtcccctaccctaggtttcctgagtccttctacttctccccctgcttgctcagcacctttgctgcaggaacaaggctctggggcagggcacagctggtcccaccctaagactgtgccccaggctagtttaccctggtgaaaggaaattcaaatcaccttgctaattggatccaggtgcttgtcttgctcccaggagcacattgtcagctagtgcggcacatcggtggaaagccacttatcaaagtgcctatagacaggcacaagaggttcctcagggtgatgctaataccagggaatgggcctccagacgacccaagcttgattgctccaaggaatctgtcaagacctcttaagggaatccagtccttcaggccgagaggtagccatttacatactgggatttgcagaacactgaaagcccactgtcccctcccacctccttcatacactgtcaaatctttcttccacccacctaccactgctaaaatttctattggccatacctgctggagtgcccattaaaaggcaaatctctgcttaacgagggaggctgccatgaagtacccaatcaaccctcaacaccttaggcagagttactgtgccagtttagtttttggcctgggtgagaagtgcaagtttgagtggctgttggtggggggagggtaaagaccagacacaggatgccgccttctcaggcagagcactgggtgggggcctcaaatggcctgcagcaacaaatggaaagcccctggggcttggaaggggagggtgctccaaaggcccccaaacaaacctcacctacttcacggttttgcttgagctagcccttctgcctgtgcactttactcaacctgctgctgaggctaaggtgttcatttggacccataatctggggctctatcccaggaaccattttctgtcccagaccattttcccctccaggttgtcctactgtggcactgagccccagatattttcagaccccaccagagagtccaatgcatgttttctatttcctcctcctgcctcctctccccacctcctccacccttccttctgtgaacgttgcctgccattcttgggcaccaggatgagaagcagtcggccaccacgctcctggtgggaccccgtcatggcatcagccatgttattgacctcaaaaccaacctcaccactgtgctgtccgagttcagcaagatcagcaagatccagctgttccgggagaaccagggcgtggcccgggtggagaccagcatcatggatgccaaggtaagccctgctttgagggcctccttctgtttaggaacaggccttgggaatagaggaagaagtaaacttgagaaagagaattggaatctgttaggtgaggttcagtaattctgaagtggttcaaccctgggactctttgggctaatatgtctcttctcagccctctgggacatgccattttgaccacataataaggtcagccagcactaaggaatgctatggagagtcagatcagcctgagacagttcttcagcacagggcagggaaactggagaacttggagctacccccagaccactgcttcccatttttctcatatcatagcacacagaaaattatattcacaggccggcatggtggctcatgcctgtaatctcatgctttgggaggccaaggtgggcagataacttgagtccaaggggtttgagaccagcctgggcaacatggtgaaaccctgtctctacaaaaaattacaaaacttagctgggcatggtagcacacacctgtggtcccagctactcaggggactgaggtgggaggactgcctgggccagagaggtcaaggctgcagtgagctgtgattgcaccactacactccagcctgggcaacagagtgaaaccctgtctcaaaaaaaaaaaataaaataaataaaaagtaataataaagaaagaaaagaaaaaagaaaaaaaaattatattcatgtggaacactggggtaaatgtagcagccccagagactctgtccaccccaggttctgcctggctgccccagaaactataggaatgaatatcttggcccatcttcacccattccatgtgcacagcagttggggggccctgccatagggacacgcaccttgagtcattgaagagagggtgtctgagcatgtgaacagaacagagggggcctgggaagaaggggaacatgcagagccttgtccttatttcacctcccagagtccagcccttccagaaccttagattcattcccatagatcaactccttcggactggcaagcagctgtcgcctgtgcaaagtctggcagtcttggtcagccaccccctccacagctctcctgtttgaataccagtgaccactgtgggtggggggcaggcctgcctgccagctggcggaagctcttagaggagttgcaactttcctttcttaaacgatttcccagggggagatattggtagcagattaagaggtggagtgtttgctgtttctaaaagagaaaattatttgctttatttttgtctttgtgaaacccagaaagctttaatgtgttgatttttccacctgtgattcacaggattcccattggtttaggaactggcttggagccgatgtttaattggcttgcggctacctcctcaaccaatggttgctgcactcctcagatgttgttgggtaaaaagccaaatggacgggcagagaagggggcagggaagacaaggcatgcaggggagatgtggcttcctgagaaataaaaggggtttaaaatagagacacagctttccaactgagtcttctatgttctgagtgattctcaacattgactacacaatagaatgtccttaagtgctttaagaaaaaaacagatgcctgggtcctactctcagagattatgatttctttggtcatgggtgaaacccaggcatcaggatttatttatttttttcagtttcctaggtgactgtgtaatgcaaccactttgagaatgcacaggcttgagacctgtattaccagagctctgggaggaaacaggctgaacaggggatcagtgggtgttgtctgagtgaggagcactatgcttatttctaggggtgatccagccacagttgtgggaatgaatgctgccctggagaggctacattgtcattggggagactagattcacaaagacacatgacctgcctttaaagcacaatatcagaacatgtatagagctctggaatcagacaaggctcaaatcccagccttcctgtgtgaccttcagaaagtgtcttaacctctctgaatcccgattccctcaactgcaaaatggaatgcctatctcaaaaggtttttatcaggattattattattatttttaattttagagatgggggtcttgctatgttgcccaggcttgtcttgaactcctgggctcaagcagtcctcccaagtcggcctcccaaagtgctgggattacaggcatgagccactgcacccggcctgttgtgagtattaaatgaaaaaatgtacataaaatgtcttagcatactgcctggcacacagtaagtactcaatgaatgagacctgttattttttcaaaagcaaaacatcagtaaagaaaaagtaatatgaagtaaatgttacagacaagtgtgatgtggaatatggaacaaaagaacaggaaggagttaatcagatctggcttcccacaagagggtgttttaagctggatcttgaagtgataggcatgaattagcagagagaagtgggatgtgttcaaaggcaaggagcaagcacagaaataagcaagccatatgtgcaggtcgataagcatagttgcttggctggagaggagaataacgagaaaagagattgaagagattgggggtgggcagaacaagttggttaaaagcctcaaaggccagtctgtggaatttagattcaatgtggtagaacagtgagaatccacagtaggtctttgagcagaggggtgatcaaataaaagttgatttggaccagggtgcaagatgggggagagcaaagctaatgtcgagctagggcagtgaggaggggatcatggcactagtccaggagtgaagggacaagggcctgtgctggagggacagcagtggtaatgagaaaaaaagaggagatgtgaaatatgcaaaatcagtaagatgtgggtgcatattctcccctgcataccactcttgcacagacaatgcacgtgtcttattatacctagcccttctgcctacttcatgggtcccaagtactctgaagaatggtactatgtgcccagcagaagcaaaatggatgatattgtagtgaaaagagaaagggaagattgagggagaaaaaaagatcaaggtttagatttgacagtcatttagtatgaacttgctgttgctgggaagcatgctaaacacagaatttattttattttattttattattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtcctccagaattttttgttttttaaataaagaggctgggcacagtcgctcatgcctgtaatcccagcattttgggaggccaagggaggcagatcacttgaagtcaggagttcgaaaccagcctggccaacatggtgaaatcctgtctccactaaatctccactaaaaatgcaaaaaaaaaaaaaaaaaatcagctgggcgtggtggcacacacctgtaatcccagctacttgggaggctgaggcgggagaattgcttgaacctgggaggcagaggttgcagtgagccgagatcatgccactgcatcccagcctgggggacaaagtgagactccgtctcaaaaaaatagaaaaaaaattaaaagacagaaaaaaacatggcttgctgggtgcagtggctcatgcctgtagttccagaacttaggaaggcacaagtgagaggataacttgagcccaggagttcaagacctgcctgggcaatatagtgagaccctgttctccacaaaaatgaaagagagagagagagagagagagagggagagagagagagagagagagaaccatggctccttgccttcaaaaagcttacctagcttgtaggatagaaatggacatatacagccctgcacggtggctaatgcctgtaatcccagcactttgggaggctgaggcgggcagatcacctgagatcaggagttcaagaccagcctggccaacatggcaaaaccctgtctctactaaaaatacaaaaattagccacgcatcgtggcgcacacctgtaatcccagctattctggaggctgaggcaggagaatcccttgaacccaggaggtggaagttggagtgagcccagattgtgccaccacactacagcctgggtgacagagcgagactccatctcaaaaaaaaaaaaaaaaaaaaaaagcacaaatacatggcacacagaaggaagtgccataggagagctaccaagagcatgttaggggagtacagggaaggacaaaattctggctgggggtattaaggaaagcttcttagaggtgcttatatcagcaatatttgtgtttagtaagaggtggctctgggaaggaattgggagagcagggttgggaagcttcttactagagaatggcttccctgggctcagtaagaatctacccaccgagccagtggtgtgctggagctggctcacacagtgcatcagagccagctgggcacatctctccccatctctttgttcagtgccatcatgttaatagtttgaaagcagccatggtgggtgtatgtacaccagggaaattggccaatgctacaaattactacttgaaagaactggctgtgggctgggtgcagtggctcacgcctgtaatctagcactttgggaggctgagatgggtggattgtttgaggccagtagtttcagaccatcttgaccaacatggcgaaactctgtctctactaaaaatacaaaaattagctgggcatggtggcttgcgcctgtaatcccagctactcaggaggttgaggtgggaggatggctggagcctaggaggcagaggttgcagtgagccgtgatcatgccactgcactccagcttgggtgacagagcaagagacagtcaaaaaaaaaaggaaagaaagaaagatgaaagaaagaaagaaagagaaaagaaaagaaaagaaaggaaggaaagagagaaagaaagaaagagagagagaaaaagagagcgaggaaggaaggaaggaagggagggaaggaaaggaaaggaaggaagggaaggagggaggaaggggggagcgggggagggaggcaggaaggaaaggaaagaaaggaaagaaagaactgcttgtgaaatgtttaccagcacacaactgcataggttacactgaagaaggactgtctgaacatccttaacaggggacatggaagttagaaaccagacttggcccatttccccctagacaggccactctggtctggtaatattctgtaagggtctggtgaaattaagatggttcatttaaagtagttctcagccctgactgcacattagaatcatatgtagagatttaaaaaccactggatgcccagactcttcctcccagaccatttaaaataagaattctggggggttggggcccaggggtatacaggtctttaccacttccaggtgattctaatttgtatctggcctgagaaccactaccttaagtgatattctgccttgcccccaaattggctggctgtgcccaattagcctttcccagtgctgtggaggcaagaaccaaatatactgatcccttgggtctctagaccatcatcttttacccttcccctccaggccccttgattccatccttttcctgttttcagggatgctagagtgagcgaaggctaccccagggaaaatccttttcctagttggcatttcagagtgctaagtgcctgttagctcccagggcaccctgggaaggagatgtagctgaagcatgtcaaattaatccctgctgtaccttcttctggctggctcatgcctccaactccattctcctttcctcatgctacatttgaagatggcctgggcatattaattagttttcactcagcttacttgctcttagtggagcaaacatgaggtagtattcaaatatctttcttcaagagatggcagcctgggactgaggcatacctgggccattaccataccccattaccacagaagcacataaggtggaaaaagaaatcatcaaaggaatgtcccaagggatatcttgtggcccagtatgtgtcctattctcatgtttgagctttatttctctagtgatctctgtagggacaagcgttacattacacgtcatgatcattaaaatcctatctaaaataaaaaattgtttttgaaggtttctaaggaacctgtccaacctttttgtttgcctgcttttgatttcatttttacctgttggcaaaaatttcatttttctcttggcaaaaatttcatttttctcttggcaaaaagtgcatttgtgttccttttactgcgagctgcatttggcccatgctggggccaagttggctgtctggggatgacaaggagaggctcctgatgagctgtgctgtgctgagccagctggggttgtgcttggccctctctgtgcacgggattttgctttcgtgctgttttattactggcactgggctatcttgggggtaagaggggaaactgaagtggtcagacaatgaagtcaatcagccattctcccagcctccagtcagtaattctgtccattagccagccaaccagccagccaggcagctcagcggtcagaatgtgaggctgttaggcattctgtctgtcctgagctggcttgtcaaccagggcatgagtgagtcagactgccctgcagccggccagctcattagtcagccagccattcagcctctactttggtcaaatggtctcacattatatttgtcagccaatgctattttctcaaagctgtctccagtgtctgaaaccaaattagtcacacacgcacacattcacacttacccacccacgtaccactccaggacattctacgtttgggtagctctctatacgttttcctcaaagtacttatcacacctcgcaatcatatttatttgcatggttatttgatttgggttatgtcttatttcctgctcgattgtaagctccatgagggcaggaactaggttggcctagtcctggaatgaatggatgcatctttcacttggtcatgttctccaggaggcatctagccagtttatggcagcttgttgggtggacaaagcagggcacaggagcatttcagccagagggaacagcataggttaaggtatgaagatgtgaaggaacatgaggaactgtatttgtaattgctggagtataaggtgagggacagtgatgggaggggagcaccagtggagttaatgggagatatggttggagatggaggttgggtccaggtcctgaagggatttgtatgccattgtaaggcagttggattttctacaggtgatgagctattgaagattttaaataacaatgagacttgtgctttagaaagagccttcagactttgggagcctgagacgggtggatcactgaaagtcaggagttcgagactagcctgaccaacatggtgaaacaccatctctactaaaaatacaaaaattagtcagatgtggtggcacacacctgtaatcccagctacttggtaggctgagacaggagaatcgcttgaacccaggaggcagaggctgcagtgagccgagattctgccattgcactctagcgtgggcatcagagtgagactctgtctcaaaaaaaaaataaaaaagccttcagggtcattcagggtgtctcatgcctgtaatctcagcactttgggaggctgaggtgggaggatcacttgaggccaggagtttgagaccagcctggaaaacatagtaagaccacatctccactactactactactactactactactactaataataataataataataaagtagaaaagaatcttcaggcaacaatatggaggtgaagtggattcaagtgggtagaaactagagggagaaaggccagtcaagaggttattggaggttcttgggttagtgtatcccaaccttttccatatcatgagaaatgtcacaatttatataacaaaacatacaaacaaacgaggcatacatatataccagatgaggcagcttgcggccaaaggcaataggactgagaagccgagaggctcagtatctcagcacacaggccacccactcacaagtaccttgaggagttttgatctggcaggaagatgataaggtcctgaaatgaagcagtggcagtagggatggccgcgatgtgaaaacacctgaggcaagcctagtgagtcttgggccctcgtggtagccgccatttacactcaaacctctgtatctgtatatccttctgccatcagtggcagggctacagtggcagcaagacagcaagaaggggtatctgactccctgccccccaagttcatttcctttccatacttttttgtctttattttgttgtatgcaagtttggccattctgttgtgactgagaaacattcattaactggaggtacgaaagtcccttctaccccttcctaataatgactaaaaagtaatacctgtctctggcccctttctcactggaaaaaaaagccattgctcctcaaggtacaaactgttcctttttcctcccaatggtattgcatgaactccataggagcatcactaacttgttgccttaaagttggggcagagtccaaatgccttattgtggcatgcattgtaattgaatgtacaacaactatgaaagaattcaagttagtatttgatccaacacaagactgtgtggtatagacatagcaccatatgatttctgcaataggaaaagaatttaaaggagtagactgggcatgttgatttttgaatctccagcatagaggttaaagcagacaccctgatggagaagaattgagggctgtagactgagcctaggatatagctagggcgaggaggttgcacatgaagaaccaaccaaagagagagatgaagatggtcagattacagaaccggaacacatctcacagaaacagaagccaagagaagaatttccaaagaaggtgattgctgttagcaaatgtaataacttgagatgtgtgatgaatgaatacagttgtttctagctgtaaagaagtttcacttcagcgagcgctgtggctcatgcctgtaaatcccagcactttgggaggccaaggaggatcacttgtgcccaggagttcaagaccaacctgggcaacatagtgagaccctgtctctattgaaaaaaaaaaaaggcaaaaaagaagtttcacttctagatcaggtggctaactatggcccatgagccaaatctgactcactgcctgtttctgtaaataaagttctgttagaacacagtcatgcctatttgtttagtttacagattatctgtggctatttccacactatgtacaatggcagagttgttgtgacagagcccgtatggcccacagtgcctaaaatatttactcactagccctttatagaaaatgtgtgttgacccctggcctatatgaactacaaaatattcaactcaggctctgtgttggaatcctgggaaaaagaaaaccactgcaactttagctaacagctgagctggtttggaatcagaattgagcccaaggtaatggtgattcagccaaggaaggctaatctagttagtgatcaagttctgtcaggtcttcataatgtcccttccttttcactggaccagccaccaccctagtggaggccctaaccacctctctcctagactgttgcagtagcctcctcattggtcagagaagggcctcatttcctctgcctaattctcctatttcttaatgcctggtctgggtgacccacagccccatggctccctctttagccagtcttcagtgatctttatctggaaaccactgccctattccaaggagaatgttcccaaggctgacttcagtctgactcaaacttggtcaagccatagttaaaattacaatacagatactaggaggttttcttgaaatagtgctgattttcttgaatagcattgcctggtctctgaagcagttaaccagttaaccccaggactaatctgactgatttagagttaggaacagaagtcaacaatgtatgctagtatttcccaaggtgggttaacaacaacaacaaccttgttaccatgagattttctataaaaatagatctttgtggtctaataaattcagaaaacttagaatattaaagcctttcttttgaggtttcccagtgcacaactatatattaaagggtcttatgaattctcatagtaaaactatctgcatagtgttatttaacccaatgtcacaaacatatttgactaaggagctcttttaataagcaccaattaacaatatctcaaggacacagggaaataaaggaaaggggatagagcatgactcttttttttttttttagacgaagtctcactctgtcacccaggttggagtgcaatggcgccatcttggctcactgcaacctccacctccctgattcaagcagttctcctgcctcagcctctggagtagctgggattactggcgcctgccaccacgccaggctaatttttgtatttttagtagagacggggtttcaccatgttggccaggctggtctcgaacccctgacctcagatgatcctcctgcctcggcctcccaaagtgctgggattacaggcatgagccaccgcgccgggccgagcatgacgctctgagcagagctgcaggccagaaagactttggcccaaaaggcagagttacaacttgattccacagagattcctccatgtccagggaggtgttctgggtgttacaggggcatgtgaagatgagcaagacatagctcttgcacccaagggacttagaatcgagggtgttctaggccattctgaagtctaatctaaattcccagctttaccccgctctcccggctggcctgtgtatctgctgagccctggcaaacacaaatacagctacacagcagtcacatgaggttatataattttagtccttttcagcaaaggtggttcattaaatgtataattaaaggttgatttaattttgatacctgggtaagaggttattacaaagaaattctcaaatcagaataaactatttgtcaagccatgtgcctcaatttttggttcagacagtatggttcctttaactatgcaagtcatcttttgctagctaccatgcctctgaaaatgcatctgcctccctccttcccatgtcttcatgtttcttcccttctcttctgcagcctctggtgctgttgatggagtggcctgaagccaccaactttgcctgcctgatcgcggggtactgccgcctcttgctggattccaggaagatggtcttctccaggcctgccagccagccacttccacctccaatgatcaaggcaggtagggctcaacctcggttggtttttgctgtgccagaggccctttggaccctgaagacatggagggaagagcttctctgccttagtgctcaccccgtgccaacagtgcctgatttgccaggagccaacactgtaccactatatcctagctggcacagcccagtgggaaagacagctggccttcacatgtacttgtttcacaaaggatacctgtgacaacattgtgattgagtcagccaatgaatgtattattaaaatagcaaacatgataaatagagccaattaaatggctgcattggatctaaggcaaacttagcggtgcagagatctagaggaaacttacaggtgttctggctcagttgaagtgaagatgaaaatgaatataaaggtctgatgaaaaggaggtggctcaaagaacaggtacttcacatattagacctaaggctcatgtagatgcagtaagtgctccccaaccccagcacccagaaataatgagtgaagctgagactgacatccagtagtttgctctcctcacatgctgaatactctcaacccacttgcccttgctgcttgactatttctttcttcaaggctgtggttttctgagtagtcatatcacactttgggaggctgaggcaggcggatcacttgaggtcaggagtctgaaaccagcctggctaacaaggtgaaaccctgtctctactaaaaaaaaaaaaaaaaaaaaaaaaaaaatacaaaaaataggccaggcatggtggctcacaccagtaattccagcactttgggaggctgaggtgggcagatcacctgaggtcaggagtttgagaccagtctggccaacatggtgaaaccccatctctaccaaaaatacaaaaattagctggacgtggtggtgtggacctatagtcccagctgtttgggaggctgaggcaggagaatcacttgaatctagaaggcggaggttgtagtgagctgagatcacgccactgcactccagcctgggtgacagagtgagactgtctcaaaaaaaaaaaaaaaaaaaaagccaagtgtggtggtaggtccctgtaatcccagctactcgggaggctgagacaggagaatcgcttgaaccctggaggcagaggttgcagtgagccgagatcccgcctttttacttcagcctgggcgacagagcaaaactccctctcaaaaacaaacaaacaaacaaacagtagtcagatcagatctcgatcgaggtgtttgagagcagacacatactcctgatggatggcccagacctagaaggctgtggacaccccccacccacacacatcttctcacctcttgtctcttcatcacgatcatcatgacatgcctgagtttacatctcatgacattgtccataggaactaaatggcaatgcaccaaacacagatttgggaaaggataggtggccccaaggcatatgaaggagattccacatagaaaagcaaaggagctgacttaggatagtaagaaaccagggggctgagttgcttcaagtctccaggtgaacagctctgaaggggcggccatactagcaaacctacagatggccgaatgatgaaaaagccagcattagcattatcactgtcacttctgctcttcctctctctaatcacatccaagtaaactatacctcctactgaacaggctagagagggagaaaatgaaaagggaagataaagtgaagaacctggagcccagccaaagaccaaatgtgacagtgaagattatttggagggaatccactttcagaaggcactggaggtggctctgtagtcccaccctacctaacaaacagttttttgtcatcccatcagcaccctagccaatgctggccccaagtattccccttgctctggggatagtggcaccaagcacaagagggatatgtgcttcagtgcagcctcactgaacacattccaacatgccatgttgcttttccaaaggcaaatctgttttcttgcattctctatgggctaggtgtggctttaaaacaccccaccccccaccaccttcctgacttctgagatccgccttcggcctgcagaatgatgggggctcatgttgcctctagcacagggcctctgtgtccatgcgggagccagatggaccactgtgatgtctctgtttttgtggtacttctccctcttggggtagaaataatcagcttaggggcagagacctacagaaagttctgctcttccttcgccatctcttctggccagaaacatgagaacttgaactaggcatcatctccctaggtacatggtttaaatcttgggccctgttacttagctttttgaactgttaggtgctcttggtgggtggagtggggcagagtgagcctcacagctctacctgggttcactgagctgccactgccccagcaaagttctaggacttggtgtgcacattttgtctcatggccgctaagaagggaagggcacaactgaggagacctcagctcaggttacagtgaagggattatccgttcctgatattgtagacttttaggaccaaggtccgaagttgagatcagtttcctacaccagcccttactttcatcccagaacagaagccccaatgccaactgttgttccttaacaaaggccaatagggaataggcatcctcccaaccttatctgggcttttcccccagggtccaaagccacagcctggttaggtcctggtctctcagaaaagggaggaagaggtctggccagctctattcttgtcccacagcagctactggctgtcagcaagtccaactcagggctcagcctattgggcctaaaggatgaagttaaaccagcaactgggaaagtgaaaacatcaccttccttcaagtctcagaaaaaaaaggagaatggggacatggtagggaagggactccctcttgggctttatcagtagcttcaccaaaggtactacacttattcacttaacaaatcaagcactcatcatgtgccaggtgcagaagcagcagccatgaataacagacatagtccttatgatccttgccctcacataggttacaatctagtagaggggaaatactgacagatgattaaaaggataaggctaataacgtaagtacttttgcatttatatataagagattcaatagatacaacagagcagcgcctgggtttgagggcccagaaaggctttgagcttagagaaaggtccagaaaaatgccagttctctatctgtaatgaggttgtgggcaatctaaaggcagctaccatctttctgcagccctgagctctctgtatcctggggtaatccaggaaaaaaaggctttgagggcctcagttggaggaactcactctacgttttctaccatggttagaaaacagtttggtctgatgaattgaatattttggttaatggctactatatatcccatgagtggcttaccaattttcatgtagttaaaacccagcaaaatgtacagagtactaaagtaagactgaacgtagtagacttgttttgggtgattcagaaagaacatgagattcttgcaaggcctctaggtcgtcattatgaccagtgattattggactatagaatagagcagggccaagtactagaatgctggctgagtcaatgtcacacagaccgtatgtttatatatataaaaataagctgcatatattttcaaacataactccagttgaatcaccctcctgttctttgcaagcatttttttctagtcagtcttctgagtgactgagtacagagggatagactagggcaatccccttggggaaagctgatgagcaatttacaacatatttgcaatatgggaggcatactgtcctgaaccatcagccagccacacctggcattttactggcacttctaatcttctgccaggaggagatttgggattcttcaagcacattttgtcctctgatctggaagtcatggtaccaagtggtggacagggcattacctggccttgacagtctagtgcttagagatgtttccatcttgcagggagggaagccacccttagaactccagcctctgcctgagaggagtcaccatcttcttattgggcatgccactgggagccacctttgatggcagcttattgccaggctggctatcctgattgctcagctgtctcatacgtagttagcacctggtacatccccaggacctgtggacaatgtcttggtgtagagagacataatgaacttatagttcatactcctggctgattgctcctccggagcacttattccctaagtctcagaggcctggatggagggtaattaaataatatttctccaactgacccagagttccctagatacagtaaagcccagtaaggcctgaaccaaccccactcattgattctgtatttaaagcggcaacatggtctatggaaaattgcaagagagatctgaagtcacagagacttgggttccagtccctgttttgccatatcttagctatgggatcataactaaatgccagaaacttagtctcagtttcctcatatgtaaaatgaggataatactattacctacctcatgaggaatttgacaggattgtgtgagataaaccacctaaagtcccttcacaatacagagtacccttttttgctctgtttgtttgtttgtttgttgagacagagtctcactgttgttgcccaagctagagtgcagtgtcatgatctcggctcattgcaacctctgcctcctgggttcaagctatactcctgcctcagcctcctgagtagctgggattacaggtggccgccaccatgcccggctaattttttgatatttttggtagagacagggtttcaccatgttggccaggctggtctcaaactcctgacctcaggtgatccgcccacctcggcctcccaaagtgctgggattacaggcatgagccaccacgcctagccttttgctgttttttcaaagactgagagttcatcatgtgcccagagctgtgctttaaaaaaaaaaaacagctttgtttagatataattttgaagccataaaattcacccatttgaagtgcacaatacaattttgtttaatatatttaatatattcacagggttatacagccattatcacaatctaattttagaacattttttgcccctcccaaaacaaactctgtacccattagcggtcactccctatttccctcctaatcacctcccagccctaagcaaccattggtctactttcagtctatagctttgcctatgctggacattttgtgtaaatggaataataaaatatatggtcttttgtcacttgcttttttcacctagcatgttttcatgggtcattcatgttgcagcatgcaccagtacttcattcctctttattgatgaataacattctattgtatggatataccacattcctttatccattcatcagttgatagacatttgtttttttcccaccttttgactattatgaataatgttgttataaacattcatgtttatatggggacagtttttatggggacatatgttttcctttctctccagtatatacctaggaatggaattactggtcaaatggtaactccatgtttaacttttagaggaactgccgaattgttttttaaagagactgtaccatttttcacttccatcagcaatattggagggttaaattttaaccgtatcttcaccaacacttgttactgtccatcttttttttttttttggagacagagtctcactccgtcacccagaatggagtgcatgtgcacaatctcagctcactgcgacctctgcctcctgggttcaagcaattctcctgcctcagccttctgagtagctgggattacaggcatgtgccaccacacctggctaatttttttgtgtttttagtagagatggggttttaccatgttggcctggctggccttgaactcctgacctcaagtgacccacccgccttgacctcccaaagtgctgggattataggcgtgagccaccacacctgaccatcttttcatttattaatatgtctgtcatagtgtgtgtgaagtggtagctcatgtttacgatttacagtttcctgatggctaatgatgttgaacatcttttcatgggcttattggccacttgtatatcttctttggtgaaatatctattcaaatcatttgtccattttttaattgagctatttcaccataaatgtgagaggttatttgtgaactctcaattctactgccttgatctatacgtctatccttatgccaccactttatggtcttgatcactatggcttgtaatgaattttgaaatcagaaagtgtgagtcatcctactttgtacttctttttcaagactgttttggttattctgggtctcttgtgattctatattaattcttgaattagctgttaattttgacaaagtcagctgggattttaatagagactatgttgaatctatagatcaatttggaaagtactatcattataacaatattgattgagtcttccaatccatgagcagagaatatattccaattatttaaatctcctttaatttctttcataaatgttgtatagttttcagtgtacaaattttgcacgtcttttttttctttttctctttttttctttttctttttttttctttttactttaagttccgggatacatgtgcagaatgtgcaggtttgctacatgggtatacatgtgccatggtggtttgctgctcctattcacccgtcctctaagttccctcccctcgctcccccacccccaacaggcccaggtgtgtgttgttacccaccctgtgtccatattttctcattgttcaactcccatttatgagtaagaacatgcgatgtttggttttctgttcctctgttagtttgctgaagatgatggctttcagcttcatccatgtccctgcaaaggacatgatctcattcctttttatggatgcatagtatcccatggtgtgtatgtaccacattttcattatccagtttatcactgatgggcatttgggttggttccatgactttgctattgtaaatagtgctacaataaacatacgtgtgcatgtatctttatagtagaatgatttatattcctttgggtatatacccagtaatgggattgctgagtcaaatggtatttctggttccagatccttgaggaatcatcgtactgtcttccacaatgtttgaactaattttcactcccaccaacagtgtaaaagcattcctatttctccacagcctcactagcatttattgtttcctgactttttaataatcgccattctgactggcaagacatggtatcttattgtggttttgatttgcatttctctaatgatcaatgatgttgagcatttttttctttttctttctttttttttttttttttgagacagagtctcactctgttgcccaggctggagtacagtggcgtgatctcggcttactgcaacctccgcctcctgagttcaagcaactcttgcctcagcctcccgagtagctgcaactacaggcgcctgccaccatgcccagctaatttttgtatttttagtagagatggggtttcaccatgttgaccaggctggtctcgaactcctgacctcaggtgatccacctgccttggcctcccaaagtgtttggattacaggtgtgagccaccacgcctggccctgttttgttttttgttgttgttgttgttgttgagcattttttcatatgttcgttggccgcgtaaatgtcttcttttgagaagtgtctgttcatattttttgcccacttttttatgggattgtttgttttttttccttgtaaatttgtttaagttccttgtaaattctggttattagacctttgtcaggtggatagattgcaaaaattttctctcattctgtaggttgcctgttcactctgatgatagtttcttttgctgtgcagaagctctttagtttaattagatcccatttgtcaattgtggcttttgtcgtaattgcttttggcatttttgtcatgaaatctttgcccatgcctatgtcctgaatggtattgcctaggttttcttctagagtttttatgatttggggttttacatttaagtctttaatccatcttgagttaatttttgtataaggtgtaaggaaggggtccagtttcagttttctgcatatggctagccagttttcccagcaccatgtattgaataggagatcctttccccattgcttgtttttatcaggttcaatgaagataagatggttgtagatgtgtggtgttatttctgaagtctctgttctgttccacttgtctatatgtctgttttggtaccactaccatgctgttttggttactgtagcctcgtagtatagtttgaggtcaggtagcatgatgcctccagctttgttctttttgcttaggattgtcttggttatacagggtctttgatgattccatatgaaatttaaactagttttttctaattcagtgaagtacatcaatggtagtttgatgggaatagcattgaatctataaattactttgatcagtatggccgttttcacaatattaattcttcctgtccatgagaatggaatgtttttgcatttgcttgtatcctctcatttccttgagcagtggtttgtagttctccttgacagggcccttcatgtcccttgttagctgtattcctaggtattttattctctttgtagtgattgtgaatgggagttcattcatgatttggctctctgcttgtctattgttggtgtaaaggaatgcttgtgatttttgcacattgattttgtatcctgagactttgctgaagttgtttattagtttaaggagtttttgggctgagatgatggggttttctaaatatacaatcatgtcatctgcaaacagagacaatttgacttcctctcttcctatttgaatacactttatttctttcttttgcctgattgccctggccagaacttccaatactatgttgaataggagcggtgagagggcatccttgtctcgtactggttttcaaagggaatgcttccagcttttgcccattcaatatgatattggccgtgggtttgtcataaatagctcttattattttgagatatgttccatcaatacctagtctgttgagattttttaacatgaagggatgttgaattttattaaaggccttttctgcatcagttgagataatcatgtgtttttttgtctttggttctgtttatgtgatggattacatttattgatttgcatatgttgaaccagccttgcatcccagggatgaagccaacttgattgttatggataagtttttcgatgtgctgctggattcggtttgccagtattttattgaggattttttcattgaagttcatctgggatattggcctgaagttttgtttttttgttgtgtctctttctagtttgagtatcaggatgatgctggcttcataaaatgagttagggaggagtccctccttttcaattttttggaatagtttcagaaggaatggtaccagctcctctttgtacctctggtagaatttggctgtgaatccatgtggtcctgggctttttttggttggtagtctattaattactgcctcaatttcataacttgttattggtctattcaggtattcaacttcttcctggtttagtcttgggagggtgtatgtgtccaggaatttatccatttcttctagattttctagtttatttgcatagaggtgtttatagtattctctgatggcagtttgtatttctgtggggtcagtagtgatatcccctgtatcattttttattgtgtctatttgattcttctctgttttcttctttattagtctagctagtggtctattttgttaattttttcaaaaaaccacctcctggattcattgatttttttttttttggagtgttttttgtgtttctatatccttcaattctgctctgatcttagttatttcttgtcttctgctagcctttggattagtttgctcttgcctctctagctattttaattgtgatgttaggatgtcgattttagatctttctagctttctgatgatgtaggcatttaatgctataaatttccctcttaacattgctttagctgtgtcccagagattctggtacattgtctctttgttctccttggtttcaaagaacttcttgatttctgccttaatttcattatttacccaggagtcactcaggagcaggttattcaatttccatgtaattgtgcagttttgagtgagtttcttaatccttagttctaatttgattgcactgtggtctgtgagactgtttgttatgatttcagttcttttgcatttgctgaggagtgttttacttcgaattatgtggttgattttagaataagtgccatgtggcactgagaagaatatatattctgttgatttggggtggagagttctgtagatgtctattaggtccacttgatccagagctgagttcaagtcctgaatatccttgttaattttctgtctctttgatctgtctaatattgacaatggggtgttaaagtctcccactattattgtgtgggagtctaagtctcttcgtaggtctctaagaacttgttttatgaatctgagtgctcctgttttgggtacatatatatttagaatagttagctctgcttgctgaattattccctttaccattatgtaatgcccttctttgtcttttttgatctttgttgtgttaaagtctattttgtcagagactaggattactactcctgctttttttttctttccatttgcttgataaattttcctccatccccttattctgagcctatgtgtgtctttgcacatgagataggtctactgaatacagcacacccatgggtcttgactctttatccaatttgccagtctgtgtcttttaactggggcatttagctcatttgcatttaaggttagtattgttatgtgtgaatttgatcctgtcatcatgatgctatctggttatgttggacactaggtgatgtagtttcttcataatgtcattggtctttatattttggtgtgtttttacagtggctggtaccggtttttcctttccaaatttagtgcttctttcaggagctcttataaggcaggcctggtggtgacaaaatccctcagcatttgcttgtctggaaagtattttatttctccttcacttgtgaagcttagtttgtctggatatgaaattctgcgttgaaaattcttttctttaagaatgttgaatattggtcctcaatatttttttttagacagggtctcactccattgcccaggctggagtgcagtggcacagtcttggctcactgctacctctgtccccagggttcaagtgattctcctgcctcagcctcctgagtagctgggagtacaggcacatgccaccacacccagctagtttttgtatttttagtagagagagagtttcaccatgttggctaggctggtcttgaacccctggcctcaagtgatccacccacctcggcctcccaaagtgctgagattacaggtgtgagccgcaacgcccagcctggcccccagtctcttctgccttttagagtttctgctaagaggtctgctgttagtctgattggcttccctttgtaggtgacctggcctttctttctggctgcccttaacattttttccttcattttgaccttggagaatcggagaatctgatgattatgtgtcttgtggttgatcttcttcttctttttttttttttgagacagagtttcactcttgttgcccaggctggagtgcaatggcacaatctcagctcaccacaacctccgcctctcaggttcaagtgattttcctgcctcagcctcccgagtagctgggattacagtcatgcaccaccacacctggctaattttgtatttttagtagagatggggtttctccatgttggtccagctggtctcaaactcccgaccttaggtgatctgcctgcctcagcctcctaaagttctgggattacaggcgtgagccactgcacccagccttgcggttgatcttctcatggagtatcttagtggtgttctctgtatttcctgaatttgcgtgttggtctgtcttgctatgttggggaagttctcctggataatatccgaaagtgtgtttttcaacttatttccattctccctgtctccttgcagtactccaatcaattgtaggtttggtctttttacagagtcccatatttcttggaggctttgttcattccttttcattcttttttctctagtcttgtctgcatgccttatttcagcaaggtggtcttcaaactctaatatcctttcttccacttggttgattcagctatcgatacttgtgtatgcttcatgaagttcttgtgctgtgtttttcagctccctcaggtcatttatgttcctgtctaaactgattctagttagcagctcctctaaccttttatcaaggttcttagcttctttgcattgggttaaaacatcctcctttagctcagcatagttttttattacctatcttccgaagcctacttctgtcaattcgttcttatcatcctccatccagttctgtgcccttgctggaaagatgttgtgatcatttggaggagaagaggcactctggccttttgagttttgagctttttttcactgtttttctcttattttcatgagtttgtgtagtttcgatctttgaagcctcaaagacccttggatggggttttggtgggagcttttgttgttgttgatgctgttgttattgatgctgttgttgctttctgtttgtttttctttcaatggtcaggtccctcttccgtacggctgctgctatttgctgggggttcacgtcaggccctattcatctggttcactcctgcacctggagatgtcactcaaggaggcgcctcccttggctgggggatgggggctcctttgccttgtgtggctctcaggtgggccacctgaccacactattcttccttcctctccatggatcatgccaacctactagtcagttctgatgagagaacctggatatgttggttgccgttaaaggattcacatgcttatggttcttttccatgggaaacttgattgccgctgtttctagtcagccatcttgaccctgcgctgtcctcctttttaaattcataactagttaaaagacaaagtcaaattttaaaaagacaaattattaagtaaaataagatttaaataataaaaaataagtgtatttataactatttgttcttttttatgttattgtaaatagaagggctttctgattttattttcaggttgttcattgctagtgtataaaaatagaattgaggtcgggcatggtggctcacgcctgtaatcccagcactttgggaggccaaggcaggtggatcacttgaggtcaggagttcaagactagcctggccaatatggtgaaaccctgtctctactaaaaatacaaaaaattagctgggtggggtggtggcgtgcgcctgtagtcccagctactcaggaggctgaggcaggggaatcgcttgaaccaaggatggggaggttgcagtgagccgagatcatgccactgcactccagcctggcgacagagcaagactccatctcaaaaaataaaaatacaaaaaaaactgattttttgtacattgagcttgtatcctgcaagagatagttttactttttcctttccaatctggatgtcttatatttcatcttaattcctaattgccccagttggaactttcagtcagtacagttttggatagaagtggtgagaacatctggacagaccccagactaaaaagaaaagaaagaaagaaagaaagaaagaaaagaaatggtgagaacagacattctggtcttcttcctgatctaagcttttatcctttcattcaaatcaagtatgatgttagctgtgagttttttataggtaacctttatcatattgaggaagttcccttttattcctagtttattgagtgttttattatgaaagggtgttagatttatgtttttatttatgtttttgtgcatctattgagatgatcatgtagtttttgtcctctagtctatttacatggtgtattacattgatttttggatgttaaagcaaccttgcattactgcaataaatcccacttggtcatggtgtataattctttttatatgttgctggattcagtttgttagtatttatacactgctgggtcatggtgtataattctttttagatgttgctgaattcagcttgctggtattttgttgagggattttgtgtctgtattcatgaaagacatttgtctgtagttttcttgtgacatctttgtctggttttggtatcaaggtagtactggcctcatacaatgagttaagaagtgttctctcctcttttgatttttggaagggtttgtgaaaggctggtataagtgcttctttcagcatttggtggaatccactagtgaagtcacctgggcctggacttttttcgggggtgagggaggagttttaattcctatcctaattcaatttcttttcctgatactgtctattcagattttctatcttcttgaatcagttttggcaaattgtatatttctttctttctttctttctttctttttttttttttgagatggcgttttgctcttgttgcccaggctggagtgcaatggtgcaatcttggctcactgcaacctccacctcccgggttcaaactattctcctgcctcagcctcccaagtagctgggattacaagtatgtgccaccatgcccagctaattttttgtatttagtagagacgaggtttcaccctgttggttgggctggtcttgaacttctgatctcaagtgatccacctacctcggcctcccaaagtgctgggattacaggcgtgagccactgcacccagcctaagttgtatatttctaagaatttgtccataccgtttaggttatccagttgatatatccttattcatattcccttataatcaattccatatctgtatggtcagtagtgatattctttctttcattcctgattttagtaatttgagtcttctctcttttttgtttgatctttccagctaatctgttcaaaacaccaacttttagttttattgattttctctatcttttttctatcctctatgtatttccttccacttgctttgggttgtttgctcttctttttttgcctttatttttgttttgtttttaatttttgtgtgtacatagtagttgtatatatttgtggggtacacgagatgttttgttacaggcatgcaatgtgaaataagcacatcatggggaatggggtattcatcctctcaagcatttatcctttctttgtgttacaaacaatccaattatactcttttagttattttattttatttttatttcaatagtttttagggaacaggtggtgtttggttacatggataagttcttcagaggtgatttcttagattttggtgtacccatcacccgaacagtgtaccctgtacccagtgtgtaatcatcttttattcctcaccccctcccgcccttccccgcaagtccccaaggtccagcctatcatttttatgcctttgcatcctcatagcttagctcccacttgtaagtgagaacatatgatgtttggttttccattcctgagttacttcacttagaataatggtctccaactccacccaggttgctgcaaatgccattatttcattcctttttatggctgagtagtatttcattgtatatatttaccacattttagtctacagccatacctccctgaatgtgtccaatctcatcaaccacattaaaaaaattttttaatattcatttattaatgtttttagatggaatctcgctctgtcacccaggctggagtgaagtggtgcaatcttggctccaaaagtgctgggattacagacatgagccactgtgcccaactgtaccacatttttcttcatctgctcgttgattgatgggcatttgggctggttccatatttttgcagttgtgaattgaattgtgctgctataaatatgcatgtgcaagtgtctttttcatataatgactcttggatcaaatggtaaatctacttttagttttttaaggaatctccatactgttttccatagtggttgtactagtttacattcccaccagcagtgtaaaagtgttccttttcaccatatccacaccaacacatattttttttttatttttaaattatgaccattctttttttttttttttttttttgacagagtcttgttctgtcacccaggatggagtgcagtggcacaacctccaccttccgtgttcaagccattctcctggctcagcctcttgagtagctgggattacgggcatgcaccaccatgcctggctaatttttgtattttagtagagacggagtttcaccatgttggtcaggctggtctcgaactcctgaccttgtgatctgcccacctcagcttcccaaagtgctgggattacaggcatgtgctatcgcgcccagccattatggtgaattcttgtaggagtaaggtgatattgcattgtaattttgatttgcatttccctgataattagtgatgttgcacatttttccctatgctcggccatttgtataccttcttttgagaattgtctattcatgtccttagccaacttcttggtgggattgtttgtttttttcttgctgatttgtttgagctccttgtagattctggatattagtcctttgttggatgcatagtttgcaaagattttctcccactctgtgggttgtctgtttactctgttgactgtaccttttgctgtgcaaaagctctttagtttaattaagtcccaactatttatctttatttttattgcttttgcttttgggttcctggtcatgaaatccttgtgtaagccaatgtctagtaggggttttccaatgttatcttttagaacttttatggtttcaggtcttagatttaagtccttaatccctcttgagttaatttttgtgcaatgtgagagatgaggatccagtttcattctcctacatggggctagccagttgtcccaacaccatttgttgaaaagggtgtcctttccccactttatgtttttgtttgctctgtcgaagatcagttggttgtaagtatttgggtttatttttgggttctctattctgttccattggcctatgtacctatttttataccagtaccatgcctcgtagtatagtttgaaatctgataatgtgatgcctccagatttgttcttttgcttaggattgcttttgctatgcgggctcttttttggttccatataaattttaggatttttttttctagttctgtgaaaaatgatgatggcattttgatgggaatagcgttgaatttgcagatcgcttttagcagtatggtcattttcacaatattgattgcacacacccatgagcataggctgtgttttcatttgtttgtgtcatctgtgatttctttcagcagtgttttgtagttttccttgtagaggtctttcacctccttggtgttttattttttttgcagctattgtaagaagggtgaagttcttgatttgattctcagcatggtcactgttggtgtatagcagtgctactgatttgtgtacattgattttgtatcctgaaactttaatgaattcatctatcagatctaggagctttttggatgagtcttcagcattttctaagtatatgatcatatcatctgtgaacagtgacaattcgacttcctctttaccagtttggatgccctttatttatttctcttgtctgattactctggctcttttagttatttttaaaagtacaattaagttattattgacggtagtcaccctattgcgttatcaaatagtaggtcttattcattctttctacttagtttgctcttgtttttctggtttcttaaggtagaagtggaagtttatggtaattcatatgaaatctttcctcttttttaacgtaggcactttcagctacagatttcccctttaagaactattttaggccgggcgcggtggctcacgcctataatcccagcactctgggaggctgaggtaggcagattacttgaggtcaggagttcgagaccagcctgaccaacatggtgaaaccccatctctactaaacatacaaaattaaccagacatggtggcacatgcttataatcccagctacttgggaggctgaggcaggagaatcgcttgaacccgggaggtggaggttgcagtgagctgagttcgtgccattgcactccaccctgggcaataagagcaaaactccatctcaaaaaataaattaataaaaaatttaaaaaaacgactttagctagatcccataaattttggtatgtggtattttcatttttattcatctcaaagtattttctaatttctcttgtgatttttttccttgacagcctggttatttaagagtgttttggctgggcacggttgctcatgcctgtaatcccagcattttgggaggctgaggcaggcagatcacttgaggccaggattttgagaccagcctggccaacatggtgaaacctcatgtctaccaaaaatacaaaaattagctgggcgtggtggcaggtgtctgtaatcccagctacttgggaggctgaggcgggaggatcacttcagcccaggaggtgaaggttgcagtgagccaagattgcaccactacactccaacctaggtgacagagcaagaccctgtatcaaaaaaaaaaaaaagtgttttgtttgatttctacttgtgaatttcccagactcccttctgttactgatttctaatttaattatgttgtgctcagaaaatatattttgtatgattttattccttttaaatctagtaaggcttattttatatcctaacatacggtttattcacaacagtgttccatatgcacttaagaataatgtatattctgctgctgttaagtagatggttctatagatttcggttaggtctagtttgatttatagtattgttcaggtcctctgtttccttgttgatattctgcttagttgttttatccattattgaaagtggagtattggccgggtgcggtgggtcacgcctgtaatccctgcatttgggaggccagggcaggtggatcacttgaggtcaggagtttgagaccagcctggccaacatggtgaaaccccgcctctaccaaaaacacaaaaaattagtcgggcgtggtggcaggcgcctgtaatcctggctactcgggaggctgaggcaggagaatcacttgaacccaggaggcagaggctgcagtgagccgaggtcgcaccactggactctagcccaggcaacggagtgagactccgtctcaaaaaaaaaaaaaaagaaaagaaaagaaaagaaagaaagtagagtattgaagtctcctactactgttgttgaattgtgtatttttcccttcaattctgtcagttttttcttcctgtatttgggagttttgttgttaggtgccagtgctgtacttttgtcatagatgtaatctctagtgaaaggcaacactggcatattgactctgtcaaactggagtttgagtggcattttgaaggcttgttttccagcatcttgaccaccatgatgagttataagggtaatggctaaaaacatgggttttgaagtctttcagacctaggcggaaatccagtctaccacttggtctatgtaaccttaggtgagtcagtttctttatccttaaaatgtgaataatgataataactacctcattgggttgttatgaagaataagtaggatcatgtatattaggaccttagcctaagttagtgcttgtttgttatctgtctgtctgctgtccgagtatattctcacagataaaatggggaagagctccaaaaacagtgagagaaggtattcacagataaagcatttgctatagataattctcagatgcacacacctaccatcattaagagcggttgacgagagcatttgccatatgtatgtgtagcaggtagggctggccctgcatgaatgcagaaaagaataaaatttgaagaattataagaatgcttcccctgccctcctcccacatatgcacatcccagcatatctcccatatactttacacattcagaccccggaattctaatatagagccttattcttttaggatccctccatcaacaggcctctttgaaatgcaaactcttcggcattatatgtagcctgtttaacaggttctgactaaagcattagtaacttgtcagatttatttccttctgctagaagagattcaagataacaagaacaacagagcactggtggaaaagctctgaaaaggggtggggacaggggtaggaacagttccaagtgggacatacgtttacagctgactttcagatagagggtatccatgtaagagtccagctgtgcccagataccaggccctaaaccagggtgttcaccccgacccctaccataccccatgccttttcccatttcagaggtgatggggctattagcagctcaggttattagactctattcactctactttcagggtcagcagtaacatagctcatcaacttccctacctctaatctttggcagccaggtaatgctttgtcttgggacctgccacttgattgtgctacagagacatgggccagagacaacaagggagctcattcacaatccttggcaccagggctcatctgttgattctctttctgggtttagattacatgcacagcgcccaccgccctgtcactgggggccacctggggaaaaaggagagtagttatgtgggcagcgtgggcaccagccccaggaaatcgagccgctgcacgcccccacctgccgactctgagcttgtcagcttctgctacctccatatgcgggaacaaaggaaggagcaggaaagccggacagatgtcaacgagaacctaatcttctttgaggagaccaggccccgaaccaagtctgaccccacatccaaaagctctggccaaggttatgaggtagtccctgatgactttgatgcagctagcctagaccacgagccttgtgccagcagggcccggtcctacaccttggacaattcccttggggctgaagccctgaatttctactgtgactcttgcaaagccaaacttcaggagcagctgggccctcgcaaaggtgggaagcctggctcctctcgtgacaatatagtagatttgatgtccctcccaccacctgggagtgaggaggaggaggaggaggaagatgagacaacttctctgttgccagccattgctgccccaccccctggtttccgagacaacagctctgatgaggatgaccccaagcgccgggctgtccagagccaggaacaaggacgccacctgcgtgggcttctgtacgatgagattccagtgacattgattgacagtgtgcagacccggacagttcgagatcatgcccaggagctagatgatgccctggtgtccactctgcaggctctagaagccctggctgcatccgaggatggaccacacccaccacccccacagactgcaggtaatgaccgattccttctccctctttccacccccttctcttgtccaacaagggccagtaggtaacattgtgtcttcccaaataggtgtcagagtcactgaggtatgtcagggcagtggatgtaccaaaggttctttagatagggtcagaggagcaatgatgttacagcagggagcagctgctcagctctagctagagttctggctctcgtcattgcatctctttggaaatgccttacagatagatcccagggattggggtcatgacagctatggatgcaggccaggatagaggatcagagaaaaactgtgagagatgtagaagacaggtgaagaacagaacatccagcatgcacatgattgaaagaaaaggaaaacgaccaactcactacctagtgacctgggaccaggggagccaagggccatcactgctcatggctgaggtctttatcctgcctaagaacatgggctctgaatcagatgcaccgaagtcctggtttcttcaatcattgtcagtgtaacctttggcaaggcacttactctctctgaacctcattccatcatcttaaatgggttttataaaagtagttctatcacatggggttgtcacaaggattgaatgagatcattcatgcaaagcatgtaagcactgcctagcacacagtaaggcctcagtaagtggtagctattgtaactaagtattagttcacaggaaaaccgtacaacatgcatgctgttccctgttataaacacatgtatgtccatcttgtagacaaacacatgtcagacacatacccatagtcacacatatgtccctccatatacatacaccttaaaaaaagagaagagagctgggcgtggtggctcacacctgtaatcccagcacttttggaggccgaggtgggcagattacttgaggtcaggagttcgagatcagcctggccaacatggtgaaaacctgtctctactaaaaatacaaaaattaactgggtgggctggtgcacacctgtagtctcagctactcaggaggctgaggcaggagaatcgcttgaacctgagaggcagaggtcgcagtgagccgatactgcaccactgcactccagcctgggtgacagagtgagactctaaaaaaaaaaaagaagaaaaaagaaagagaagaggtaaatgacacagcaacagaaaaggaatagggaggaatagggaccacgagggattggggtcagagagagcctgccttttccatgtgtgaggacacccttgacattggacaacccccatgtatttggcccccagggctggcatttctctttgcttagagtctggagagagtgctagttgctcccaggcttgagtcccacgtggctgctggagagaggacaagctcagctaaatggcctcagctgcaatgactgtaggcgggcctggccagatgaggagggatagagagagacctctctttgccagcccctctttaggacaattaacaaaaatttcctagctgttgaatctaaaaatagttgtgattagcatgctgttttgcatgtgattcacatggtaatttgccataaaactgcccagatcctctcgccacctcttttgtttctgttttggattccggcctttcatccccttcttatagcttgcccctctttgtcccctcccctccactcttcccaccctcagccctgcattctcgccaggcctgtctgtttttctccagctggaaatactgctggctaaccttggcttctatgcacttcctatatagtcagccctctgtatctgagggttctgcatccactgattcaaccaaccgcagatcaaaaatatttgaaaaaaagaaatatgtctatactgaacatgtacagatttttcttgtcattattccctaaacaacacagtataacaactatttacatagcatttacattgtgtgaggtattataagtaatctagagaggctttaaagtacatggaaagatgtacataggttacatgcaaatactatgccatttcgtatcagggacttgagcatctgcaagttttggaatcttcaggagtcctagagccaatcgcccatgaataccgagggacaaccgtgtagagctggaaaagaacttgatttcagtaagcataacaagccctatccctgttcctccaggtctgattgtgctggccacaatcactcctgaatcatcgctggactcaggtcatgaaaccaactcttcagagctcacagacatgtcagagatgatgtcggccatgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtag

SEQ ID NO: 3558 - DNA, 80923 bp, human; identical to SEQ ID NO: 3557

SEQ ID NO: 3559 - DNA, 78605 bp, human
gacaagtgaccgttcaccgagaccctatatatggctttggcttcgtggctggcagtgagaggcctgtggtggttcgatctgtgaggccaggtaggtgtccctcagagtgttcccctagccctgactcctgtctcccaacacccacatatcttcccaaaaagcagagcttccaagcattctaactgtcttgctgaagaattcatgaagactggttgaagacttgccaaccaataactgtgtgagggagctggccttttaagactgatagacacaacaattgaggctgtttggggccctagaaaaaggctgcagttgattgtttaacagtgtctgggtcttaataaagcttccctttgcatagaacattcataaaagaaccataatgtcttgcaaaaaaaaaatgtacctattctatttaattcaacaagtatctatagattgcctactctaagcccagcaatgttgtcgggaagtacaagacacagttcctgttctcaagaacctaaccatcaggctgtggagacatgtatatactcatgaaacaggtcagccattgaagaccagaatcaagatacagaccacaggtgggataggagaggagaggataatggaatctctgaatgcttgagtggcagtaacaaacatctaccattgattaagcatctacaatgtgctttacatcatattgtttaattctcacagccacccctgcaaagtaaataagtaatatcattcccattttgcaaacgaggaaactgaggcataatgaaagagaagtggcttgtccagtgtcactcagctataaagcaacagagccagggtttgcacctgggcctgtttgatgccatgcaggggaagtagggcctgaaagggaccatgtgggatggaacaagcaaagccccacctaagctatgaagccctgctatcatgaatgaaatggaaaaagactgaagtactgttttgtttcgaatctgctaggcattgacaaaaaagacagacggaatggagctttattcctgacttgctgggcctgaggctttagatgtttacaacagtttctcgctcagtcaagaggagcagccagagtacaaactggtcttgcagaaatttgatgaattttgcaatcctccaagggaaagaaaaagatttttgtaagctctctcttcaactagagggcacagaggaaaaaaaacacacacacacacaacaacaacaatttagtacaggagtccgtggctgacctaaggctctggagtcagccatgcagtttggcaaaaaggttttgaatctctgatcagaaatcagaggaaagggggaccagctaacattcagtaatagaccaccaggagcccctactttaacttcaaatgagacagaatctgcacagctgaaggaagcccccaggcctagaggggttcagctgccaaaggtataacaatgaagaaggagttggaggggtcaagagaagaaaatccccaggcacgaaccacaaaaagccatggggctggcatgcatagccctataaaagccctataaaaagctgatccgtagtgctgcttctggcccaggtggctcctgaatgcacaggacttgtttggttctttatttgaggccgtaataaagacaaaaaaagtgtcctacagaggagcaattatggttgatcaagccaacaaaccatttgtgaaagcagtagtagactgatgttaccggtaccatcaaagggccaaggcccataaaggaggttgagttccatgaggacctcttctgttagacggaagaaagggaggggagggaagggaagaagaagatagatagagtggcctccacctaagagactgacatttttggcagaagtagatagaaggaatgaaatgagttgaaggaattgtcccttggatggtataataactaccatttatccaattcttagcaatgtcaatcagctgttttaagtgctgtatatttatcatctcattcatcctcccaacatttctatgatgcatatgtactgttattttcccattttatagatgaggtaagagagactcagagagattaaatgtcttgcccaaggtcacacaaccagtgaattgcagatttggagttagagtccaagtctgtctggctgtaaagagtgttctgttagccaccacactttgctcctgaagccagtgcactgtcaggagacttggcctagtgtgtttagggcaattgctcctcgagcaatgaatcctgctgcctgtgctggcacagccatcctcagcacataggctctacactccagagccattgagctgtgctcaagtgatgtatttgttgtgtatgttcatgtttttggaatttgggcagcccccttctttggagagagagggagaagttgggatctggcccttcaaagtggacacaaactagagtcaaggctggtttgatactgggtaatgtcagtgaacatttctttcaaatttgagtcaggctggttctgacttctcattctctccaagtctctgagaagcttttctccaagaagatctttgctaaacatcagaagcagcatagccttgtggtatccctctaccctcaccctttgccccaaccaagaaggtacagccctcagataggtctgctttcttaaccttgcagtagaaatgggaaggagagccaggcacagtagctcacgtctgtaatcccagcattttgggaggctgaggtgggtgaatcacctgaggtcaagagttcaagaccactctgggcaacatgatgatgttccatctctactaaaaatacaaaaattagctgggcatggtggagtgtacctgtcatcccagctactcaggaggctgaggtgggagaatctgttgaacctgggaggggcaagttacagtgagccgagatcacgccactgcactccagcctgggtgacagagtaagactccatctcaaaaaaataaaaaaagaaaagaaaagaaatgggagggagaaaaaacaaatatccaactgcccaaaagtatgtgctttgttcccctcatttattggacagtggcatttctcagtgtagaaaaaaaaataaccctttaggtctttttcctctgtcttcagacaagtgaatgcctaagtccttccagactagtaagtatgaataatattcaagtaagaagatccttcctcgtcctcctttcgcctgaccacctccagtagtctggaagtcattccttgtacctaagcaagtcccgcctgtgaaatggaagtctgcgttcctcattaagaagcaagccagtaaaatgtttattgaccttatctgagtttggtaccttttgctaccaaaccatacccagctaaagtgttttcaccccacttatctttctggggctcccaaaagcccacctggttctagagtacctcccttgccttcaaaggcagacttagcattctgtgtttggaacagcatcctctaactagctctggagggctttggaatgctcgcttctgaagtccagagcatgtctttcttggcatggaactaaaggaggtccactccattctctgtcttcattcctctgccctctatctgcttataggcagcagcagcggcagcaacagcagcagagagctcgaatagcaccctctacaccaccacagctcagcctgcaccatctccaggcctcagcacctgcttcagctcctacaggcacaggggacttgcccagacctggactttcccagcagtaaccctaagccctcacacctctctcctctcctttgcaggaggcccctctgagaacaagctcctggctggtgaccagattgtggctattaatgaggaagacgtgagtgaagccccgagggagagactcatagaacttatcaggtaacaggggccttttggcaggaactgatcagtatccccacccctgactcaccagtgacatggggccaccactatccccccctcgctctgagagcagaatccttccaggcagagaagccctatagagggctcctggctaacccagaacttcaggggccagctattcagggtcagcaggagccttcatacacactggcttagcatctccaatgatgtgaacagacgcaaagaactccctgctggagtctcacccctacctccttccacccaaacaatctcttcaccccagcccctttgtttttttccagcgggacagaccaagtgacagatgagaatcaagccattaaaagaacatcctagatatgcacagtgcaagcaagatattgaccaactccccaactccagaaaaaactcagaatccctggccaatgggttgaggaagagaacctcccaatgtggatactgtccatagtgtttgtgtcccctaaatgccctccgcagatgggagcagatgacaaaaggaacattgtgggattaccactgtttgtacatggagagtaatcacattgtctttacctatcctttacccctgtgcacattacacacacacacacacacacacacacacacacacaccatacacactctcctaccccacattcacaccacatacacacaccctggcatagatttgttgaaaaggaattagagaataagaggtaaaggctccaaattgcatgggctaacctcagtttgggggagcttggctatctcactccaaatggaaccatgtacatgctcgctctttctctcactctccttttctctctccctctctctctctctctctctctctcctcctctctctcacccccttgcttagtctgacttcatctctgccaccatctccttcaagtcctcctggttcagagtgttttcatcccactcatctttccaggctcccaaaagcccacctggtcccagagctcttcccttgccttcaaaggcagacatagcattctgtgtatggaacagcaccctctaactagctctggagggctttggaatgttccctcctgaagtccagagcatgtcttccttggcatgctccttccagctcaataccatgaaatgtgtctgatccctaatgaccttttctttgactcttctccaagttcagttgtctattgcatttccctaccctccaccctccaccctctgctaccacaccaatatgaggtgagttctttctatcctattagggcatgttgggtttttttcagcctggtccctcagaagtcactgctttgtttttagtagatttctttgccctctagaacaaggtatgctgatttcgtgaggggttccagagctccttcagggttaaagcagagcacactcttgataaccttgggagccagtggattattcattcattcattcagtcagtcagtcaatcaaccagtatttattgttgtcctcgatgcaccaggcactgttccacacaccgaagatacagcagtgaataagacagacaaagatccctggctcactggagtttacattttagtgaaaggagacacatcataagcagaaaagattataagtagttctacaacatattagaagctgataaatgttattaagaatagaaagtagatctaggtaaagaggatcaggagtgctgggcacaggggtgcaaaatgcaactaaacagtagggtcaatgttggcctcattgaaaaggtgacatttgaagaaagacttgaaggaggagaaggtgttggacagagaacagccagtgcaaaggccctaaggccaggagtgtgtttggcacgattgtggaacaggggagaagccagtaggactggagttggtaaggaaagaggagagttgtagaaaataagtccagataatggagaacctttgaagccaccatagggactgtggctttgttataaatgaaatggggagacatggcaaggggctggaggagacgagtcacataatccaacttatgttatgccccttccctgttcaagataaaggattttctttagtatttttcctggagaataactctttacttctggtaacttcccaaaccctggggctgattaatccctgtaatttgcctcaccaaatgtgggagatgttcaaagttcttgagctgcgggccttggcatttcttgaatatccagaatcaagggcagcttgactctacttcttaaatgactttgttcacataaacatttgaaaagggccaataaggagaggggaagctccttcagggcaaactatttccatttcttttagttcttttaaaagattatgtattcctgggagagaattttcatacttcacagcctgtttgatcactggcataattcttgccagaagagtttcatattcttcattcttttgaatatttgctatctggagagttttggcttccatctgttgctccctggctctcttttttggtccctcaattaaaacaaatctgatgagtatgagtcatggtgaccaaatgacctcctttgggtttttcctttgaatttctcttctcacttaaataccaaattaccaataatcattgtacgtggttcccaggactctctgattttgagttccataatgcaggcttttagttttccttgagaattttgtagtctacagataaaattgctactaaggtttggagatttctacagagagtatgtgagaaggaatatgaaaagaagacctaaaaaatgacaaccccagaggtaatgattataccatcttcggatacctgtgtgaattaatatggatggtttgtgtcagcctccacaaatgatgggaggtgaagtgtccatgcagacactcagattgccctctatcctaatccatatacctgaataaagccaggggaagattctggtgttgcttcttgtactagatgaatacctagtgcatgatacactactctcctattccctcttttctctgtaggagcgctaaggaattcatcgttcttacagttctgcacactcatcaggtgagtgagcctctttgccatctgcccttcctcctgactgagaagagatgacatttccatattggaaagcaacagtgatggggttgggggttcagagactacaaccaacatatgagccaaggatttaggagtgaacttaaagaataccttctgaacagcatgtctctgctcatgtccaaagctgaggactttgaagggctgtgctgtgctgtgttctgtcctgtgccttcttctttacccacttaagctgcccactgcctcaattccaaatacagtttccacttctttttggctgtactccattaaaatgtatctgtccaatgtgaactctcataaagtcctggacgatgataggtgccaatcttattcattcatataagttacctacaatgtatgagacacagcaccatatgtgagagaatttaatataaatttgctggggggtacccttggacaaacagattcatttttgtcctggtacagtcacttaactggctgtgtgaccttgaatgagtcagttccccattctggacctgtttcatcatctgtacattgagagatttaaagtataacagtgttacctaaacatgcctgatcataatcgttgccaggactacttattaaaagtaaaaatttctagccccctctcctcaagagttggatttagaaagttcagtgtccattattagttgtacccttatagcaatcttaacttaaatgcacaaacccaggtgcacaacttccatgtgcaaaattcagagccctcactctacctccagcctacctgtccccttattaatgtccccaacaacagtcctctgcaccccagcatggatgccataccctcaatatatagccacaggagagatcacatctgttgggggtgagggacatgaaatcagggaaggcttcaaggaggaggctgcacctgagctggaccttgagggatggggcaagattttccatagagagatgacacagcgagggatggaacacaggtgcacagcatgggctcaccaggcaagagcaagattcaaatcaatcttggttcaaactaactgcctctccccatggcccccagctcccagacctcttctgcatcagtgtgaacttcactcacacactcatacactcacacacatatacaaacacactgacacacacacacaatacactcacacattcattcacaacctcatgcataatagactcacacatatcctcacacgtacactcacacacatacactcacccactcatacccatacatatacacacactactcacatatacacgcactcatgtgctctctcacatatgtacacacaatggtcccaggcagataggcctttctcagttccagttctcttgtctctgggcaggcaagccccaccactccattgttgttaccaatagtcccctccccaccactttgctgcatgtgtgcagttgcctagtgggcagtaggcagtcagtcccaacctcccaacctcctgtcttgaaaatgaccaccagttctcccactaaaacatgcttgatgtgtggttagaatttactactgcgatcagagacccaatgtgggtttactttgttagtcagttcttctcaaatctcaccttgcagaagccttccttgagtaccctttctaaaatagcatctaccttcactatcttctgatatggcttactttttcatcagagctgaaatattatattttttaacttttcttttgaaataattgtagatcacaagaagttgcaacgatagtacagagatataccatgtactgttaccctgtttctcccagtggttatatcttacataactatgtgcaataggctgggtgcagtggctcacacctgtaatcccagcactttgggaggccgaggcaggttgatcacttgaggccaggagttcgagaccagcctggccaacatggtgaaatcctgtccctacacaaaatacaaaaaaaattaggctgggatggtggaacgcacctgtagtcccagctacaaaggaggctaaggcacgagaatcatttgaacctgggaggcagaggttgcagtgagctgagattgcaccactgcactccagcctgggtgacagagcgagactccatctcaaaaaaaaaaaaaaaaaaggcaaaacagaacaaaaactatgtgcaatagcaaaaccaggaaatcaacaatgacacaacgtatgtatatgattcaatatgaatttatcacatgtgggtttatgtctccaccaacacagtaaagataccccatttaccataatattgttattatacgttgcatgcctgtgtcaaagtatcttatgtgccctagacatacatatatctactatgtactcacaaaaatttaaaacttaaaaaaatcactggacaagtctgtcacccaaaggattcctcgtgttgtccttttataaccacactcacttcaccgcctacacccaatccctgtcaaccactttacatttccctaattttatttcaaaaatattatataaatggaagcaaggcactgtggctcctgtctggaatttcagctacttaggaggctgagatgggaggatcacttgaggtcaggaatttgagatcagcctgaacaacatagaatgagacctcgtctctaaaaattttctttttaatttagctaggtgtggtagggcacacctgtagtcccagctacttgagaggctgaggcaggaggattgcttgagcccaggtgttggagactgctttgagctatgatagcaccactgtactccagcctgggcaatagagcgaggccacttctctaaaaaacaagcaaaaataatatataaatataattatataatatgtaacctttggggattgactttcttcacttagcaaaatgtcctcttagcaaaatgtcctcgagattcatccaacttgttgcatgtatcaatattttgttccgttttattgctgagtagtacccatggtattccatggtgtggatgtaccagtttgtttaatcatgtacccgttgaagggcattgggttgtttccagttttgaactactacaaataaagctgctataatatttgtgtacaggatttttgtgggcataagttttcatttctctgagataaatgcccaagagtacgattgctggatcaaatagtaagtgtatatttagcctattaaaaaactgccagactgtttttcaaagtggcggtgccattttacattcccatgagatattatatttacatgtttattgtctctgtccctcattagaatgtcagctccatgagggtagagactgtgttttgttactgctgtatccccagcacctggcacagagtaggtgctaataaatattggttgacggaaggaaggaaacccagtttctagccaacaaagcaacctaaacaaaactcaagtgtccaaacttaggtgcagaataaagggcgtaacactcaccccaatctctatctcgactttcccatcccagtgcctccaacattttcttaccccctgttctgcttactctgcaggtcccaacccatggcccctttgctgcggccaggctgatttccttctccttcttaggtacatttccttcttaggtcttactgccccgtggacttttgtccttttgctattccacatctcttctaatacatgtctgtttcttttaagaccttgtttgatactcatgttctccaaacagctttgcctgactaatctcaatgagcatttccctaattttttcattcactcatcaagcatttattaaatacctactattctggacactcttctaggctgggaatatagcagtgcacaggacaaacatagtccctgccctcacagagcttacattctagttctcagtcttgtgctctctaaatccttggagcatagaagtggacgagtacacacacacggggctaattgtcaaaacatttaatgacctgtacagtaggagccaatccagtcaaaatataagccagtaataacaccggagcagaatcttgaaggcctcctagttgtgccagatgttaaccctgtagttgatctacgtttgtaaggaggtccagggggagaggtcaggtggcatccaggaagcatagggcagtgcctatttaccaatcagtgtgaaagaatctctctgtattttacaactggtatggccatcccagtgcatgccaattgaatgtcagccttacctacatgtgcagtcgatcctcattatttgcagattccctatttgcaaatttgcctactcccaaaaatttatttataacccccaaaatcaataatcacggcactttcctggtcatttgcagacatgtgcagagtgtgaaaattttgatttaccccatgcacacgttcccagccgaggtcggacaaggtgatgctctgccttcttgtgtcagatctcatacagaggtaatcagaggatgaagacgatagggggcagtgcagtgtagtgcaagaaagaaactgcagttctggggccagttggacggggtttgaatcttgactctggcacctgtgagtggagtggcctcaggcaagtcacttaacacttttgaacttcattttctctttgtaaaataaagaacatagaagctactaggatgagttgtttttacattttaacaccataatttatgtgaaatattggagcaacagttcagtattcactaattcagtgtttatggaaatgtcatagaacgtaaccaccttaacaagtctccattgacagatcttctctctttagctatactgaaagcttcttgaagacccccaatatgtgtttaatgttataccccctacatcacagaaaatactactgtgttcacagcaggcacttggcatctcatgggtgcaaggagactgctacctattacagaactcttgtcatgttaaagtttgattaccactacttccagaagacaacctcctaataggtccaggatgtggcctaggaatctatatttgttaaaaaaaaaaaaaaaaaaaaaaaaaccactggaccagacaatctgcaagtctccttctattaatagctcctacattatgtggctgataatggcctaatacctactcctacatactgtggctggtaattttattttatatatatagagtctcactctattatccagtctggagtgcagtggtgccatctcagctcactgcaacctttacctcctgggttcaagtgactctcctgcctcagcccccgaggagctggaattacaggcatgtgccactacaccggctaatttttgcatttttagtagagacgatgtttcgccatgttggccaggctggtctcgaatccctgacctcaagtaatctgcccgccttggcctcccaaagtactgggattacaggcgtgagccaccacacctggcctggtaatggttcttgaccctgtttatccattataaccatctgagaagctctgaaaactattaatagtcacttctgattcattcgagcagcagagacagaaaaaaaaaaagaaaacatgaaaatattgatacttgggctcttgccctgactcattgaattagaagctctggagatgaggccctggtattggtcttttgaaaaggctcaccaaatgattctgatatggagtctctctcagatgacattttccttgtaagagtgactcatagcatggcagacaattggggagaggggtcacaggagttctttcccagggcccctcaaaccatactgcatagatagccacttaataagcttctgtgtacttaagggtattccttaatctttgaattaccaactagtcctcatgactgactggatatttattaatcttgaaatctttagaccttggcacacagtaggcactcagtaaatatttttaaacggataaagtaccggattatgaccaagaatgaccctgataaagcaagtacagacaatctgtttcaaatgaaacccagttttctggttctgaaaacagcctgtacttaaagaactggaatcccttctgcttggagccacctgcccagaaaaagaaagccaaaataatgggaaccacctcagagaaactggttttctacagagcttcctgacgtatagtgtttgtcagatggtagatactccaaccatatatgctgaattaatgaactaattcattactaattttagcaatcaactaatatattttatgccatgtctactatgtgcttggtactagggggagacatattaacataaaatggcatctctgcttatacagcctggttggggatgtgagcaatggcagtgtggattaacaggagtactataggaaatccaagaaggggaattgaggagttggggaaggattgaggataaaggtagagtttgaactaagctgtaaagtgatggcatttagctagtcaaagggacactctagaccctgaaggatggggacagggaggaaacagcgtgaggtgggtccaggaatgataacaagcccagtgtgtgcagggagctgtggatagaactaccaagtgcagcaaaaggtgatcttggagagaggtggttagagagtcaggtgtagtttgtggcgggctttggaagtcaggcagaggatatgttcatgtccaggcagtcttgagtgtgggaaggaaggccccctggttcccctagtagtgatctggtgaaaccaggatggtcctccattgtcctaggctcccacagtggttgctataggaattggttataagtaggctcaggtgtcaaaggcagtgtagccagaagggcaaatcagtcaaagcttcaagaagctgagtttcgttttttttcagttaccaaagcggggccctatcttgttctaaaatatttggccctatatctgactttggtcaagatttgagtgatcacaaccctgacatctgtactaatacagacaacaaatttaaaaaatggtcaaaaaataaccagctgctgaattctgcactgagggaaaggcagactctcttctattccttattccaccaagctgctggcttcatatttgcttcaagcagcttgcagtggccccagaggtacttagcaattctagtcccatgtttcaagccaaaattcattttagccagaaagggtgcctgttgcaaagtgagattcccagctgcttggagaaaaaaatagggtcagtgaagagctcaaacattccagccttaaggtgctcaattaatctatgcttaatggattgggatctcttcaacaatgtcaatttctgggccccactcttccagagattctaacttttaaaatctggtgtgagcctaggcatctgtgctttaacaagcactcctcagtgattcttatcatcaggcacgttttaaaaacagctggttagtgcatggttatgaattagtgcagaggttggcaaactgtttctctgaagggccatataataagtattttaggctttgcaggccatatgtggtagcacaaaagcagccataggcaatacataaatgaagatcacggctgtgttccagtaaagctttatttacaaaaacaggtggtgagcaagatttggcctatgtaggcctgtaatttgctggcccctgaagtgtattatgccttcctgctaccgcattcacattttgacccgggccttcccaattctcaacattgtaattcaaaggagtgcccctaatattacgaacttcaagccccagagctgagctttgaagatgctttgggacacggaggcctctgagaggctcctcatatcacactgcaaagcaggcctcacctgtgtctgagcataaggctagatgtgactccatgacatctagcacagaccagctggcaatgaatgagtcaccagcatcaaggctgaagactgagaataggatggaatcttagagaccaacaggacaagggtcaatgaggactgaagtataaacaagctgaaaataactctgaaacagacacctggaaatgattataatccctgaaaatattggcaatttcatttcctcctttgtggtttgtgcctataattaactgaatctttggttttcagtggtacaaacagaaactctctaggacaggatctaatcttgcatctttggtagggatagcaaggatgccaccctcttcactgtggtgaatacataaaaggataccagttggggttcttcatttgtttgagtccattacataacaccaaggtagaaccagaaccagtggatgaaagatcaggaaaggactcccagctttagcctgctgtgggggaacaaccactaagcaaaggctcaggaaacctgggttctggtttcggctctgctactcaattatttcaatactttgggtaaagtatatcctcttcccaggcttctgtttcacatgtgaaaaatgaaggttgagctgcatggcccattcaggtctctagagatgcctcgttctacacactgtgccatgcaggcatctgagggcagatgatggcagagaagagaggtgactgtcaggtagaaagattccacttgcctcatgtttgtggcaccttggtggaactttggatgactgtggagatggaatcaaacacagctgcctgagcatagctacagatctttctatcttgcccctttctcttgcttctgcctcagcctgcagcccctgctcaggattggagcaccaggctgtgcaacacacaaaggcatttatcaactccatgtataatcaatactgtaatcactttctgcagtgatctccagctctggatttcattgtgctatattgtctgctgccaacaaattgcccctttggctcaggatgagaagtctaaggttcctttagctcaatggttcttaatcttggctgcatttggaaatcatcagaagcttgaaaaaaatactgatgctcagacctcacccccaggaattctgatgtaattggtctgtggtgggccctgggcttcaggatttttaaaagctcctcccagcatttctactatgcagccaggactgacactcactgcctgagttcctgctggactcaggtgaaagaagtggttttttgcaatctcccctctgtgggaatgagattgctggctctgacagagccagctgggaccagggcccaagacacaatgaggacgtttgtttctgatgtgtatcttagggccctgccctcctgtggctgattgggtaaatgaatctcaactgcagtgtaaatggtagataatagcttaacgtattcccagctggcagggaccttcagggccttaacacaaagaaattcctgattgtaggactcaggctccatggcaaggcccataggggtggtggtttgaagtagccccaaacctgattcactccctagtcctcttcatctcagtaaatggcaagtccattctttcagttgaagtctctctttttctcactctcatatccaatcagtcaacatatcatcctaattcagtattcaaaatatatccagaattcattcacttttcaactccatcagtaccatcctagcccaagcctccattatgttttaaccatattattgcagttacaaatattgtacttagagacccccaactggtctccatgctcttgccattgcccttctacactctgttttccacacagcaaccagaggcttccttttaaaatgcacatcagactctgttcaatcaaatccctctagtggagtgaaatccaaagttctcaccgtggtttacaaggtcctacatgacccagcccccagctgcctctctgagcatctcccctcttgctccccctccatcacgccactccagccaccttggccttccttgctgttcttcatacacctcaattcacttcagggcctttactgtagtttctgcccagaagcctttctccagataacctggtggctgtctctccctcacttccttaagtttctgcttaatgtctcatcctcagagaggtcttccctgaccatcctgtctaaaataacctcccccagtggccgggcgccgtggctcatacctgtatcccagcactttgggaggccgaagtgggtggatcacttgaggtcagtagttcgagaccagcctggccaacatggtgaaaccccgtctctaccaaaaatacaaaaattagctgggcatggtgatgcctgcctgtaatcccagctactcgggagactgaggcaggggaatcacttgaaccgcggagacagaggttgcagtgagccgagatcgcaccactgcactctagcctgggcgacagagcaagactccttctcagaaaaaaaaaaaaaaaaaattaaaaatataacccgcacaatcctacttgtggatatatatccaagggaattgaaattagtatgccaaagagccatctgcattcccatgttcgtggcagcactattcaccatagccaagatagggaaacaacctaagtgtctgccatcaacagatgaatggatgaagaaaatgtggtataaatacacagtggaatactattcagtctttaagaagaagtaaatcctgtcatttgctacaacatggatgaacttggaagacattatcctaagtgaaataataataataattattataagccagacacagaaagacaaataccacatgatctcacttacatgcggaatctaaaaaagtcaaaatcatagaagtggagcatagaatggtgatcactagaggctaaggttgggagggagtggggagatgctgttcaaaggatacaaaggctcagttagacaggaggaataagtttttgagatctattgcacagcatgatgactatagttaataataatgtattatgtatttcaaaattgctaaaataataccctcactactcccactctaactcactcattctcttgtgtagtcctttaccctgccttatttttcctcaaagtccttctttgctacctaaaagatatttatcgtctgtctattcctgctggaatggatgctccatgaggccagggagttttgtctgtcttattcactgctctatccctcatcacctagaacagtgtgtggcatgtagtaggcccttgctaaatttgtcaaaagaatgaataaacgcccccccaaagacaatgaggatgcccctcagcacgactcctgtattcctaattgctgggccttacagagctcagcagggagctagaatccaaggggcacccaggaaaggcttagtttccagtgtttgctaatcatgcttctgataaaattgtgggagagttttcaagaactaaaaagccagccaggcatggtggcctgtaagcccagtactttgggaggctgaggcaggtggatcacctaaggtcaggagttcaagaccagcctggccaacatggtgagaccccatctctactaaaaatacaaaattagctgggtgtggtggcacatgactgtaatcccagctactcaggaggcaaggctggagaatcgcttgaacccagggagcggaggttgcagtgagccgagattgcaccattgcactccagcctaggcgacaagagtgaaactccgtctaaaaataaataaataaatacaagcctggctgattttttgggcatttcttacagaattggataaacaaagtggtgcagagcccaaaactagaaagccagaagacttgggttaaatctctcacatctctattccccaatagtgtagtaactgtggataaatccttttggagtgctaggtctcctttctcccacatctaaaatagtatttattatgcaactccttcctaggggcaggacatgtctgtgaggtgaacaagatcatttctgtaaattatttgggatgcttatattcagatataataataataataaaaagacaccctttaggtctatctcactgtaagaaaaccaaatatataaaaactcaatgtatgttattactaaagaacttttgcaaactcccctaggcctagagtattaataatggggttcaatctacccaaattcaattcatgcccagctgtttcagaacacaccaattacatagggaagcatttagcacattgccttgcaactaataggtaattaatatttgtttattgactccttgatcagtaatgcaaagtgtacctgtactgggacatcttaactctgacgtgacaaaggttaggctttccctagatatggagaactcaccatctctctgttctttttccagtcccccaaatctgctttcatcagtgctgcgaagaaggccaagttgaggtccaatcctgtgaaggttcgattttctgagcaggtggcagttggagaaacagatgcagtaagtgtagctttggctccctctcctcagcccctggccataatctgcctggctgtcaagctctcgctctggggcttcttatagtggacagctttccgaatgggttagagtgggagcgtccaggtgctggagggggaaaagtagtgagtgaagagggatacgtgacatccagagaggccccaggcattgtggggagaaggaatatatattgattcactcaagatccttctgatgcttagagaaatttccatccctaacacagtagcttacactcaaagcaagtgctccataaacatcttttgctacttgatagaaacaggaaggaaataatggcttcctgaagactcagggaatgagtggctggtgaaattgagctctcttcacatttaagtgatcttgcaactccacatcttgaccagaaaaggccatgcagtggtgagtaaagttgcctaaaggaaatgatacagactctcattaagtcaccaagtttttattaggcacctgctatgttcttagcaccagaggggaggcaaaataaatacctgttccctgctaccagatacctctcagcaatgttgagggggacaagaggttcagattgagacaatacaaaatctactacggggtggtattgtttcgaaagacaggtaatatttgacagcccatgccatgcagctgccaatttggggagtcttggccagccacagtgtttctcactgctttgggaggtttacatgcagtgaactgtcggctccagatgtgcaaatgagaagaggcaggtgaagagcagaaaagaagtgtgttaagcagtcatgcattctggccgagtccttcaggaatctgcagaagttagtgataacctggtggggacagaggggatagctagagctaacaggcacttgtgtgcttttgatagctgtgatgggcagagctgtctggaggcccttggcatttacgtactgaggaacagccacagttgttgggagaagatagcaggcccagagcagggaaatcagcagggtgccaggcgcttctatattatttaaggcagaattagtgagaagaaggtatagaggacacaggtgtcttccatctccatttccctgactctcattcccaaactcagtctatgccctcctccatctctgcatgaggaaggctggcaaacccaggggactacaggaccccactgggcaagctgtctgaataattgatggttgggatctgtgtcaatcctagaagaaaagttttaagagaagtgatcattgatgagcagaggggaaaaggagtaatatggagtccctgcaaatcagggtgaaacagaccccgaggtccaagtcaccaggaggatatgtgtgtcctgaatgcttgaaaacccagaggacgtatgacttggatttggtaagtatgaacaggcttatcctatgccatctcaacattgcagagtaatcagtcaagggcaggccacccagtgaagaactccttcccttcctccccactcccctcccctctcttctcttcctctcccttctacttccccttctccactttctccttcttccaccatgattcccctctccatacgtcacagctaggttacaggcacagctagtctacaggcgtaacgatgccccccactccagtctattctgaatgcaaatgccacagagtagctaggacccacctagagtgacctcattctctcggacaggccaccaggcatagtgtgaggctcttgtctgggtgagagacagacatcaatcttccaactctcactgcactcgtgaaattacctggtgttacaacatcaccctcctccatgctgccgccagtatggaccatagcagcctcatcacaggtcgggagccgggggagtccaggcccaagtgactccaggctctcctatcaaccctttcctttcgtgttccaaggctttattaagcagccagagcaaaaataaatcctgtgggtgatccttgccagctctatttttaagcaaattcaattaagtaattatctgagtccaacccagtgtgctaaataaaacctgccaccactgggatccggggccgctgggcctggcaggagcaaggcatctcaagatcagggaggggaccagggagtcacactcttccaattttatatcccaccacttcccaccttgtttccacagccaagcttgtctcttggctcctcaccaccatcaaccataccccaacccaggaggatttgcttgttcctctttccatgctttgtccatgatccatgacagtctctaggtctagactgttctcatctggcttctcaaatcatccacacccactgtctccttcaaaatcaaaatccaatttgccttatctaggaaactttagccatcttatacctgttggtttgctttggttttataatgtgtatgtgtgccaagtcactacaacaagaatttaagactggatttaaatctcctgtagctctcatagagacttagcatagtgttgggcatacagtagaggttcaatgaatgcccagtgaattaaggaatctggttatctctgcagcttttccattcctatagaactgatgatgatgttggcccagggaaatggttgggatgagagtgatcattcagtaagtgcacatcaagcacctactgcccattcattcagcagccatttattgcgcaccaaatgtgtgccaggaactttgtttagtgttgggactacaaagataaataggacatggtctttgtgctctcatttcaccatttgattgtgaaagacaaatatccttcaaaaatatgataaaggtgagtttcggcagcatagtgagaccctgtctctacaaaaagtaaaaaatttagctaggtgtagtggcacatgcctgtagtcgtagctatttgggaggctgaggtagaaggatcacttgagcccaggagtttgaggctgcagtgagctgtgattgcaccactgcactccagcctaggcaatagagcgagaccctgtctcaaaaagaaatcaaaacaaaacaaaatacggtaagagcattgtgagaagcgtgcataaattgctataggaatgcatggaaagaccaggtccaagtatctgatgatattagaccaaggctttacagaatacatatttgagctgggttttgaaggataaataggagtttgccaaagaggaaaagagaaaggcagagggaacagctttttttctttctttcttttagagtcctcagagaaagagaacagtctttatttaatgaatttttattaagaatgtctcaatcagagtcagtacctcccattgctagagagcttttgaaaatgtctgagggccaggcatggtgactctcgcctgtaatcccagctactactagagaggctgaggcaggaggatcacttgaactcaggaggcagaggttgcagcgagccgagatcacaccactgcactcccacctgggcgacagagcgagactctgtctcaaaaaaagaaaaagaaaaaaaaaagaaaatgtctgagggtgtttcaggtcatcccaatgctttggtgtgctactggcacttcatgtctcagggtcggagatgctaagtgttgtgcagggagggggacatccctgaataatgaagaatcatcagaggtatggaggtgtgaaagaggtgtgggtactaggaatagcaagacgtgactctggagactaggcaggggccaggtcagaaagggcctagggaggggaaaaggcagagcaaaggccttgacaggacgtgatcttggcttgtgaagggcctcagggaaagggaggtatcaggagataagatcagtctagaagctttgtagaaggtgtttaaaaaaatgtcagagataagatcaggtgggtgaggtagactccaaaggaggcctctcatcagcccttcagcgggtgtgtggtgatccctttgctctgatctgtggaggtttgaactacagtagaatgtgggtgctccgtgatgtcaaatggaggcgggcttttgatatggctcagtgtcttgttggggagtttggttctggtccccatgtattattgatctgctctttcctctgtctctgccctcctacacctttggctctctgtctccatcaccttttctctctcctttttcacacccttcctctggcttcctacttccttctaaatgagccggtctccttgtcctttccctgcttgttcacagaaaatgatgaagaaggaagctctcctcctcatccctaatgtcctgaaggttttcttagaaaatgggcagatcaagtcattcacatttgatggtcggaccactgttaaggtacatacagtctcctccccctggtcagcattgccctctccagagtacatgcagttgtgtgtcctgtgttcctctgagtctgcacatagctgcttgccactggagtaaggtggcctttaagctctggatgcttgttagcacaaggctgcaaaaatgcacagtcccagatgagagtggtggtagaagtttgcatgcccaactgtgtgctagtaattgttaaaccgtgtgtgtgcacttatacttgtgaactgctctgtgtttgcgttacatggggtccttcaggacttttaagaactaaagaatatgaagatcattaagccatttataaagcaaaagtgatttatattgataccataacacctacacaagtttatgcacagaaataaacacagtctcttgggagattagcttagttatggcttgctttttaaataacaacctgatctcaagcactgaaccaagatttgaaatgtccagccacagcctctttggctgttcttttcacaggaagagcaattactgagctgtgattcttcacagctcagccaggtgtcagaaagtcctagtgactttcctctaatccttaggaatagaagtgatgatatgattcacccccagattcaactctgctctgggacagaaatatccattcctgcatcttctggactctctccagaaagagaatgccatccccagaatgagtattttaatgcaactaatgccgcccaaactgctgggcagctacggtgtctacccagaaaacctaggttggtccacaggtaccctgtggttcccatactgggaccaaggcaatcctataagtaaagaaactcttggaccaacaaacgtttgctaagaggagttatcaggtactcagaatgggtcttgccagtgattttcaaccaggattcctacttcccactcttagagagcttttggaagtgtctaagggtgttttaggtcatcctaatgatttggtgtgctactggcattttgtgttttagggtcggagatgctaagtattctgcagggagtgggacagtccctgaatggagaatttttttgaaaggcttaggcctaggtgggtcccccaggggacctaggaccaaaacatactacttagggtgccatagaatgttcttttggctattgaagggggcatgggagggggcattgaaacagaactagaccacccaggaggtgtccaaatgtgccttctccagatgtgaatatcgctttgtgtcagaatcctccttggtggtttattcatgggttggtatgtccattgtggactctgtctccatactggagtgtttagtgccctctctttccctttggagtcttctctgaagttctcccacctcacatcatcagcgccattgtggcttccaggtagccccagccttccaagacagcagtgttcccctcgcttgtgatctcaatctgactccaggaagggtgtgctggcgacttattggagctttgacaggctgccaagccacttgtcccagagaggtacctgggtgaattgacagcctggcacaggggctgttacacttgtaacaccagttggcaatcgccggattggctgtccacaatcccagtgcagccaaactgcaaagaaaacctcatctgtccctgacagagctccagcaacactggcgcctctgtgactacttggacaacacaagagatgctctgaagtacccaccaatttccagcttaacatttgaataactgaacgtctttcagtgttcattgaggggcttgtttggcaactgcggttgtaaagatgttttatattcccaagcttgattctttccagcctttgggggctgagagatgctgactccatgaacacacacattggagcccagtgtataagccaaagtcacagcaaatcagtggcagaagtctcagaactgacatttgtgcagccccttctgaaatgttttcagacaccctaatattaaaagtagggcagcagagcagatggaacccagaagtagtcagatttatgactgtacacaaaacacatgacatagttcctctgcatggatacatttttcgagttgctaaattgatcatctataaaatccagttatggtcaaaaatgaacattttgccagtaactcaagtcatttgatttaaattatgaatccagaaatagtatgctttttaatcatataaatgtcacttttgcttttgttcattcctaagagttgacagactatcccaagtggatattctgacttataagagaaggtgaagggagaaccaacacagtgcctggcacttagtaagcatttaaaagataattttttgagtggaaggagagaggtagggagggagagacatgaccttcttttgccataagcctcgccaggtgaaattcagaaacacctacctctaaccccctgcacctctccccagggcccaggcctctgagcagcactcatgggtcactttactcattgtggatcacagagcctgggctactataaaggccagtgttgcagccttctccccaggactatatttcttttcttggtgtttaatcccccctcccatgtttgatgcttagaatagcttagggccagaactaatctccctctcaaggctcttttctgtcccacaggatgtgatgttgacattacaggaccgcctttccctgaggttcattgagcactttgctcttgtccttgagtatgccgggccagaacagaatcacaagtttctgcttcttcaggacaagcaacccctggcttatgtaagtaactcttttttacagatagctttgcatgtggcctctagtagagaagacccaaggcactccctgtctggaaaatttataatgatatgctcagccggttcccagaagtcacagttctcacccaaagctggtattatccacctccagagggcttttggcagtggcctttgtgagctgagaagagcatgaagatcattagtcttggtctctagggggaagagtatggggtgattcaccacatggcacccagaatgctgagataaggagcagttgcaagtctcctgtctcctggaaaccccacatgatagatttttctgctttctgggagaaaacttggccttttgcatgaaggctgttatggaagggtcagggagtggatcctactcagccaattcccaactcccacttatcctaggacaagtgggagttgggaattggctgagtagagccaaaaataggcggcatgtcacccacatcaatttacaaggtagagtaggaaaaagtatccggtcttcctagccctcaccatatggaaaagggctggggaaatccaggattcctggatagcatttcatctacagtgaagcaccaagaagtgtcagagatgcaatcaaagccaatcagtactaccaagtagggtgggacagagttggaaaggaacagtggaagaaataccttttcagagcctacatgaaagccaaacaaaaccccaaatcagacacaaaaagatgaaaggatttttggaaagagagattcaagtttagctctcagccaaatgcaatacagagactcactggtgggaaggaaaggttgtgggagtcctgcctggagggaggcctaagcacctccctcacccccaagcaaccctttgaattcagttggtctgttgttccaaatgggattttaaacttttttattatgaaaactttcacacatacacacaagtaggaggaatatagtatcattaaccctattacccattcccaggttcaacaattatcaatacagtgccaagatgtttcatctgtaccttgaaataatattttaaacctttgatttactctaatcagcaatttactctgcttgaggctgagcccctctgtaaggtaaaggcatgaatcccacagcaagaaaagaggagtctgagccattgccaggagccctcccttcctgcctagtgtcttgggctttagacccaatggttgataaaggtcatgtcctagataagtgatttgaaaattcctcttattttgggtcagaagtgtagaaaagacctgactcctcactactttcctctgagggtaattagaatcagccaggtcggagacagagtaggaaacaacagcttagctctgccccaagccccaccttaaagagccactgagctgccagcccaacaccccagccattgattccagatctcttttcttctcccctttcatccctggaattcaggtggtacagcggacacactatcatggaatgaaatgcctcttccgaataagcttctttcccaaagaccctgtggagctgctgcgtcgggatcctgctgcttttgagtacctatacatccaggtagagtctggcttggggatacacagacagaccagtggacaaagaagcaggcaggctgttctgccatcacaatgaaatagctatgtaagtttttccaacctccaggtagccctgaaggccctttccttccttttctgctaccatcgtaggccatggccaagttggctggcctggtgacctgagctggctgtggctcaaagtcctgtctatttgtccactcagatctcatcagttttcagaaacaagcaatcccagtaactctggcatcctcacaggatcctaaagtttaacaagcccatttcggtttcaacgggtcccaacccccaatacctagctccagtatgagatgattcccaattcagtttatccagaaacatttactagacacttactctgggttaagccctatgctaggtactagcaatcagaagtgaatgaagaactgtcctggctcactagagcttatatgtgcctgaataaatatgacagcagcagggtgcaatgaagatgagggcactcaggaagcatttttccaactctacacaagagagatggtgcaggcttcatggaaaaagtgatatatgcatgctcttagccttgaagaatgaatgagagtttgttgtgtagagagatggaatggagggggcatactctaagcaaagggccttgcatttacaaagccatggtggcatgaaacagcatgggatcatgagagaagcatgagtgattttttatggctagagtacaggatgtgaggtaaagaggagtagggaataaaattggagagacaggaagcagtgatcaaaggcttttggtaggccaaggcaagcatagactttatgattgagcctgggcagcggttcttaaagtgtggctgttatagattctttgcaatttcatgcttcctggagtggtagcatcagcatcaactgggaccttgttagaaatgcaaattcttaggccccagcccagtcctactgagtcagaaactctggaggcagaattcagtactctgtgttttaacaagccttccaggggattccgatgcccaaaagactttgagaacctctgctttatgatggtggtttaaaccttagatgcacattaaaattatctgggaggtttgggaaaatgctgtgccccatccaagaccagttgaatcaaaatctatgggagtggggtccaaacactggtatttttttaaattcctcaagtgatcctaatgtgcagccaaagtaaagaaattctgtgggagagtaggagagcagaaattattaaaagagaagaatagcctggtcagatgagcaaattcaaaagaccacacagtgctaaggaagtacaccagctagggagcaatggcagttatccagaagaaatgacaagggctagaaccagggccatgatgaaggaggtgggatgggtttcaagagagatttaaagggtagaatggataggctttaacttaacaagtgtcttgtagaggtggtatcattccccaagttagagaatacagacaatggaatgggtttagggtaaagatgagttcattttgggaaatgttgagttttaggtgcccataggacatacaacagcacttaatgagagaaaaaaacctcaaacttcatctgtctctgatggtgatatccagggaggtgctatgagacattgtcgttgtcctttttgactgttctgacaacctaaaatgttaggaacgtttcccagacagcctcaggttcatttaccaaccttctaggaggcaatgagttgtggttgctctgtgaattttgtaagtttagttctcattttttttttttgccctgaatttcttaattcaagcttccaaggattaccttggtttgaatattttagaatttagtgacaagatcatgtccatcctatccttctgcttcatgatgatatggacttcagctgtattctttcttttttacatgtaacagctttattgaggtctaactgacaaaagataaaccgtacatgtttacagtacacaataccatacgttttgacctatgtttatgcccatgaaaccatcaccacaatcaaaatattgaacatatccaacacacctaaaagtttattcaggccactttgtaattcatccctcccagccctaggctaccactgacctgctttctgtcactatagattagtttgcactttttagagttatatagaaatgagatcatatggtatgtatacttattttgatctgacttatttggctcggcatactgattttgagatccatctatgttgttgcgtgtatcaattatttcattcatttttattgtcaagtagtatttcatggtgtggatattccagaatgtgtttattaattcacctgttgatgaacatttgggttgtttccaggttttagttattacaataaagcttctatgaactttcatgtaccagtcttcgtatggacatatgccttcttttctttggggtaaacacttagaagtggaatggtctgagcatatgctagatctctttctttaattttgtaaagaaactttactgttttcaaatgtagttgtaccatctttcattcccaccagccatgtatgagagtttcattttcttacatccttatcagcacttggtattttcagtattctttttttactttagtcattctgatagtgcgtagtggcatctcattgtgattttcatttgcattttcctaatgactaatgatgttgagcatcttttcatgtgtttatttgatgctacgcatcttctcgggggaagtgtccatttagatctttgcctgcttttttattgggttgttttcttattgagttttgagagttctttatatactctggatacaagctgtttgttagatatattatttgcaaatattttcttccagtgtgtagctttccttttcagtctctaaacaacgtctttcacagagcaaatgtgtgaattttgatgaagtccagtttgctaatttgttcttttatggacagtgcttttggtgtcatatctaaaaaatctttgtctaacccaaggttacaagaattttcccctatttttttctagatgttttatcatttacagttttatatttaggcctatgatccatttgaattaacttttgtatgtggtgcaaggtatccatcaaagtttcgtgtgtgtgtgtgtgtgtgtgtgtgtgtgtttttttttgcatatggatatccaattgttatagcaccttttgttgagaagagtatccttcctccactgaattgcctttgtacttttgttaaaaatctgttgtctatatatatatatatatatatatatatatatatatatatatatagatctattcctgtactctctattctgatctgttggtctacttgtctgtcgttatgtcaacatcacactcttgattactggagctttataataattcttgaaatcaggaagtatttgttctccaactttgttctttttcaaagttggtttggctattataggtcctttgcattttcatgtgaattttagaatcaccatgataatttctaccaaaacctgctgtgatttggattaggattgtgttgaaactatagatcaatttggggacaattgacatcctaacaatattgagccttccaatccctgaacacagtatttctacatttaattataccttctataattttcctcagcagtattttgtagttttcagtatataggtctttcatatgttttgtcagatttgtccctaattatttcatattttttgatgctattgtaaatgattttgattttaattccaattttcaattatttcttgctagcatatacaaatagagttggggttgggcatgttggctcacgtctgtaattgcagcactttgggagactgaagcaggaagatcacttgagctcaggagttcaagaccagcctgggcaacatagtgagacccccatctctatacaaaaagatttatttttaaaagaatagaaatacaattgatttttgtgtattgatcttatatcctgaaaccttggtaaactcactacatttggcccttcatatctacaggttccatatttgtggattttgaaaatattcaaaaacaataaaaaataacagtgcaataataaaaaatacaaaatttaaaaatataatataataactatttgcatagcatttttattttagtttagtttgagacagagtctcgctctgtcacccaggctagagtgcagtgccatgatctcggctcactgcaacctccacctcccaggttcaaacaattctcctgcctcagcttcccaagtagctgggactatagacatgcaccaccacgcccagctaatttttgtatttcttaatagagacagggtttcaccatgttggccaggctggtctcaaactcctgacctcaagtgattcacctgcctcaacctcccaaagtgctgtgactttaggcatgagccacagcatctggcctacatagcactatagcaatttttttttttttttgagatggagtttcgctctcggctcattggaacctccacctcctgagttcaagtgattctcctgcctcagcctctcaagtagctgggattacaggcgcccgccaccatgcccagctaatttttgtatttttagtagagacggggtttcaccatgttgtccaggctggtcttgaactcctgatctcaggtaatccaccagtctccgcctcccaaagtgctgtgattacaggcatgagccattgcacctggccttatatagcattttaattgtattaggcattataagtaatctagaggtgatagaggtatacaggaggatttgcataggttacatgcaaataccacagcattttatataaaggacttaagcatccacaaatttcagtatccatgggggtcctggaagaaatcctccatggataccaagggaaaactgtagttgtagtagttttttgtaatagaatccactgaattttctacatagatgatcattgatgatgtattccttttccactctctcctatattatagtgatatcactgtggcttcctagtcccttagtccatactggttccactttaacaaaatgggaaactggtctaaccaaggctgactcattgatagctggggctgtgaccctcagggtttgggggttgtcatacccttggccagtagttcctggagacctcctctaggatagcatagggaagattgactcatcaacatttttgtccttcagacaccaagaagaagaatgcctcccccatccctgcaattcagctctcaccctgggcttctgggccagggccctgtggagagtccctcccagtatctttctccccttgtttccatctgagctagtaaaggagccttgtatggcttgggggtgagtataacccccatgaaaaaaagtaggaaagtctcttataaaaggaggaaagaaagggagtggtgccatgtctcacttttgcagtgaactggactgtctgcttgtaccttgccattgtgtgcccctgtcactgagaaggctatctagtatctgctgaataaagtgaacagtgtctatgagacctgagcctcctctgttgtctcttctccaaggggagctccttcctctgtcccttgatctagcatgccttactgatactatgagtattgtctgggatgtaagggagtagatcagggggtggggaaggaatgtctccttcagctgataggtttggactgccctctctcacagagtcggaatgatgttattcgagaacgctttggaatggatcccaagccagagatgcttttgggccttgctgcgctccacatctatatcactgtctcagccactcgacctagtcagaagatctcgctcaagaatgtggagtgagttgtgctgcggcccgttgggatggggggcgaatagttgcgtagggaaaaggtacactggttgagctatgctatgcttttcagaaatgtaggacatgggatgggagtgagaattggagtccctcatatctagactatgaagccctagagctacagcttctactagggagctgtggctaatgttattttcctatccctgtccctttttctttctcccagtctctattcctccatctctacctctcagattcagtcaatttctgtcttaccatcttctctctgtcccactttgcctctctcactaatctcttacttttcttctgcttttaggaaggagtggggcctggaaccctttcttcccccctccctcctgcaggtcatcaaagagaagaacctccggaaatctctctctcagcaactgaaggctcaccaaacacatccttcctgcggcaccaaggtatccagagtagaccactgggcatggtgctccaggcactactggccacagggagatcctgggtggtttcccagcagagtctggtcctctagggatcctcaccactgcttttgactcaggtgcacatacggcttggccaggtgtggggcagttgtggagaggagtcttccccaagcctgagcatcccaaagagacagctgagtgacacatcactgagagagctcagggtcctcaaagcaaaggggccaagatgcaggagataattctcaggtccttttcaccaattagtcagtgccgactgagcatgtatcatgtggaaagcactggaccctagggaggcacatgttttccatggaaatgactaggctggtgtggtggctcatgcctgtaatcccagcgctttgggaggccaaagcaggaagatcacttgagcccaggagtttgagaccagtctgggcaacatagtgagacagcgtctttacttttaaaaaaataatttaaaaaaaatgtaaaaaaaggaaatgtacctctgtacctctaattcatcagtcctagggtgtggaattctgggagacaaaaccccagcccaggggaaagtgggagagttgggggcacaagacctgacctggagaatgggtcactgggtggaatggtgagggatcaggttactgcctccactttctagtgctctgagggactcccactgtctgctttcccaagccccgcagcagcttcttagctttgtaagattcaatctgcctgtgcttcctgccctagaagcaggagagtggtgagacgcactagaatcagcatgcagatgtacatatgggacgcaatcgccccatacattcctcccattccagatttcttgcattaccaactagcttctcttttaagatgcaaatttccccggagagttaagccattcccaccttgctgtgaatatttaatcagattgttttcttctcaactgagagcatcagtgctcaccaccatctcctcaggtaacatttttttcgaggcaccccagtgcttgggttggaaatatgaagatgaagagggcctggtcttggcccctgagtcaggcacagtctaatggggaaacacattagtcagtcccaacacagtgcattaggcacaggtgctctggaagcacagaggaagaacactaagcccagcctgagggaggtggaaaaggccagagctgggtcttgaaagacagataagagtttgtctagattaatccgtgggcatgggtcatgggaggaagtgtttcccaggcagagagatccatctgtacaaaggcccagagatatgagaaaccatggtgcaaggacagaaatgcaaatcattcagcctaagcaagtacagaaaatgcaagctgtgtgcaaggggtgaagataggggcaagagaagaggccagagaggttggcaggagccagttcatggagggccttgtgtgccaaggaaagaggttgtacttcatcctctaggcagctgggagccattgaagggtttaaagcagggagctgatgtgattaaacttatgttttaggatgctccctctaacagtgtggaggcacttgagggaaagagggaaacaagtgtcagtcctgaaggtaacctggctgtcaccctgacacaggtgggaatgtcaaggcaatgactggctagagaagagggatggatagattggaaaaggagctagggggtaagtatccagatgatctggtaactgctggctctcacatgaggcgattaaggaggagtccagtgtgactcacaggtttctggcttgattgcccaggggatgctgatatagaccaggaatgcctgaagtgcaggcttgggacttaggaatgcttagtatgaacggtattgagtgggacccccagctggggaatgaccagcatgtacatgactctaggggtctgaaacatctcaggagagaggtatggattaggtggggcgtcagttagttggaattaaaccaaaaacaaaatgagtaagctggatactttaggaatgaagatcaggaggtaggacaagattttagaaagggagatgagatactagagggaagagctgtccaaactagaaccttgctgctgttttaagaagggcatcttcacatctccacagtgtcacttgctgactggtgcctgtcctaggatgttgagactcctcgttgagaacatgggtttgcttttcctgtgcccctcaggcttctcatatttctggatgggtttttccacagggctctgcaattcaggcaaagctccagtatctacgaattctgaatgaacttcctaccttcacgggcgttttgttcaacactgtaggcctggtcagtggcgcaggattgggggatgtggggagggagccccttgttggctcttgtccttgggtgtgggggcaggaggggcaaatatttctaaaggccttcgttcctcttcctcctccttctacctcttacctccctggccctgcctctgccaaaatgataaagtgggaggagatatttgttttgagtatccctccatgacctttttttgttcctcttcctcgatttgggggcgcagcatactttttccataaagggccagatagtaaatattttaggttttgcaggcgggccatactggcaactgtggcaactactcagccctgctgtcagattatgaaagcagccacagacaatgcataaacaaatgggtgtggctgtttaccaataattatttatggatacgaaaatttgaatttcatgtacttttcacatgtcacaaaacatgcctcttctgattttttttccctaccattaaaaaatctaaaaaccattcttagctcctgggccataaaaaataggtggtgggtggtatttggcccatgggccatggttaggcaacccctgctctatttcatttttgttccacatactcccacagtcccctaccctaggtttcctgagtccttctacttctccccctgcttgctcagcacctttgctgcaggaacaaggctctggggcagggcacagctggtcccaccctaagactgtgccccaggctagtttaccctggtgaaaggaaattcaaatcaccttgctaattggatccaggtgcttgtcttgctcccaggagcacattgtcagctagtgcggcacatcggtggaaagccacttatcaaagtgcctatagacaggcacaagaggttcctcagggtgatgctaataccagggaatgggcctccagacgacccaagcttgattgctccaaggaatctgtcaagacctcttaagggaatccagtccttcaggccgagaggtagccatttacatactgggatttgcagaacactgaaagcccactgtcccctcccacctccttcatacactgtcaaatctttcttccacccacctaccactgctaaaatttctattggccatacctgctggagtgcccattaaaaggcaaatctctgcttaacgagggaggctgccatgaagtacccaatcaaccctcaacaccttaggcagagttactgtgccagtttagtttttggcctgggtgagaagtgcaagtttgagtggctgttggtggggggagggtaaagaccagacacaggatgccgccttctcaggcagagcactgggtgggggcctcaaatggcctgcagcaacaaatggaaagcccctggggcttggaaggggagggtgctccaaaggcccccaaacaaacctcacctacttcacggttttgcttgagctagcccttctgcctgtgcactttactcaacctgctgctgaggctaaggtgttcatttggacccataatctggggctctatcccaggaaccattttctgtcccagaccattttcccctccaggttgtcctactgtggcactgagccccagatattttcagaccccaccagagagtccaatgcatgttttctatttcctcctcctgcctcctctccccacctcctccacccttccttctgtgaacgttgcctgccattcttgggcaccaggatgagaagcagtcggccaccacgctcctggtgggaccccgtcatggcatcagccatgttattgacctcaaaaccaacctcaccactgtgctgtccgagttcagcaagatcagcaagatccagctgttccgggagaaccagggcgtggcccgggtggagaccagcatcatggatgccaaggtaagccctgctttgagggcctccttctgtttaggaacaggccttgggaatagaggaagaagtaaacttgagaaagagaattggaatctgttaggtgaggttcagtaattctgaagtggttcaaccctgggactctttgggctaatatgtctcttctcagccctctgggacatgccattttgaccacataataaggtcagccagcactaaggaatgctatggagagtcagatcagcctgagacagttcttcagcacagggcagggaaactggagaacttggagctacccccagaccactgcttcccatttttctcatatcatagcacacagaaaattatattcacaggccggcatggtggctcatgcctgtaatctcatgctttgggaggccaaggtgggcagataacttgagtccaaggggtttgagaccagcctgggcaacatggtgaaaccctgtctctacaaaaaattacaaaacttagctgggcatggtagcacacacctgtggtcccagctactcaggggactgaggtgggaggactgcctgggccagagaggtcaaggctgcagtgagctgtgattgcaccactacactccagcctgggcaacagagtgaaaccctgtctcaaaaaaaaaaaataaaataaataaaaagtaataataaagaaagaaaagaaaaaagaaaaaaaaattatattcatgtggaacactggggtaaatgtagcagccccagagactctgtccaccccaggttctgcctggctgccccagaaactataggaatgaatatcttggcccatcttcacccattccatgtgcacagcagttggggggccctgccatagggacacgcaccttgagtcattgaagagagggtgtctgagcatgtgaacagaacagagggggcctgggaagaaggggaacatgcagagccttgtccttatttcacctcccagagtccagcccttccagaaccttagattcattcccatagatcaactccttcggactggcaagcagctgtcgcctgtgcaaagtctggcagtcttggtcagccaccccctccacagctctcctgtttgaataccagtgaccactgtgggtggggggcaggcctgcctgccagctggcggaagctcttagaggagttgcaactttcctttcttaaacgatttcccagggggagatattggtagcagattaagaggtggagtgtttgctgtttctaaaagagaaaattatttgctttatttttgtctttgtgaaacccagaaagctttaatgtgttgatttttccacctgtgattcacaggattcccattggtttaggaactggcttggagccgatgtttaattggcttgcggctacctcctcaaccaatggttgctgcactcctcagatgttgttgggtaaaaagccaaatggacgggcagagaagggggcagggaagacaaggcatgcaggggagatgtggcttcctgagaaataaaaggggtttaaaatagagacacagctttccaactgagtcttctatgttctgagtgattctcaacattgactacacaatagaatgtccttaagtgctttaagaaaaaaacagatgcctgggtcctactctcagagattatgatttctttggtcatgggtgaaacccaggcatcaggatttatttatttttttcagtttcctaggtgactgtgtaatgcaaccactttgagaatgcacaggcttgagacctgtattaccagagctctgggaggaaacaggctgaacaggggatcagtgggtgttgtctgagtgaggagcactatgcttatttctaggggtgatccagccacagttgtgggaatgaatgctgccctggagaggctacattgtcattggggagactagattcacaaagacacatgacctgcctttaaagcacaatatcagaacatgtatagagctctggaatcagacaaggctcaaatcccagccttcctgtgtgaccttcagaaagtgtcttaacctctctgaatcccgattccctcaactgcaaaatggaatgcctatctcaaaaggtttttatcaggattattattattatttttaattttagagatgggggtcttgctatgttgcccaggcttgtcttgaactcctgggctcaagcagtcctcccaagtcggcctcccaaagtgctgggattacaggcatgagccactgcacccggcctgttgtgagtattaaatgaaaaaatgtacataaaatgtcttagcatactgcctggcacacagtaagtactcaatgaatgagacctgttattttttcaaaagcaaaacatcagtaaagaaaaagtaatatgaagtaaatgttacagacaagtgtgatgtggaatatggaacaaaagaacaggaaggagttaatcagatctggcttcccacaagagggtgttttaagctggatcttgaagtgataggcatgaattagcagagagaagtgggatgtgttcaaaggcaaggagcaagcacagaaataagcaagccatatgtgcaggtcgataagcatagttgcttggctggagaggagaataacgagaaaagagattgaagagattgggggtgggcagaacaagttggttaaaagcctcaaaggccagtctgtggaatttagattcaatgtggtagaacagtgagaatccacagtaggtctttgagcagaggggtgatcaaataaaagttgatttggaccagggtgcaagatgggggagagcaaagctaatgtcgagctagggcagtgaggaggggatcatggcactagtccaggagtgaagggacaagggcctgtgctggagggacagcagtggtaatgagaaaaaaagaggagatgtgaaatatgcaaaatcagtaagatgtgggtgcatattctcccctgcataccactcttgcacagacaatgcacgtgtcttattatacctagcccttctgcctacttcatgggtcccaagtactctgaagaatggtactatgtgcccagcagaagcaaaatggatgatattgtagtgaaaagagaaagggaagattgagggagaaaaaaagatcaaggtttagatttgacagtcatttagtatgaacttgctgttgctgggaagcatgctaaacacagaatttattttattttattttattattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtcctccagaattttttgttttttaaataaagaggctgggcacagtcgctcatgcctgtaatcccagcattttgggaggccaagggaggcagatcacttgaagtcaggagttcgaaaccagcctggccaacatggtgaaatcctgtctccactaaatctccactaaaaatgcaaaaaaaaaaaaaaaaaatcagctgggcgtggtggcacacacctgtaatcccagctacttgggaggctgaggcgggagaattgcttgaacctgggaggcagaggttgcagtgagccgagatcatgccactgcatcccagcctgggggacaaagtgagactccgtctcaaaaaaatagaaaaaaaattaaaagacagaaaaaaacatggcttgctgggtgcagtggctcatgcctgtagttccagaacttaggaaggcacaagtgagaggataacttgagcccaggagttcaagacctgcctgggcaatatagtgagaccctgttctccacaaaaatgaaagagagagagagagagagagagagggagagagagagagagagagagaaccatggctccttgccttcaaaaagcttacctagcttgtaggatagaaatggacatatacagccctgcacggtggctaatgcctgtaatcccagcactttgggaggctgaggcgggcagatcacctgagatcaggagttcaagaccagcctggccaacatggcaaaaccctgtctctactaaaaatacaaaaattagccacgcatcgtggcgcacacctgtaatcccagctattctggaggctgaggcaggagaatcccttgaacccaggaggtggaagttggagtgagcccagattgtgccaccacactacagcctgggtgacagagcgagactccatctcaaaaaaaaaaaaaaaaaaaaaaagcacaaatacatggcacacagaaggaagtgccataggagagctaccaagagcatgttaggggagtacagggaaggacaaaattctggctgggggtattaaggaaagcttcttagaggtgcttatatcagcaatatttgtgtttagtaagaggtggctctgggaaggaattgggagagcagggttgggaagcttcttactagagaatggcttccctgggctcagtaagaatctacccaccgagccagtggtgtgctggagctggctcacacagtgcatcagagccagctgggcacatctctccccatctctttgttcagtgccatcatgttaatagtttgaaagcagccatggtgggtgtatgtacaccagggaaattggccaatgctacaaattactacttgaaagaactggctgtgggctgggtgcagtggctcacgcctgtaatctagcactttgggaggctgagatgggtggattgtttgaggccagtagtttcagaccatcttgaccaacatggcgaaactctgtctctactaaaaatacaaaaattagctgggcatggtggcttgcgcctgtaatcccagctactcaggaggttgaggtgggaggatggctggagcctaggaggcagaggttgcagtgagccgtgatcatgccactgcactccagcttgggtgacagagcaagagacagtcaaaaaaaaaaggaaagaaagaaagatgaaagaaagaaagaaagagaaaagaaaagaaaagaaaggaaggaaagagagaaagaaagaaagagagagagaaaaagagagcgaggaaggaaggaaggaagggagggaaggaaaggaaaggaaggaagggaaggagggaggaaggggggagcgggggagggaggcaggaaggaaaggaaagaaaggaaagaaagaactgcttgtgaaatgtttaccagcacacaactgcataggttacactgaagaaggactgtctgaacatccttaacaggggacatggaagttagaaaccagacttggcccatttccccctagacaggccactctggtctggtaatattctgtaagggtctggtgaaattaagatggttcatttaaagtagttctcagccctgactgcacattagaatcatatgtagagatttaaaaaccactggatgcccagactcttcctcccagaccatttaaaataagaattctggggggttggggcccaggggtatacaggtctttaccacttccaggtgattctaatttgtatctggcctgagaaccactaccttaagtgatattctgccttgcccccaaattggctggctgtgcccaattagcctttcccagtgctgtggaggcaagaaccaaatatactgatcccttgggtctctagaccatcatcttttacccttcccctccaggccccttgattccatccttttcctgttttcagggatgctagagtgagcgaaggctaccccagggaaaatccttttcctagttggcatttcagagtgctaagtgcctgttagctcccagggcaccctgggaaggagatgtagctgaagcatgtcaaattaatccctgctgtaccttcttctggctggctcatgcctccaactccattctcctttcctcatgctacatttgaagatggcctgggcatattaattagttttcactcagcttacttgctcttagtggagcaaacatgaggtagtattcaaatatctttcttcaagagatggcagcctgggactgaggcatacctgggccattaccataccccattaccacagaagcacataaggtggaaaaagaaatcatcaaaggaatgtcccaagggatatcttgtggcccagtatgtgtcctattctcatgtttgagctttatttctctagtgatctctgtagggacaagcgttacattacacgtcatgatcattaaaatcctatctaaaataaaaaattgtttttgaaggtttctaaggaacctgtccaacctttttgtttgcctgcttttgatttcatttttacctgttggcaaaaatttcatttttctcttggcaaaaatttcatttttctcttggcaaaaagtgcatttgtgttccttttactgcgagctgcatttggcccatgctggggccaagttggctgtctggggatgacaaggagaggctcctgatgagctgtgctgtgctgagccagctggggttgtgcttggccctctctgtgcacgggattttgctttcgtgctgttttattactggcactgggctatcttgggggtaagaggggaaactgaagtggtcagacaatgaagtcaatcagccattctcccagcctccagtcagtaattctgtccattagccagccaaccagccagccaggcagctcagcggtcagaatgtgaggctgttaggcattctgtctgtcctgagctggcttgtcaaccagggcatgagtgagtcagactgccctgcagccggccagctcattagtcagccagccattcagcctctactttggtcaaatggtctcacattatatttgtcagccaatgctattttctcaaagctgtctccagtgtctgaaaccaaattagtcacacacgcacacattcacacttacccacccacgtaccactccaggacattctacgtttgggtagctctctatacgttttcctcaaagtacttatcacacctcgcaatcatatttatttgcatggttatttgatttgggttatgtcttatttcctgctcgattgtaagctccatgagggcaggaactaggttggcctagtcctggaatgaatggatgcatctttcacttggtcatgttctccaggaggcatctagccagtttatggcagcttgttgggtggacaaagcagggcacaggagcatttcagccagagggaacagcataggttaaggtatgaagatgtgaaggaacatgaggaactgtatttgtaattgctggagtataaggtgagggacagtgatgggaggggagcaccagtggagttaatgggagatatggttggagatggaggttgggtccaggtcctgaagggatttgtatgccattgtaaggcagttggattttctacaggtgatgagctattgaagattttaaataacaatgagacttgtgctttagaaagagccttcagactttgggagcctgagacgggtggatcactgaaagtcaggagttcgagactagcctgaccaacatggtgaaacaccatctctactaaaaatacaaaaattagtcagatgtggtggcacacacctgtaatcccagctacttggtaggctgagacaggagaatcgcttgaacccaggaggcagaggctgcagtgagccgagattctgccattgcactctagcgtgggcatcagagtgagactctgtctcaaaaaaaaaataaaaaagccttcagggtcattcagggtgtctcatgcctgtaatctcagcactttgggaggctgaggtgggaggatcacttgaggccaggagtttgagaccagcctggaaaacatagtaagaccacatctccactactactactactactactactactactaataataataataataataaagtagaaaagaatcttcaggcaacaatatggaggtgaagtggattcaagtgggtagaaactagagggagaaaggccagtcaagaggttattggaggttcttgggttagtgtatcccaaccttttccatatcatgagaaatgtcacaatttatataacaaaacatacaaacaaacgaggcatacatatataccagatgaggcagcttgcggccaaaggcaataggactgagaagccgagaggctcagtatctcagcacacaggccacccactcacaagtaccttgaggagttttgatctggcaggaagatgataaggtcctgaaatgaagcagtggcagtagggatggccgcgatgtgaaaacacctgaggcaagcctagtgagtcttgggccctcgtggtagccgccatttacactcaaacctctgtatctgtatatccttctgccatcagtggcagggctacagtggcagcaagacagcaagaaggggtatctgactccctgccccccaagttcatttcctttccatacttttttgtctttattttgttgtatgcaagtttggccattctgttgtgactgagaaacattcattaactggaggtacgaaagtcccttctaccccttcctaataatgactaaaaagtaatacctgtctctggcccctttctcactggaaaaaaaagccattgctcctcaaggtacaaactgttcctttttcctcccaatggtattgcatgaactccataggagcatcactaacttgttgccttaaagttggggcagagtccaaatgccttattgtggcatgcattgtaattgaatgtacaacaactatgaaagaattcaagttagtatttgatccaacacaagactgtgtggtatagacatagcaccatatgatttctgcaataggaaaagaatttaaaggagtagactgggcatgttgatttttgaatctccagcatagaggttaaagcagacaccctgatggagaagaattgagggctgtagactgagcctaggatatagctagggcgaggaggttgcacatgaagaaccaaccaaagagagagatgaagatggtcagattacagaaccggaacacatctcacagaaacagaagccaagagaagaatttccaaagaaggtgattgctgttagcaaatgtaataacttgagatgtgtgatgaatgaatacagttgtttctagctgtaaagaagtttcacttcagcgagcgctgtggctcatgcctgtaaatcccagcactttgggaggccaaggaggatcacttgtgcccaggagttcaagaccaacctgggcaacatagtgagaccctgtctctattgaaaaaaaaaaaaggcaaaaaagaagtttcacttctagatcaggtggctaactatggcccatgagccaaatctgactcactgcctgtttctgtaaataaagttctgttagaacacagtcatgcctatttgtttagtttacagattatctgtggctatttccacactatgtacaatggcagagttgttgtgacagagcccgtatggcccacagtgcctaaaatatttactcactagccctttatagaaaatgtgtgttgacccctggcctatatgaactacaaaatattcaactcaggctctgtgttggaatcctgggaaaaagaaaaccactgcaactttagctaacagctgagctggtttggaatcagaattgagcccaaggtaatggtgattcagccaaggaaggctaatctagttagtgatcaagttctgtcaggtcttcataatgtcccttccttttcactggaccagccaccaccctagtggaggccctaaccacctctctcctagactgttgcagtagcctcctcattggtcagagaagggcctcatttcctctgcctaattctcctatttcttaatgcctggtctgggtgacccacagccccatggctccctctttagccagtcttcagtgatctttatctggaaaccactgccctattccaaggagaatgttcccaaggctgacttcagtctgactcaaacttggtcaagccatagttaaaattacaatacagatactaggaggttttcttgaaatagtgctgattttcttgaatagcattgcctggtctctgaagcagttaaccagttaaccccaggactaatctgactgatttagagttaggaacagaagtcaacaatgtatgctagtatttcccaaggtgggttaacaacaacaacaaccttgttaccatgagattttctataaaaatagatctttgtggtctaataaattcagaaaacttagaatattaaagcctttcttttgaggtttcccagtgcacaactatatattaaagggtcttatgaattctcatagtaaaactatctgcatagtgttatttaacccaatgtcacaaacatatttgactaaggagctcttttaataagcaccaattaacaatatctcaaggacacagggaaataaaggaaaggggatagagcatgactcttttttttttttttagacgaagtctcactctgtcacccaggttggagtgcaatggcgccatcttggctcactgcaacctccacctccctgattcaagcagttctcctgcctcagcctctggagtagctgggattactggcgcctgccaccacgccaggctaatttttgtatttttagtagagacggggtttcaccatgttggccaggctggtctcgaacccctgacctcagatgatcctcctgcctcggcctcccaaagtgctgggattacaggcatgagccaccgcgccgggccgagcatgacgctctgagcagagctgcaggccagaaagactttggcccaaaaggcagagttacaacttgattccacagagattcctccatgtccagggaggtgttctgggtgttacaggggcatgtgaagatgagcaagacatagctcttgcacccaagggacttagaatcgagggtgttctaggccattctgaagtctaatctaaattcccagctttaccccgctctcccggctggcctgtgtatctgctgagccctggcaaacacaaatacagctacacagcagtcacatgaggttatataattttagtccttttcagcaaaggtggttcattaaatgtataattaaaggttgatttaattttgatacctgggtaagaggttattacaaagaaattctcaaatcagaataaactatttgtcaagccatgtgcctcaatttttggttcagacagtatggttcctttaactatgcaagtcatcttttgctagctaccatgcctctgaaaatgcatctgcctccctccttcccatgtcttcatgtttcttcccttctcttctgcagcctctggtgctgttgatggagtggcctgaagccaccaactttgcctgcctgatcgcggggtactgccgcctcttgctggattccaggaagatggtcttctccaggcctgccagccagccacttccacctccaatgatcaaggcaggtagggctcaacctcggttggtttttgctgtgccagaggccctttggaccctgaagacatggagggaagagcttctctgccttagtgctcaccccgtgccaacagtgcctgatttgccaggagccaacactgtaccactatatcctagctggcacagcccagtgggaaagacagctggccttcacatgtacttgtttcacaaaggatacctgtgacaacattgtgattgagtcagccaatgaatgtattattaaaatagcaaacatgataaatagagccaattaaatggctgcattggatctaaggcaaacttagcggtgcagagatctagaggaaacttacaggtgttctggctcagttgaagtgaagatgaaaatgaatataaaggtctgatgaaaaggaggtggctcaaagaacaggtacttcacatattagacctaaggctcatgtagatgcagtaagtgctccccaaccccagcacccagaaataatgagtgaagctgagactgacatccagtagtttgctctcctcacatgctgaatactctcaacccacttgcccttgctgcttgactatttctttcttcaaggctgtggttttctgagtagtcatatcacactttgggaggctgaggcaggcggatcacttgaggtcaggagtctgaaaccagcctggctaacaaggtgaaaccctgtctctactaaaaaaaaaaaaaaaaaaaaaaaaaaaatacaaaaaataggccaggcatggtggctcacaccagtaattccagcactttgggaggctgaggtgggcagatcacctgaggtcaggagtttgagaccagtctggccaacatggtgaaaccccatctctaccaaaaatacaaaaattagctggacgtggtggtgtggacctatagtcccagctgtttgggaggctgaggcaggagaatcacttgaatctagaaggcggaggttgtagtgagctgagatcacgccactgcactccagcctgggtgacagagtgagactgtctcaaaaaaaaaaaaaaaaaaaaagccaagtgtggtggtaggtccctgtaatcccagctactcgggaggctgagacaggagaatcgcttgaaccctggaggcagaggttgcagtgagccgagatcccgcctttttacttcagcctgggcgacagagcaaaactccctctcaaaaacaaacaaacaaacaaacagtagtcagatcagatctcgatcgaggtgtttgagagcagacacatactcctgatggatggcccagacctagaaggctgtggacaccccccacccacacacatcttctcacctcttgtctcttcatcacgatcatcatgacatgcctgagtttacatctcatgacattgtccataggaactaaatggcaatgcaccaaacacagatttgggaaaggataggtggccccaaggcatatgaaggagattccacatagaaaagcaaaggagctgacttaggatagtaagaaaccagggggctgagttgcttcaagtctccaggtgaacagctctgaaggggcggccatactagcaaacctacagatggccgaatgatgaaaaagccagcattagcattatcactgtcacttctgctcttcctctctctaatcacatccaagtaaactatacctcctactgaacaggctagagagggagaaaatgaaaagggaagataaagtgaagaacctggagcccagccaaagaccaaatgtgacagtgaagattatttggagggaatccactttcagaaggcactggaggtggctctgtagtcccaccctacctaacaaacagttttttgtcatcccatcagcaccctagccaatgctggccccaagtattccccttgctctggggatagtggcaccaagcacaagagggatatgtgcttcagtgcagcctcactgaacacattccaacatgccatgttgcttttccaaaggcaaatctgttttcttgcattctctatgggctaggtgtggctttaaaacaccccaccccccaccaccttcctgacttctgagatccgccttcggcctgcagaatgatgggggctcatgttgcctctagcacagggcctctgtgtccatgcgggagccagatggaccactgtgatgtctctgtttttgtggtacttctccctcttggggtagaaataatcagcttaggggcagagacctacagaaagttctgctcttccttcgccatctcttctggccagaaacatgagaacttgaactaggcatcatctccctaggtacatggtttaaatcttgggccctgttacttagctttttgaactgttaggtgctcttggtgggtggagtggggcagagtgagcctcacagctctacctgggttcactgagctgccactgccccagcaaagttctaggacttggtgtgcacattttgtctcatggccgctaagaagggaagggcacaactgaggagacctcagctcaggttacagtgaagggattatccgttcctgatattgtagacttttaggaccaaggtccgaagttgagatcagtttcctacaccagcccttactttcatcccagaacagaagccccaatgccaactgttgttccttaacaaaggccaatagggaataggcatcctcccaaccttatctgggcttttcccccagggtccaaagccacagcctggttaggtcctggtctctcagaaaagggaggaagaggtctggccagctctattcttgtcccacagcagctactggctgtcagcaagtccaactcagggctcagcctattgggcctaaaggatgaagttaaaccagcaactgggaaagtgaaaacatcaccttccttcaagtctcagaaaaaaaaggagaatggggacatggtagggaagggactccctcttgggctttatcagtagcttcaccaaaggtactacacttattcacttaacaaatcaagcactcatcatgtgccaggtgcagaagcagcagccatgaataacagacatagtccttatgatccttgccctcacataggttacaatctagtagaggggaaatactgacagatgattaaaaggataaggctaataacgtaagtacttttgcatttatatataagagattcaatagatacaacagagcagcgcctgggtttgagggcccagaaaggctttgagcttagagaaaggtccagaaaaatgccagttctctatctgtaatgaggttgtgggcaatctaaaggcagctaccatctttctgcagccctgagctctctgtatcctggggtaatccaggaaaaaaaggctttgagggcctcagttggaggaactcactctacgttttctaccatggttagaaaacagtttggtctgatgaattgaatattttggttaatggctactatatatcccatgagtggcttaccaattttcatgtagttaaaacccagcaaaatgtacagagtactaaagtaagactgaacgtagtagacttgttttgggtgattcagaaagaacatgagattcttgcaaggcctctaggtcgtcattatgaccagtgattattggactatagaatagagcagggccaagtactagaatgctggctgagtcaatgtcacacagaccgtatgtttatatatataaaaataagctgcatatattttcaaacataactccagttgaatcaccctcctgttctttgcaagcatttttttctagtcagtcttctgagtgactgagtacagagggatagactagggcaatccccttggggaaagctgatgagcaatttacaacatatttgcaatatgggaggcatactgtcctgaaccatcagccagccacacctggcattttactggcacttctaatcttctgccaggaggagatttgggattcttcaagcacattttgtcctctgatctggaagtcatggtaccaagtggtggacagggcattacctggccttgacagtctagtgcttagagatgtttccatcttgcagggagggaagccacccttagaactccagcctctgcctgagaggagtcaccatcttcttattgggcatgccactgggagccacctttgatggcagcttattgccaggctggctatcctgattgctcagctgtctcatacgtagttagcacctggtacatccccaggacctgtggacaatgtcttggtgtagagagacataatgaacttatagttcatactcctggctgattgctcctccggagcacttattccctaagtctcagaggcctggatggagggtaattaaataatatttctccaactgacccagagttccctagatacagtaaagcccagtaaggcctgaaccaaccccactcattgattctgtatttaaagcggcaacatggtctatggaaaattgcaagagagatctgaagtcacagagacttgggttccagtccctgttttgccatatcttagctatgggatcataactaaatgccagaaacttagtctcagtttcctcatatgtaaaatgaggataatactattacctacctcatgaggaatttgacaggattgtgtgagataaaccacctaaagtcccttcacaatacagagtacccttttttgctctgtttgtttgtttgtttgttgagacagagtctcactgttgttgcccaagctagagtgcagtgtcatgatctcggctcattgcaacctctgcctcctgggttcaagctatactcctgcctcagcctcctgagtagctgggattacaggtggccgccaccatgcccggctaattttttgatatttttggtagagacagggtttcaccatgttggccaggctggtctcaaactcctgacctcaggtgatccgcccacctcggcctcccaaagtgctgggattacaggcatgagccaccacgcctagccttttgctgttttttcaaagactgagagttcatcatgtgcccagagctgtgctttaaaaaaaaaaaacagctttgtttagatataattttgaagccataaaattcacccatttgaagtgcacaatacaattttgtttaatatatttaatatattcacagggttatacagccattatcacaatctaattttagaacattttttgcccctcccaaaacaaactctgtacccattagcggtcactccctatttccctcctaatcacctcccagccctaagcaaccattggtctactttcagtctatagctttgcctatgctggacattttgtgtaaatggaataataaaatatatggtcttttgtcacttgcttttttcacctagcatgttttcatgggtcattcatgttgcagcatgcaccagtacttcattcctctttattgatgaataacattctattgtatggatataccacattcctttatccattcatcagttgatagacatttgtttttttcccaccttttgactattatgaataatgttgttataaacattcatgtttatatggggacagtttttatggggacatatgttttcctttctctccagtatatacctaggaatggaattactggtcaaatggtaactccatgtttaacttttagaggaactgccgaattgttttttaaagagactgtaccatttttcacttccatcagcaatattggagggttaaattttaaccgtatcttcaccaacacttgttactgtccatcttttttttttttttggagacagagtctcactccgtcacccagaatggagtgcatgtgcacaatctcagctcactgcgacctctgcctcctgggttcaagcaattctcctgcctcagccttctgagtagctgggattacaggcatgtgccaccacacctggctaatttttttgtgtttttagtagagatggggttttaccatgttggcctggctggccttgaactcctgacctcaagtgacccacccgccttgacctcccaaagtgctgggattataggcgtgagccaccacacctgaccatcttttcatttattaatatgtctgtcatagtgtgtgtgaagtggtagctcatgtttacgatttacagtttcctgatggctaatgatgttgaacatcttttcatgggcttattggccacttgtatatcttctttggtgaaatatctattcaaatcatttgtccattttttaattgagctatttcaccataaatgtgagaggttatttgtgaactctcaattctactgccttgatctatacgtctatccttatgccaccactttatggtcttgatcactatggcttgtaatgaattttgaaatcagaaagtgtgagtcatcctactttgtacttctttttcaagactgttttggttattctgggtctcttgtgattctatattaattcttgaattagctgttaattttgacaaagtcagctgggattttaatagagactatgttgaatctatagatcaatttggaaagtactatcattataacaatattgattgagtcttccaatccatgagcagagaatatattccaattatttaaatctcctttaatttctttcataaatgttgtatagttttcagtgtacaaattttgcacgtcttttttttctttttctctttttttctttttctttttttttctttttactttaagttccgggatacatgtgcagaatgtgcaggtttgctacatgggtatacatgtgccatggtggtttgctgctcctattcacccgtcctctaagttccctcccctcgctcccccacccccaacaggcccaggtgtgtgttgttacccaccctgtgtccatattttctcattgttcaactcccatttatgagtaagaacatgcgatgtttggttttctgttcctctgttagtttgctgaagatgatggctttcagcttcatccatgtccctgcaaaggacatgatctcattcctttttatggatgcatagtatcccatggtgtgtatgtaccacattttcattatccagtttatcactgatgggcatttgggttggttccatgactttgctattgtaaatagtgctacaataaacatacgtgtgcatgtatctttatagtagaatgatttatattcctttgggtatatacccagtaatgggattgctgagtcaaatggtatttctggttccagatccttgaggaatcatcgtactgtcttccacaatgtttgaactaattttcactcccaccaacagtgtaaaagcattcctatttctccacagcctcactagcatttattgtttcctgactttttaataatcgccattctgactggcaagacatggtatcttattgtggttttgatttgcatttctctaatgatcaatgatgttgagcatttttttctttttctttctttttttttttttttttgagacagagtctcactctgttgcccaggctggagtacagtggcgtgatctcggcttactgcaacctccgcctcctgagttcaagcaactcttgcctcagcctcccgagtagctgcaactacaggcgcctgccaccatgcccagctaatttttgtatttttagtagagatggggtttcaccatgttgaccaggctggtctcgaactcctgacctcaggtgatccacctgccttggcctcccaaagtgtttggattacaggtgtgagccaccacgcctggccctgttttgttttttgttgttgttgttgttgttgagcattttttcatatgttcgttggccgcgtaaatgtcttcttttgagaagtgtctgttcatattttttgcccacttttttatgggattgtttgttttttttccttgtaaatttgtttaagttccttgtaaattctggttattagacctttgtcaggtggatagattgcaaaaattttctctcattctgtaggttgcctgttcactctgatgatagtttcttttgctgtgcagaagctctttagtttaattagatcccatttgtcaattgtggcttttgtcgtaattgcttttggcatttttgtcatgaaatctttgcccatgcctatgtcctgaatggtattgcctaggttttcttctagagtttttatgatttggggttttacatttaagtctttaatccatcttgagttaatttttgtataaggtgtaaggaaggggtccagtttcagttttctgcatatggctagccagttttcccagcaccatgtattgaataggagatcctttccccattgcttgtttttatcaggttcaatgaagataagatggttgtagatgtgtggtgttatttctgaagtctctgttctgttccacttgtctatatgtctgttttggtaccactaccatgctgttttggttactgtagcctcgtagtatagtttgaggtcaggtagcatgatgcctccagctttgttctttttgcttaggattgtcttggttatacagggtctttgatgattccatatgaaatttaaactagttttttctaattcagtgaagtacatcaatggtagtttgatgggaatagcattgaatctataaattactttgatcagtatggccgttttcacaatattaattcttcctgtccatgagaatggaatgtttttgcatttgcttgtatcctctcatttccttgagcagtggtttgtagttctccttgacagggcccttcatgtcccttgttagctgtattcctaggtattttattctctttgtagtgattgtgaatgggagttcattcatgatttggctctctgcttgtctattgttggtgtaaaggaatgcttgtgatttttgcacattgattttgtatcctgagactttgctgaagttgtttattagtttaaggagtttttgggctgagatgatggggttttctaaatatacaatcatgtcatctgcaaacagagacaatttgacttcctctcttcctatttgaatacactttatttctttcttttgcctgattgccctggccagaacttccaatactatgttgaataggagcggtgagagggcatccttgtctcgtactggttttcaaagggaatgcttccagcttttgcccattcaatatgatattggccgtgggtttgtcataaatagctcttattattttgagatatgttccatcaatacctagtctgttgagattttttaacatgaagggatgttgaattttattaaaggccttttctgcatcagttgagataatcatgtgtttttttgtctttggttctgtttatgtgatggattacatttattgatttgcatatgttgaaccagccttgcatcccagggatgaagccaacttgattgttatggataagtttttcgatgtgctgctggattcggtttgccagtattttattgaggattttttcattgaagttcatctgggatattggcctgaagttttgtttttttgttgtgtctctttctagtttgagtatcaggatgatgctggcttcataaaatgagttagggaggagtccctccttttcaattttttggaatagtttcagaaggaatggtaccagctcctctttgtacctctggtagaatttggctgtgaatccatgtggtcctgggctttttttggttggtagtctattaattactgcctcaatttcataacttgttattggtctattcaggtattcaacttcttcctggtttagtcttgggagggtgtatgtgtccaggaatttatccatttcttctagattttctagtttatttgcatagaggtgtttatagtattctctgatggcagtttgtatttctgtggggtcagtagtgatatcccctgtatcattttttattgtgtctatttgattcttctctgttttcttctttattagtctagctagtggtctattttgttaattttttcaaaaaaccacctcctggattcattgatttttttttttttggagtgttttttgtgtttctatatccttcaattctgctctgatcttagttatttcttgtcttctgctagcctttggattagtttgctcttgcctctctagctattttaattgtgatgttaggatgtcgattttagatctttctagctttctgatgatgtaggcatttaatgctataaatttccctcttaacattgctttagctgtgtcccagagattctggtacattgtctctttgttctccttggtttcaaagaacttcttgatttctgccttaatttcattatttacccaggagtcactcaggagcaggttattcaatttccatgtaattgtgcagttttgagtgagtttcttaatccttagttctaatttgattgcactgtggtctgtgagactgtttgttatgatttcagttcttttgcatttgctgaggagtgttttacttcgaattatgtggttgattttagaataagtgccatgtggcactgagaagaatatatattctgttgatttggggtggagagttctgtagatgtctattaggtccacttgatccagagctgagttcaagtcctgaatatccttgttaattttctgtctctttgatctgtctaatattgacaatggggtgttaaagtctcccactattattgtgtgggagtctaagtctcttcgtaggtctctaagaacttgttttatgaatctgagtgctcctgttttgggtacatatatatttagaatagttagctctgcttgctgaattattccctttaccattatgtaatgcccttctttgtcttttttgatctttgttgtgttaaagtctattttgtcagagactaggattactactcctgctttttttttctttccatttgcttgataaattttcctccatccccttattctgagcctatgtgtgtctttgcacatgagataggtctactgaatacagcacacccatgggtcttgactctttatccaatttgccagtctgtgtcttttaactggggcatttagctcatttgcatttaaggttagtattgttatgtgtgaatttgatcctgtcatcatgatgctatctggttatgttggacactaggtgatgtagtttcttcataatgtcattggtctttatattttggtgtgtttttacagtggctggtaccggtttttcctttccaaatttagtgcttctttcaggagctcttataaggcaggcctggtggtgacaaaatccctcagcatttgcttgtctggaaagtattttatttctccttcacttgtgaagcttagtttgtctggatatgaaattctgcgttgaaaattcttttctttaagaatgttgaatattggtcctcaatatttttttttagacagggtctcactccattgcccaggctggagtgcagtggcacagtcttggctcactgctacctctgtccccagggttcaagtgattctcctgcctcagcctcctgagtagctgggagtacaggcacatgccaccacacccagctagtttttgtatttttagtagagagagagtttcaccatgttggctaggctggtcttgaacccctggcctcaagtgatccacccacctcggcctcccaaagtgctgagattacaggtgtgagccgcaacgcccagcctggcccccagtctcttctgccttttagagtttctgctaagaggtctgctgttagtctgattggcttccctttgtaggtgacctggcctttctttctggctgcccttaacattttttccttcattttgaccttggagaatcggagaatctgatgattatgtgtcttgtggttgatcttcttcttctttttttttttttgagacagagtttcactcttgttgcccaggctggagtgcaatggcacaatctcagctcaccacaacctccgcctctcaggttcaagtgattttcctgcctcagcctcccgagtagctgggattacagtcatgcaccaccacacctggctaattttgtatttttagtagagatggggtttctccatgttggtccagctggtctcaaactcccgaccttaggtgatctgcctgcctcagcctcctaaagttctgggattacaggcgtgagccactgcacccagccttgcggttgatcttctcatggagtatcttagtggtgttctctgtatttcctgaatttgcgtgttggtctgtcttgctatgttggggaagttctcctggataatatccgaaagtgtgtttttcaacttatttccattctccctgtctccttgcagtactccaatcaattgtaggtttggtctttttacagagtcccatatttcttggaggctttgttcattccttttcattcttttttctctagtcttgtctgcatgccttatttcagcaaggtggtcttcaaactctaatatcctttcttccacttggttgattcagctatcgatacttgtgtatgcttcatgaagttcttgtgctgtgtttttcagctccctcaggtcatttatgttcctgtctaaactgattctagttagcagctcctctaaccttttatcaaggttcttagcttctttgcattgggttaaaacatcctcctttagctcagcatagttttttattacctatcttccgaagcctacttctgtcaattcgttcttatcatcctccatccagttctgtgcccttgctggaaagatgttgtgatcatttggaggagaagaggcactctggccttttgagttttgagctttttttcactgtttttctcttattttcatgagtttgtgtagtttcgatctttgaagcctcaaagacccttggatggggttttggtgggagcttttgttgttgttgatgctgttgttattgatgctgttgttgctttctgtttgtttttctttcaatggtcaggtccctcttccgtacggctgctgctatttgctgggggttcacgtcaggccctattcatctggttcactcctgcacctggagatgtcactcaaggaggcgcctcccttggctgggggatgggggctcctttgccttgtgtggctctcaggtgggccacctgaccacactattcttccttcctctccatggatcatgccaacctactagtcagttctgatgagagaacctggatatgttggttgccgttaaaggattcacatgcttatggttcttttccatgggaaacttgattgccgctgtttctagtcagccatcttgaccctgcgctgtcctcctttttaaattcataactagttaaaagacaaagtcaaattttaaaaagacaaattattaagtaaaataagatttaaataataaaaaataagtgtatttataactatttgttcttttttatgttattgtaaatagaagggctttctgattttattttcaggttgttcattgctagtgtataaaaatagaattgaggtcgggcatggtggctcacgcctgtaatcccagcactttgggaggccaaggcaggtggatcacttgaggtcaggagttcaagactagcctggccaatatggtgaaaccctgtctctactaaaaatacaaaaaattagctgggtggggtggtggcgtgcgcctgtagtcccagctactcaggaggctgaggcaggggaatcgcttgaaccaaggatggggaggttgcagtgagccgagatcatgccactgcactccagcctggcgacagagcaagactccatctcaaaaaataaaaatacaaaaaaaactgattttttgtacattgagcttgtatcctgcaagagatagttttactttttcctttccaatctggatgtcttatatttcatcttaattcctaattgccccagttggaactttcagtcagtacagttttggatagaagtggtgagaacatctggacagaccccagactaaaaagaaaagaaagaaagaaagaaagaaagaaaagaaatggtgagaacagacattctggtcttcttcctgatctaagcttttatcctttcattcaaatcaagtatgatgttagctgtgagttttttataggtaacctttatcatattgaggaagttcccttttattcctagtttattgagtgttttattatgaaagggtgttagatttatgtttttatttatgtttttgtgcatctattgagatgatcatgtagtttttgtcctctagtctatttacatggtgtattacattgatttttggatgttaaagcaaccttgcattactgcaataaatcccacttggtcatggtgtataattctttttatatgttgctggattcagtttgttagtatttatacactgctgggtcatggtgtataattctttttagatgttgctgaattcagcttgctggtattttgttgagggattttgtgtctgtattcatgaaagacatttgtctgtagttttcttgtgacatctttgtctggttttggtatcaaggtagtactggcctcatacaatgagttaagaagtgttctctcctcttttgatttttggaagggtttgtgaaaggctggtataagtgcttctttcagcatttggtggaatccactagtgaagtcacctgggcctggacttttttcgggggtgagggaggagttttaattcctatcctaattcaatttcttttcctgatactgtctattcagattttctatcttcttgaatcagttttggcaaattgtatatttctttctttctttctttctttctttttttttttttgagatggcgttttgctcttgttgcccaggctggagtgcaatggtgcaatcttggctcactgcaacctccacctcccgggttcaaactattctcctgcctcagcctcccaagtagctgggattacaagtatgtgccaccatgcccagctaattttttgtatttagtagagacgaggtttcaccctgttggttgggctggtcttgaacttctgatctcaagtgatccacctacctcggcctcccaaagtgctgggattacaggcgtgagccactgcacccagcctaagttgtatatttctaagaatttgtccataccgtttaggttatccagttgatatatccttattcatattcccttataatcaattccatatctgtatggtcagtagtgatattctttctttcattcctgattttagtaatttgagtcttctctcttttttgtttgatctttccagctaatctgttcaaaacaccaacttttagttttattgattttctctatcttttttctatcctctatgtatttccttccacttgctttgggttgtttgctcttctttttttgcctttatttttgttttgtttttaatttttgtgtgtacatagtagttgtatatatttgtggggtacacgagatgttttgttacaggcatgcaatgtgaaataagcacatcatggggaatggggtattcatcctctcaagcatttatcctttctttgtgttacaaacaatccaattatactcttttagttattttattttatttttatttcaatagtttttagggaacaggtggtgtttggttacatggataagttcttcagaggtgatttcttagattttggtgtacccatcacccgaacagtgtaccctgtacccagtgtgtaatcatcttttattcctcaccccctcccgcccttccccgcaagtccccaaggtccagcctatcatttttatgcctttgcatcctcatagcttagctcccacttgtaagtgagaacatatgatgtttggttttccattcctgagttacttcacttagaataatggtctccaactccacccaggttgctgcaaatgccattatttcattcctttttatggctgagtagtatttcattgtatatatttaccacattttagtctacagccatacctccctgaatgtgtccaatctcatcaaccacattaaaaaaattttttaatattcatttattaatgtttttagatggaatctcgctctgtcacccaggctggagtgaagtggtgcaatcttggctccaaaagtgctgggattacagacatgagccactgtgcccaactgtaccacatttttcttcatctgctcgttgattgatgggcatttgggctggttccatatttttgcagttgtgaattgaattgtgctgctataaatatgcatgtgcaagtgtctttttcatataatgactcttggatcaaatggtaaatctacttttagttttttaaggaatctccatactgttttccatagtggttgtactagtttacattcccaccagcagtgtaaaagtgttccttttcaccatatccacaccaacacatattttttttttatttttaaattatgaccattctttttttttttttttttttttgacagagtcttgttctgtcacccaggatggagtgcagtggcacaacctccaccttccgtgttcaagccattctcctggctcagcctcttgagtagctgggattacgggcatgcaccaccatgcctggctaatttttgtattttagtagagacggagtttcaccatgttggtcaggctggtctcgaactcctgaccttgtgatctgcccacctcagcttcccaaagtgctgggattacaggcatgtgctatcgcgcccagccattatggtgaattcttgtaggagtaaggtgatattgcattgtaattttgatttgcatttccctgataattagtgatgttgcacatttttccctatgctcggccatttgtataccttcttttgagaattgtctattcatgtccttagccaacttcttggtgggattgtttgtttttttcttgctgatttgtttgagctccttgtagattctggatattagtcctttgttggatgcatagtttgcaaagattttctcccactctgtgggttgtctgtttactctgttgactgtaccttttgctgtgcaaaagctctttagtttaattaagtcccaactatttatctttatttttattgcttttgcttttgggttcctggtcatgaaatccttgtgtaagccaatgtctagtaggggttttccaatgttatcttttagaacttttatggtttcaggtcttagatttaagtccttaatccctcttgagttaatttttgtgcaatgtgagagatgaggatccagtttcattctcctacatggggctagccagttgtcccaacaccatttgttgaaaagggtgtcctttccccactttatgtttttgtttgctctgtcgaagatcagttggttgtaagtatttgggtttatttttgggttctctattctgttccattggcctatgtacctatttttataccagtaccatgcctcgtagtatagtttgaaatctgataatgtgatgcctccagatttgttcttttgcttaggattgcttttgctatgcgggctcttttttggttccatataaattttaggatttttttttctagttctgtgaaaaatgatgatggcattttgatgggaatagcgttgaatttgcagatcgcttttagcagtatggtcattttcacaatattgattgcacacacccatgagcataggctgtgttttcatttgtttgtgtcatctgtgatttctttcagcagtgttttgtagttttccttgtagaggtctttcacctccttggtgttttattttttttgcagctattgtaagaagggtgaagttcttgatttgattctcagcatggtcactgttggtgtatagcagtgctactgatttgtgtacattgattttgtatcctgaaactttaatgaattcatctatcagatctaggagctttttggatgagtcttcagcattttctaagtatatgatcatatcatctgtgaacagtgacaattcgacttcctctttaccagtttggatgccctttatttatttctcttgtctgattactctggctcttttagttatttttaaaagtacaattaagttattattgacggtagtcaccctattgcgttatcaaatagtaggtcttattcattctttctacttagtttgctcttgtttttctggtttcttaaggtagaagtggaagtttatggtaattcatatgaaatctttcctcttttttaacgtaggcactttcagctacagatttcccctttaagaactattttaggccgggcgcggtggctcacgcctataatcccagcactctgggaggctgaggtaggcagattacttgaggtcaggagttcgagaccagcctgaccaacatggtgaaaccccatctctactaaacatacaaaattaaccagacatggtggcacatgcttataatcccagctacttgggaggctgaggcaggagaatcgcttgaacccgggaggtggaggttgcagtgagctgagttcgtgccattgcactccaccctgggcaataagagcaaaactccatctcaaaaaataaattaataaaaaatttaaaaaaacgactttagctagatcccataaattttggtatgtggtattttcatttttattcatctcaaagtattttctaatttctcttgtgatttttttccttgacagcctggttatttaagagtgttttggctgggcacggttgctcatgcctgtaatcccagcattttgggaggctgaggcaggcagatcacttgaggccaggattttgagaccagcctggccaacatggtgaaacctcatgtctaccaaaaatacaaaaattagctgggcgtggtggcaggtgtctgtaatcccagctacttgggaggctgaggcgggaggatcacttcagcccaggaggtgaaggttgcagtgagccaagattgcaccactacactccaacctaggtgacagagcaagaccctgtatcaaaaaaaaaaaaaagtgttttgtttgatttctacttgtgaatttcccagactcccttctgttactgatttctaatttaattatgttgtgctcagaaaatatattttgtatgattttattccttttaaatctagtaaggcttattttatatcctaacatacggtttattcacaacagtgttccatatgcacttaagaataatgtatattctgctgctgttaagtagatggttctatagatttcggttaggtctagtttgatttatagtattgttcaggtcctctgtttccttgttgatattctgcttagttgttttatccattattgaaagtggagtattggccgggtgcggtgggtcacgcctgtaatccctgcatttgggaggccagggcaggtggatcacttgaggtcaggagtttgagaccagcctggccaacatggtgaaaccccgcctctaccaaaaacacaaaaaattagtcgggcgtggtggcaggcgcctgtaatcctggctactcgggaggctgaggcaggagaatcacttgaacccaggaggcagaggctgcagtgagccgaggtcgcaccactggactctagcccaggcaacggagtgagactccgtctcaaaaaaaaaaaaaaagaaaagaaaagaaaagaaagaaagtagagtattgaagtctcctactactgttgttgaattgtgtatttttcccttcaattctgtcagttttttcttcctgtatttgggagttttgttgttaggtgccagtgctgtacttttgtcatagatgtaatctctagtgaaaggcaacactggcatattgactctgtcaaactggagtttgagtggcattttgaaggcttgttttccagcatcttgaccaccatgatgagttataagggtaatggctaaaaacatgggttttgaagtctttcagacctaggcggaaatccagtctaccacttggtctatgtaaccttaggtgagtcagtttctttatccttaaaatgtgaataatgataataactacctcattgggttgttatgaagaataagtaggatcatgtatattaggaccttagcctaagttagtgcttgtttgttatctgtctgtctgctgtccgagtatattctcacagataaaatggggaagagctccaaaaacagtgagagaaggtattcacagataaagcatttgctatagataattctcagatgcacacacctaccatcattaagagcggttgacgagagcatttgccatatgtatgtgtagcaggtagggctggccctgcatgaatgcagaaaagaataaaatttgaagaattataagaatgcttcccctgccctcctcccacatatgcacatcccagcatatctcccatatactttacacattcagaccccggaattctaatatagagccttattcttttaggatccctccatcaacaggcctctttgaaatgcaaactcttcggcattatatgtagcctgtttaacaggttctgactaaagcattagtaacttgtcagatttatttccttctgctagaagagattcaagataacaagaacaacagagcactggtggaaaagctctgaaaaggggtggggacaggggtaggaacagttccaagtgggacatacgtttacagctgactttcagatagagggtatccatgtaagagtccagctgtgcccagataccaggccctaaaccagggtgttcaccccgacccctaccataccccatgccttttcccatttcagaggtgatggggctattagcagctcaggttattagactctattcactctactttcagggtcagcagtaacatagctcatcaacttccctacctctaatctttggcagccaggtaatgctttgtcttgggacctgccacttgattgtgctacagagacatgggccagagacaacaagggagctcattcacaatccttggcaccagggctcatctgttgattctctttctgggtttagattacatgcacagcgcccaccgccctgtcactgggggccacctggggaaaaaggagagtagttatgtgggcagcgtgggcaccagccccaggaaatcgagccgctgcacgcccccacctgccgactctgagcttgtcagcttctgctacctccatatgcgggaacaaaggaaggagcaggaaagccggacagatgtcaacgagaacctaatcttctttgaggagaccaggccccgaaccaagtctgaccccacatccaaaagctctggccaaggttatgaggtagtccctgatgactttgatgcagctagcctagaccacgagccttgtgccagcagggcccggtcctacaccttggacaattcccttggggctgaagccctgaatttctactgtgactcttgcaaagccaaacttcaggagcagctgggccctcgcaaaggtgggaagcctggctcctctcgtgacaatatagtagatttgatgtccctcccaccacctgggagtgaggaggaggaggaggaggaagatgagacaacttctctgttgccagccattgctgccccaccccctggtttccgagacaacagctctgatgaggatgaccccaagcgccgggctgtccagagccaggaacaaggacgccacctgcgtgggcttctgtacgatgagattccagtgacattgattgacagtgtgcagacccggacagttcgagatcatgcccaggagctagatgatgccctggtgtccactctgcaggctctagaagccctggctgcatccgaggatggaccacacccaccacccccacagactgcaggtaatgaccgattccttctccctctttccacccccttctcttgtccaacaagggccagtaggtaacattgtgtcttcccaaataggtgtcagagtcactgaggtatgtcagggcagtggatgtaccaaaggttctttagatagggtcagaggagcaatgatgttacagcagggagcagctgctcagctctagctagagttctggctctcgtcattgcatctctttggaaatgccttacagatagatcccagggattggggtcatgacagctatggatgcaggccaggatagaggatcagagaaaaactgtgagagatgtagaagacaggtgaagaacagaacatccagcatgcacatgattgaaagaaaaggaaaacgaccaactcactacctagtgacctgggaccaggggagccaagggccatcactgctcatggctgaggtctttatcctgcctaagaacatgggctctgaatcagatgcaccgaagtcctggtttcttcaatcattgtcagtgtaacctttggcaaggcacttactctctctgaacctcattccatcatcttaaatgggttttataaaagtagttctatcacatggggttgtcacaaggattgaatgagatcattcatgcaaagcatgtaagcactgcctagcacacagtaaggcctcagtaagtggtagctattgtaactaagtattagttcacaggaaaaccgtacaacatgcatgctgttccctgttataaacacatgtatgtccatcttgtagacaaacacatgtcagacacatacccatagtcacacatatgtccctccatatacatacaccttaaaaaaagagaagagagctgggcgtggtggctcacacctgtaatcccagcacttttggaggccgaggtgggcagattacttgaggtcaggagttcgagatcagcctggccaacatggtgaaaacctgtctctactaaaaatacaaaaattaactgggtgggctggtgcacacctgtagtctcagctactcaggaggctgaggcaggagaatcgcttgaacctgagaggcagaggtcgcagtgagccgatactgcaccactgcactccagcctgggtgacagagtgagactctaaaaaaaaaaaagaagaaaaaagaaagagaagaggtaaatgacacagcaacagaaaaggaatagggaggaatagggaccacgagggattggggtcagagagagcctgccttttccatgtgtgaggacacccttgacattggacaacccccatgtatttggcccccagggctggcatttctctttgcttagagtctggagagagtgctagttgctcccaggcttgagtcccacgtggctgctggagagaggacaagctcagctaaatggcctcagctgcaatgactgtaggcgggcctggccagatgaggagggatagagagagacctctctttgccagcccctctttaggacaattaacaaaaatttcctagctgttgaatctaaaaatagttgtgattagcatgctgttttgcatgtgattcacatggtaatttgccataaaactgcccagatcctctcgccacctcttttgtttctgttttggattccggcctttcatccccttcttatagcttgcccctctttgtcccctcccctccactcttcccaccctcagccctgcattctcgccaggcctgtctgtttttctccagctggaaatactgctggctaaccttggcttctatgcacttcctatatagtcagccctctgtatctgagggttctgcatccactgattcaaccaaccgcagatcaaaaatatttgaaaaaaagaaatatgtctatactgaacatgtacagatttttcttgtcattattccctaaacaacacagtataacaactatttacatagcatttacattgtgtgaggtattataagtaatctagagaggctttaaagtacatggaaagatgtacataggttacatgcaaatactatgccatttcgtatcagggacttgagcatctgcaagttttggaatcttcaggagtcctagagccaatcgcccatgaataccgagggacaaccgtgtagagctggaaaagaacttgatttcagtaagcataacaagccctatccctgttcctccaggtctgattgtgctggccacaatcactcctgaatcatcgctggactcaggtcatgaaaccaactcttcagagctcacagacatgtcagagatgatgtcggccatgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggctctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtagcagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaaccctccccccacgccccccacccccgcaaccttcctgggagtgaagacacggagtccctaccaactgtcccactgtagggaacaaagaaagccaatgtttcttctgtatagattgcttctcgtccgcctctccatatctccccatttcccacacccttgtgccctgtgtctgcctctgtttcatcactgtgtcagaggcccatgtgaaatctttcattctgatgtgagttttataaagatgtacactgtgcttaatccctgcccatccttggtagcccctagtgcaataaagtctccctgagtggtgagttctcccggcaaggaggaggggagtttcttctgcagaatccagcccctcacttccttgcttctcctcccccaggaccaagttgttgaatgggccagagatgcagccagtggggaatccttttcccctcagccactgcaagctggagtgctgatatggtcttctttttctcccaacttcgccactcagcccctgcctgtgtcattccaccgccatccttcacctctccctcagcctcatggagaggaaacattttctaatgtctgtatatagtatatatactacataaaatatataaattatatatatactaatttatgtcttgtttttcaaacaagaatgattaaatctattcatcttactatcccaa

SEQ ID NO: 3560 - DNA, 80923 bp, human; identical to SEQ ID NO: 3557

SEQ ID NO: 3561 - DNA, 78605 bp, human; identical to SEQ ID NO: 3559

SEQ ID NO: 3562 - DNA, 62764 bp, human
gtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaa

SEQ ID NO: 3563 - DNA, 62563 bp, human
ctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaa

SEQ ID NO: 3564 - DNA, 61676 bp, human
gaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataat

SEQ ID NO: 3565 - DNA, 62764 bp, human
atatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataa

SEQ ID NO: 3566 - DNA, 62697 bp, human
acatctattgaaagggtaacgacagacggagatcaactaaggtggcaggtaaggttcagaaaaggagaaggacaacaaatttggagaaataggagaaggtaagtgaagtgaggaaaaagagggggtgctgaagtaagaaatgaggggaaaataagggaaatggcgggggtaggggagagaaaaatgagagaaaagaggaaaggggagaaaggggaaatgaggaaatagagaaaaggagaaaagaaataaggaaagaaaggtaaaagaatggaaatgggggagaaagtagaggaaatgggtaaagaaaagagaaaaaataagggaaatagtggaatgagtggaagcagaagagcagagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggcca

SEQ ID NO: 3567 - DNA, 62591 bp, human
atgcaatcgctacatctattgaaagggtaacgacagacggagatcaactaaggtggcaggtaaggttcagaaaaggagaaggacaacaaatttggagaaataggagaaggtaagtgaagtgaggaaaaagagggggtgctgaagtaagaaatgaggggaaaataagggaaatggcgggggtaggggagagaaaaatgagagaaaagaggaaaggggagaaaggggaaatgaggaaatagagaaaaggagaaaagaaataaggaaagaaaggtaaaagaatggaaatgggggagaaagtagaggaaatgggtaaagaaaagagaaaaaataagggaaatagtggaatgagtggaagcagaagagcagagagaaggaaggggaggactgaggagagacggcgaaggggcagagggaaaccgggacagagactgcctctgaggggttcagggaagagaggacacagcgagctggggaaaggaggtgacgatatcgttaagtaagcagaaagagacagaaactgaggagagtttgagcgtgcttctctgagttttgcttacggcatttattgggtactcctaatgtgtgcctggcactctctgactctctgcagaggcaaccgctctccttgcacgccccccccccagaaaaaggggggctttggagggcggcagtttaaggctacaacacttggggctctcgagggcgtcgtctcttctgtagggggacccattcgaggtgagactagagacatttgccctcacgccgagctcgagccccgcgagaccgggccactgagggggcacggcagcccgggtgggctgcgtgcgtatttctggcggaggatgcgccatgagcgctgaaagagcctgaaccgaagcgtccggctcgccgagagagtgagagccgggccggctcccaggagcgcgggcgagggtgcgagcggcagcgtggatgccagggcacaagggtgcgggcggggtggggcgaggggtggagggacaggatccagccgctcggggcccccgcccgccagccggagaagtggcggaggaccgttctccgccgtcccctctagggtaatttacatgctgtcatatcccagtgctgactcccgggcgtgcagaccgctaactagctcactcgctctcagctcctgccaccgctcagccgtcacagcccaggggagcccgagagcctgagagcctgcaaaccggggagggagggagcaaaggagggagggagcaagggcgcgccctggctctccctctgccctgctgcccgcccttcctgcctccacaggtccgccccaatccccgctcacacttgggaaacttgggactgcgctggggccgcgtgtggcacctcaggggggcggcccccggcctcaagaggagggggaggagaaggaggaagaggaggaagtgagcccgaaggatccgctcggagctgtttgtccagctgtttctattcgcacccggagcagtacagccagaagggggccgagccgaaggtggctggctttaggcgctaatttccaactcttttcctcacagcttgtcttttccaggcaccctggagtcccctcaggccagctcggtgggcgcgcacctgccagccgcccctgacctcgcaggccaggcgacctccgagcctgagaagatggcccagtccaagctcgattgccgctcacctgtcggcctcgactgctgcaactgctgcctggacctggcccatcggagtgggctccagcgaggcagcagcggggagaacaacaacccgggcagccctacagtgagcaactttcggcagctgcaggaaaagctggtctttgagaacctcaataccgacaagctcaacagcataatgcggcaggattcgctagagccggtgctgcgggacccctgctacctgatcaacgagggcatctgcaaccgcaacatcgaccagaccatgctctccatcctgctcttcttccacaggtgggtggctcggcacacggcggcaactcggtccttgctcccaccagcctctgctgcaccctcatctctggcaaaaggggcaactaggaagttcaggaggggtactggggaggtctgactcaggctacagtgactggaccttgaggttgcctggagtaccgcggagctgaggggaggactggcaggtgcaagccctattctgaaagctgcctgcaaaggctttctgatggggacgctggggcctagaaggtgggcagaccccagatggtttggaggtagctgaaagtacccgctcctcaaatgcatacatttccatagcccctttggagattctgccatggggtcttcttgagttccaagttctacccttctcaaaagcccatctcaaatgtgcaaaatcagattgaaactacaagggctttaaaattactgagtgcccctgactgacagtgagggcaagcaaaatgtcaagacaaattaaactgctggtggtaggagagggagatggggaggggaaaatttttaaaaatcagagacttgtgagaatttcttgagcctctggatgggagggattcgcctcctccatggatcacagcgttaaatttcaaatgtaagctaagcgcaaccccagagagcaccctaggacatcttgagtgcctcaagaactatgtgtggcaggagggcggatgaatccatgtcgttgcaggcgtgtattggtgtaccggtcaagctttctagaaatcctgctggggaggcaaggagaggacaagggagggaaaaaacacaatgggaagacccaaggcagctgctgtccttcagtttgagacactctggcaagaaccagtctctgggaacaactgaggcaatttagaggcagggcagacaacatcaggaaacccagccatggatttagtgtccttagcgccatcaggatagggcaccaacatgtgtgtgtgagtgtataagcgaggatttattcttgctcaacaacacaggttatgtaagagaaagacatcgccactgtgggagacctgggttgtagtacaagttatggcttcacctgtttgtatgagcctgagcaagtcgcctgacctctctagtctctccaaggttccttttagctctgagattctaggctgtaggcaggcgatgtgcccagacaaagtgataagaaattctgagcacctacaaaatatttagaatgcaagcaggctcaaataggaaattttaaaagcaatcgagaaaggcaggcgctattctcacttaatgctaagagcaggtttgcctcccttgccccaagacaaatccaccatcgcctcccgctcagcccagccccagtgattctgggcaagacaagcagggccgctaacctcgttagtgttattataacaagtcgtattcctcgggcattttcgacaccattgaagccctttctcatctattatttcactttaggcatcaaattatctcattgtctaaaataaaccaggctgaatttttaaaaataataaaataaaataaaccaggctgcgggcagaaaggtttcgagggaatcttcatttctagtgaaagattactacaagtgtattcagcccacagacgttgaaatcctgccaagcgaaagccctaacaggctcctaaggatcccgcctgtctctgttggagagtggcagtgggggaggggtagtagaaaaacctggaaagagcgcttgtagcatttgcatttgttcaactgggagagaaactgccactccaggctttaggaaagtgtgagagggggcgcctcttctggttctggccctaggagggtcaaacctgggtgagggaagtgtgaggctaaaagcctgagatcaaagtgtttccttctgccacacctcgggagcatcctggttgtttgggtttgtggaaagggaatacctcctttgtcatctactccactaatacgagtttattgactcttggttttaggcaaagcctggaaatgctacagggtggagatgtagtggggtggcattataggtattggttgagggagaagcgcaaattgtaggaaaggtttgtgtgagcaccctgcctccttcgatcagagcaactcactcagcgttcaaaaccagtgaggagctaaccagcaagctctcaggcttcgctaaggctgggaataacagggtcctgtggtaacagtcttatagttctaagaggacaaagtattctcttgcttttatttatttttatttatttatttttttcctgagacagggtctcactctgtcacccaggctggagtgcagttgcatgatcacagctcactgcagcctcaaactcctgggctccatcgatcctcccacttcagcctcccaagtagctgggactacaggcacacaccaccatgcccagctaatttttgtattttttttttatagggacgggatcttgccatgttgtgcaggctggtctcaaactcctgggcttaagcgacctgcccacctcagcctcccaaagtgccaggatcacaggcatgagccactgatcccctcttgttttccttgacaattgggaccttagagactggggattctgaattcggtttaggttttgcccagtatgacatgctcattagcaaactagaagaccattattgctggtcatggggcttctccaatatctggggtagacagccttctcctaagtgaacatatcccttgttacttcattaaattccctgggtttctatcatcatacttcagccatcgtttttacttctattcaatttaatgatttgacatttcaggttcctgttgggtgcttttttcctttgtcaactttcaaggcctctcctgctggagaagctagtctcccacccctcctcctgcagtccattcctttgccaagagggctcctatatttttaggaagaagagcagggcacattcttgatttacatctggtttgtctgctttgacctgtccctggctcccagcttcgttcttggtttccttggaacacaagagtataagcaatttgagggtagggctgtgttttacttgcttggttttcccttggcttttagttatacagccaatattcaataaaggtttcttcagttggatgactacttaaatattgacgtggtcccttgtaaagattttacaactttatactgtgctagaaaatccttattaatgtttaaaagttgttttccttccgttttaaccacatgcagtaactctcatagcctgatggaagtcctgatagtgctgtgtatatacatacgaatcagtgagaatgggcatgcagcctgttggtatgtaaatggtacctgtaaacaattgggttggggaagaagtgtattttaaacaccatcctttcaatcttgtattatgtaactaataaccataacagattaataactaacacttcttgaacattcacaatgtacctgcataatctaatttaatatttacatcaactctttggaatggatttatttatttatttgtttatttatttatttattttgagacggagtcttgttctgtcgcccaggctggagtgcagtggcacgatctcagctcactgcagtctccacctcctgggttcaagcaattcccctgtctcagcctcctcagtagctgggactacaggcgcacgccaccacactcggctaatttttgtatttttcgtagagatggggtttcaccatattagtcaggctggtctcgatctcctgatctcaaatgatccaccagcctcggcctcccaaggtgctgggattacaggcatgagccactgcgcccgaccaaatgggtactattatcatccattttcattttataaagaaggaaattgaggcttggaaaaaattaagtatcttgcccaatgcctcacaatgaagagcagagcctgaattgtctatgaagaaagaattgttaagaacactcagtaactaaactaatgctaaagaaattcttgtaacacttaagaattgtctatgaagcagaggtaaatgtgagctcagaacctttccaaatggtcaaaatgtccttattaggtagggaaaccaaccatcccagtcctgtgacataggactgcctgtgctcaaactggaacagtcctagggaaactgggatggttggtcaccctgttgttaggggacttcccccttgtcatttgaatatgcttctaatactggaaaacttaggagggagatagaatattctgggcaaacagcagaagtttccaatttaaatgtagcatatgaaaaagcttcccaagttgacatttgaagagccttccttaatttttctgacctgtaaggtataacaacctgtaacaggagctttgacagtattcgttgtgattgctgttgctgtaacctcaaatttttttctaagattttacccaaaacctcttaatcagctctattctacctttgaccccagagcgtacctggctagtgtggtctgaaatactctgaatccgatttcccttccagctctaaaaaccctaggattctacctttaagcttctgacctggccccaactggttcccatatataaatgctcagaaaatgataaaaatagcaaacatttctaattgctttatgtgtgctaattcatttaatatcccctattaatatagtaacaaaggggaaggatatagattcagagatcaggttttcaagaaaaatttgtgcaaaaaattatttgtgcttctctaagtgagtctcagaacaagtaatttcataatgtatattcctggacctggcttctgaggtggtggccactcacacggcatgatttgagtggctgcctgctgcagtgcctaagttcatactatttaagattcagttctctgtccatgtaccatctaaaattcctctcccagagcaccgctggtatgtagaccacactgtgagaaaccctgtattagagattgcaacgcattgtcaactaatttaccatttgattttgaggatggagttactcgctgtagagcggttttgggtttctgtgtggttaagcctgtcattctttgcctttgtgatttttgcttttggtatcaagcttcaaaagtcctttcatagcccaaagtaatttaaaataactatttcctgagtgcctagtggtctgacaaagaataggcattcttggattaagggaccttctccattaaaagcacaaatgcatttgcaaacttaacattcatggtttggatacttcatgagaactcagactggtaagaaactgtgtttttgctgaggcacagatgtgaatcacatgtgcaaggagactagtaggtgggggccggtcctttcaccaatgagtgagcctggtgccctaccccacatctactagtgtgtgtgtgtgtgtgtgtgtgtgtgtgtgaaagagaaagagagagatgtattatatgcatatattgtacatagtacatatatatatatagtggtaaaatagatataaaatttgccattttaaccatttctaagtgtacgattcagtagcattaggtatattaacaatgttgtgcaaccattatcattcccaaaattttgtcatcatcccaaacaaaaactctgtacccattaaagaataactcaccgtttccctattttcccctcccactaccccctggtaacctctattctactttctgtctctatggatttgcctatttagatatttcatataaattgaatcatacaatattttgtgtctgatttctttcactcaacatgttttaaagttcatccatgttgtagcacatatcagtacttcattctttttatggctgaataaaattccattgtatggatatacctcttttgcttatccattcatctgtcagtggacacttaggttgttgccctcttttggctattatgaagaatgctgctatgaacactggtgtacaagtatctgttcaagtccctgcttttaattctttggggtatatacctaggagtggcattgcccagcacctacttttcaacacaattttgtggtctactgctcgtagtcaacacatacgtaggaacctgtcataaaatgagcaaatgtctcagggcattccttgaggagaatgctccctctctaagccagctgctggtgctagtgattacaacgaagagaaagctacaaagtttggcaaagtgatggtgctgcctgggaatggactttttatgggggaaatgacatgctttggagattgcatccatgagttggagactggcaaaagttttagtgtgtatctctcatgaatggccaaggtctagcatacctttttaaagagtaacatgtgacaccattacttgccattaactactttgtatggatttgtttatcagacctctggtcatggtgacagcccactgggaatagggtcctatgggactggaatgtggcaaagccaactttggaggagagaggtagagagatggggctggagtccatggaaggcctagcttgggctgttacagcacggggcctggacagcatgagagttcaaaagatctgtttggaaagttcatgctcttaaagaaaggtgggaagcacagagcttgaatttcatctactcctcagtttttgccaggagtggactattatttactgagtccacacctcagcaaataatgctttccagggtgaccttagttttcttccctgcctgaagagaaggttaacactcctgcttatatttgcacttgcagataatccaacaagctctccattccaggtagagggttggctcctttccagatcaggtactgaaggccagggagtctgggtaaaatggagatggatgtatctggccaagactgccaagacctctaggcatcccgggtgatggaaccctgcagagttcttgcccccacctggtgggtgggttggttgggaggaatgagtttggccatgtctgcacctggtggtggctgttgcgctgtttgctcatcgtgattctgctcctacctgaactttctcttcttcttatgtaagccatccctagagataactgtaaagccataatctgccatggctggctgggcttatataacaaattggttggtatcgtgcaatagcctcttgaaccctggagaaaccaatgtgctaagttgagactaaaacatgggttcatttgatggggtattttgtgtgctcagtgaactcaggggagaggagtccatgaccacaggggtcagaaagatgaaatttccttttaaataaagagaacaataatggcccagaacatactgtgctgtcccaaagtctgcaataatgggacaagggttagggcattgctgtagcaccacagctttggcagaaaaggccctccacagaaccccatgggctaggaggagccccatgaaggccagaaggctagatcccagtttcagggcaacctaggtttgatgaagagtcaggtcagggaaaatgtcttttggaggccactgtctaccatgctgaaatccagcttaactagagttggagtggggctaagatgcgatctgtgagagcagaaagcaagcttttctcgattctattccaggcaggagggaatttcatcagtaggcaaggcaagttcacttgtaccttctagctgaaaattcctgccccaaagtagctgtggcccttctggaaactgtataagaggcattaagatcccagccagcacagaagactgaatgggaagcttcccattgtgcagacactagcccgagggaaaacaagagctggaagcaggctggatcactgatgatccaggctcaccattggccttcctctcctgggagccactttcctcaaataggtccagccagaaatcgggcccctgcctatggacagagcacacagggaccttccccatccttcctcgaaggaagactttactcacagaataggcttgagtattcaacccacttcttctaatcttctcttcaggggagatggagagcagctgttcacagcttaggggtctggccaggattcccgctccgtgctatctaggctggtgattggctagagctatccctaaggaagaagggggtgagaagtgagaggaaaggaagcgactccagcagctccttcctggcttaccccactcccaagacacccctccttcagcgctgccgtttagcctcactcccagactaggctgggcctaggccagcctgagggccctgactcataactagcacatcttatgtaacagccaggttactgaggcatcacacttctgcttgctcagtggtaggcttccctggggacaggcatttggaagcctgctgggggtccaagtcaagctcatcatacttcccaaggaaaagcctactctccccagtgtcaggcaagcagtctgctcagaggcaaatgccaggcagcaaagcctgacccggtcccacactcagcctccacactcagcagtaaatgtaagcagacaggcaagctggagtggacttaatttggcttgaggcattttggaggtggcagggaggaacctactatcacctgataatgcactgctaaagaaactgcgtggtgcatggagaggccccagaacaggtcgcagaagtccctcttccttttgtatctgcttgttggttcagaaactactgggtgggttggggtggggggagttgttggggggggggcggaaactccaggctgactgacaccaggtgaaagggtttaccggaaggtggaggagctgtttaaaggaaggcctttcaagagccaattcccagtccacgctccatgaagtctcaaagtccccaggttgacctgaattcacagtgattcttagctctctgcctggcctattcagaaaattacattaccggcttagtggaactgagcccccagtgaagtcagtattgccagattctatgacagatttctctaataacaaatgtgactatctacagcacagaatacccccatcaatctaatattccactagctcaaggtttgtaactaaaccaatagctcctcttcttctcttcctttgtcttttccccagcctgtctcacgtgtgttgccatcaagtaaatggctcacaggctgtgagtaggtggggacactgctctccactccaagaaatagaggagaaacagggaaacaaagtcaaaaaggtggtgtgggaattaccagcaggcatgatttgtatccaaagctgactcataagttcttggacaagctcaagactaccatctcagggctcagaagagcttggcacccttagtcccccagatcacagaatccagtgaaaattaggggacctgagatggagatgcagaattttcctttgtgggactcctcccaggcttccagcccctttcttctccctatcccctctgcctttttggttcataggctgtagcagtaaaaaagaaaaagaaacaaagaaaacaaaacaaagaaataataaataataagaaaaagaactgctcagttttaaggcaacataatctgcctgcccaggtgcacagagaaatgaatgatggcagcacctcattcggccttgtaccaaagcgaccaagcacttcaattaatcaatccatcatttattgaccaagggcctgctatgtattgagtaccgactgaggatttattgaatgcctatcctgctaatcactgtagaggacacaggagacgtcagagtctaggaccagggctctgaggagctgagggtatagcaggaaggagtggagcagctgcacccaaggccagtggggaacaaagcactggcgtgacctcaggcctttgcaaacctggtccagcctcctgctccttaagggaaaggccttaagcttactgctcctggggtctgcaggtctggagcttggatggtgccaaagcaaactaggaagggagagtctctttatggcggccgcttccagcagggcctgaaagaatgggttggctttggcacgatggaaagcagcagggctttcagattgggagaggggaggagaacctcgctagtccagcagggctcttgagtaggaaggggatggcctggtgtggggacacttttgattccttctgggctggaacccggagtcaccattgattcaggaacaagagagaaaggcccactctggccctcccctcattgcccctctctgacacagggcaaactggaccctagcaccctctccttgggaacctaggctagccctggggaggcagaggccttcggggcctgggagtagggaggcacctccctcttatcctggagaaagcccagcagaacaagaagagttgagcagggtagaaccaaggggtgcagtcgagggtgggcaccagaggagcctgggggctgtggcttcctatctgtgcatctctggcttcagtctccacgaggtcccttctgaggtgggtaacagaagcaggggtgtgtcaaggtgctaccacgagaatatatagataatccacccaagtctctctggaaaaaaaagttgctgatggccctgcagggtggcattttaaccttgtttgcaccttggtcaaacctgtttcccagataccctataaatgaaagcctcagggtaaggttgagaaaggtaagaagcctcaagctgacaggaagggagacagaaccagggtggaaaaagaaagcagtctcaggtaaactggggaagaaaggtgttgttcatggtcaacgttccatcctcactctctgggaccctctccccaagttagtgtcttggacacacctgtgcccacatcctttcccaccagtactctggagaattcatgtttaagttcatgaataccttcagtcaataacaaatattcattgcacactttcatgtgccagacttggtggcaggtactggggatataatgggaaacacacgaaagctgtcatagaacagtcaacggagtgggggagacaggcattaaccagatagtcatgctaatgaagcatagttacaaactagatgccaagagagaaaaggaatagacttctgtcaaagagtctaacaaaaggtcagaaaagccttcctggagaagttatatttgagctaaagaaatgagtctctagcactgaaattctaataatcagacccaggccaaaggtgatattttcagatagaagactttctgagtaaccactgaagccataccatgtaggtaattctcacacccctggaagtatctctaggccatgagtagccagcaggtcccaaaggggaggactgacagttttctgacaagaggaagagatgagtttgaagctcatggggtaactagtatttaatgtcatcctttgctaaaaatagtccatgacagtaggaaatgtgtaaaggctagccctggggaccagtgataaagtgggtatagcctgtgggaaggaaaatttgtttttgtaaattatttactgtaaaggaaaaagaaatggggggttgtctgggttttcttttccctttgcgggcttccttctgagttatgaatgcttctcattgtacagaggcagtggggcacagagcttcaggctgcactcctttctggggcccaaggtgtaaattttctgggctgcaaatatcagatatttgtccaggctgaaaaacagcctgaatgcagaaggggagggaggctagactttcttctgggaaggacaaataaactgatcaaggggccccaaagagtgttcatttgagagaggtagcctgtctctcaaatggtgggtatcacctgccctccacaatggcaaggcaggtgatagctaacagcccagtgtgatccaagggaatctgattgtgaagtgtcaggaaaaggccaacaggacttgtttagccaacaggaggcaaacatgagactctagggacctgtggtgcaaagctaaaggaactaagattattgatctacaagaagtttaagggtggggtggaaggtggtagagagcaagaagagaggtcagtcttcaaatataagaaaagtacaggtcgggcgcagtggctcacgcctgtaatcccagcacttcgggaggccaaggctggtggatcatgaggtcaagagttcgagaccagcctggccaacatggagaaaccctgtctctactaaaaatacaaaaattagctgggtgtggtggtgggcacttgtaatcccagatactcaggaggctgaggcagaagaattgcttgaactggggaggcggaggttgcagtgatccgagatcgtgccattgcactccagcctgggcaacaagagcaagactccatctcagaaaaaaaaaaaaaaaaaaaaaaaaagtacatgtgcaggtttttttttttttaaagcaaatataagaaaagtcacaactcagagatggtgactagctgtttcccaaccacactgggaagagaacaagaggaaacaggcctacattgtagcatgaagaattgagattagatagcagaaagaacttcctgactacaagcattcagaggaggtggacaaaattaccaagggatgttgtatgtagtttatacatatggggaagctgatgacagtagagataaagaattggataaaagtgtgagagtcctggttttataaggaccatggtcagaagtggacagacaggtggggaaagcaaaggggtcaggaccaggtgcttataagaaaaaagaaagtgtatgtgtgaaaggtgaaggtgttttcatgaaaatacttttataataaaaatgtcaatgaaatttccattggagataagtcagtaaaactagcatacattctcctgtaactggaatagtgtgggagaatggactgaggagctggtagggccccttctatcatccttcagctctcttgtctcctggataaattagtctcaagggggccccccatcttctacattttaacaattttagagcacactcctctgcagggggcattggagtaaggccgcccaccccaagtacttgttgcagaggagaatgttttcctcttcatgcacacaaacaagattagatataggggatacaaactgaatacaaggggtacagtggcgaacaacaaaccatgcaggatccctgccacaggaaacttacaatttggtggtggagacaggcatcaaatagtaattacacaaatagcaacatcattacaattgatggtaatgaaggaaaagtgcaggaagtcaggagaacacaggctaacgggacttcacccagaattagaaaatccacaaaagaaaattcattatgtaaagacatggggcactgcaagtgccccgctgtgagtgattcttgcccaaaaatcagtagcagaaaggcaaaatgaacccagtcactgctaatgccctaagatgtggattttgaagctcctccagctcactgaagccctgtcagattaggagcagggaaattttctcactgccaagatcaggcaggcttgatttaggcgagtgactctccaaaggtcataatggctcatcagctgaaaatcaggatcaggaagactgtgaagagctcatcacttgccaggtgtataggatcagctgaaaatcaggatcaggaagactgtgaagagctcatcacttgccaggtgtataggatggaggtcagtgaagagaagaaagaactaatgcgtgaaaattgcacttgaaattgacccccagcagtggccatgtctccaaaattctatgtcctccatctcctctttaaatgtgggaggctttcctggtatattctagtattagctgcaaggtgtgccccagggcctttgagcaggagcccagtcctggggagccaggatcctagagagatggggtcccagtctgtttttccctgtccctctttcagaggggcaggaagttctagcccttgtggggagctaggatgggcttctctgccctcacaaggccctggagaggccaccaaggagcagaggacattagccagtatgtgatcatgaagcacaggcgctttgcgtctaatagacaaccaccttggcaaatgacaatctctctagacctcagtttccaccactagaaattggtggtggtgtggttgggaaagtgaagtgagaggacactcctagaaagcactgagtgtctctttattagcattagccaagtcaaatgtggtaccagaacaaaaccttatctggctggccttgcctccctctctcacaaaatccttctctcaccagtcctcttcttgctctgtcactcacatacccttttctgctcagagccagatgacacctgaaacccagcctggcaagctttctccctgtcaaggcttgctctctcaactttcttcattcacacacaggtataaatgactgagaacacttctggtttcccttcttcagggaggggagagcagggaactgtgaagaactttgaaatttttaccagagatcaaaacccacagaaagcatgaagttgccctactggcattgatagcaactggggaagatctcagaggacaatgggcctggggacgttctcttcaagctcctgagcccctcccttttcagggttggtgaccacaccttgtacctccacgtgcatcttagatggagacacagaggctcagaactggtaggagttttctcagccatctgcctgaccctttcccattacagatgaggaaactgaggcccaatgtggggtgggtacctgccccaaaccaaacagccaattagtgaccagctgcaaagggaaaccatgtctcctgattttctgatccaatgatcttccgacttctcgtctctagacggctgtgcagcatcccatcccagtaggtacacaacatctccatgccaggagaccagctttgggtacacctgatgccaaaaatggtgatttttttaaatttgattttgtttaatagaattgaccaatgatttgggtgttatgaagctccagccctggaatcttgcttctgctcaggctggggctgcatgccacagccacagtcatgcaagggggacagaaaggcttgctgttcgggttggaaaagaaatcagttgctgaaacattggtctttttgaaagttccaaccacaggggctggctggcagagccgccgtctgggctctcccggaggatccggccctccccttcagtctgggagttagtttaggaagctggcccggtctcggcagaagatcccgagggcagcacttgccccaggagctccaggcttccctcagggcctgggagctcctgaagacactcaggaccgtgaatttcctcccgcccccacagccgagccagcccaggctggccctgaggctccttgagcactttttattctaagcctagagtttccagttgtcccaccctagcccggcagctacagagaaagggagagaacgcaggcaagagaggagagagccagagcgtgagagtgcactgtactaaaagaaaggagagaagcatccccagccaggtaatcaaggcttgggcagctgtgagatgaaggtggaaaggctggaggagccccagctcgtggaggaaccccaactcggggaggacccagagcttggggaggaggcacagttcctggaggagctacagctcgaggtggtagaaagtgggtcagatttggatccagaagatttgggttcgagtccagactttgccaccaatctgatgcttgagcttgagtaagtaactcctgcccttctgtgggctgctttgcctacttacaaaatgggggaggggagagacaagatggtctctagggtctctttcaacgcagatattctggaagactatgtttctaaagtcttgatatgtgagaatgggatgcatggaaacttgaatgaataagtcactgaaccccagaatgtcagaatggtattgggcagggagagggagttcacataagacaaaaaaaagagaatgagaaggtagtacctggataagagtcatgaccccaagagggggtcccagctgaacagaacattgaggtcgattttcaaaactcaaggatgggccgggcacagtggctcacgtctgtaatcccagcactttaggaggccaaggcgggtggaccacctgaagtcaggagtttgatgaaacctgtctctactaaaaaagaaaatgcaacaactagccaggcgtggtggcctgtacctgtaatcccagctacttgggaggctgaggcaagagaatcacttgaaccccggaggcggaggttgcagtgagccgagactgcgccactgcactccagcctgtgcgacagagcgagactccatctcaaaaaaagaaaaaaaaaaatcaaggatgatgggcttggaacggattagtaacaagaatctgggtgtttggaggtgtcattaatgtgcagttgttaataagctccttaaccacatgtctcccagtgatcccatgtgccccaaaatgccagcactgaacgcacaatgcatttcttgagttctttacgtgtgtgtttgcagaaattctctattgaattgtgagggattttcagatagtgatgtccagatctaaaaagcgaatctacaaagagagactggtctggccctctttctgaaaacctcctttcttggtaaatccccactctcaccaggcccactgttgcatgactcagtgcaggtccctttgagaatctgactgctgctatatacagctactctcccccaaataatgcacagatgagctaccaaaagccaatctgcttggtgggtgttgatatctggtacatttcactgcattaaaattccatcaaaatcagtcatccctctctggattacatggtgagagtctcttaagccataacaggtgacgttccattaaccagagagtgcctttccaggccaggcatgatatctcagggctccctatatcacagatcatctacaatgtgctccgccaaccacataaccaccagtatctacactgctgggcaaagtgtgatggtgagagtgagtagacgaagaacctccctccacctgtccagacacctgcccacagccctagtgtgctcactactgcacagtctcctccctccctgctagccctccttcttcttggctctgttcattctttcaacaataatttcttgggtgacttctggccactcagttaatcttttgttgttgttttgtttgtttgagacagggtcttgctttgtcacccaggctggagtgcagtggtgcaatctcagatcactgcagcctccacctcccgggctcaagcagcttccccagtagctgggactgtgcatcacaacacctggctaatttttttgtgtgtattttttgtagagacagagtttcaccatgttgcccaggctggaagttaatcttaatcaattatagattcctaaaggaggggctcttagaattccctcaggacaatggttttcaaagaacccttagggtcctccttggcgccttaggggctgtgggaacgggaggggaaagggggaaagggaagagagtgtggggtaagagagcagaggcaagggtgaatatgagggagggaaggggagggggagagtgtgtggaggacaaaaagaaagaggagaggtagattgtgccacagccctcaccaaatatgggctacatctggaaacaaggttgcaaataagaatctatatgtttcttttaaagtttgtagtgttttgttcatcacctggcttgtatctcctcaccagagaattttcaagctaagttcctcctaactagaaggcatctccaagtgggtgatggatgttcaggggagacctgtgggctgggtgggtggagctcctggcctcagccctgcctccctcagagcagttccactcctttaaggactctgtatccagagaccctgtgacctcccacattagaccggggagtggggtagggattagggatgattatctgttaaacaacaacaacaaaatatgttgtaagccacagaaggatgttaacttcccagctgctacaagaatctcttctaaagcactcccagagggtggacacgctgcctcagctcgaaggcaatctacatacaagccacttcccttgttggttggccctgattgttagactgtccgtctgtttagtcaaaatcagcacacatcttgcccacagaatgctttggtccctcctctcttgttcccactgaaggcctcttttgtctcctgaacaccggggaacagattctagaaggagaggagtggcccctggcttccccgggaagactgagttcccagctgggggcaccacgtgctccaaggggcctatgtgagctctgcgtggacaggcaggttactgatgtgggcatggggcactccagctgatgcagcccctggggctaaagcagaggaagtccactccacagagggcactggtcgacttgagtgaagtccagtgtggaattctcggcaagggaaatagctcgagggaaggaacacttgaccaggaataagggccttgtgttctgttgcaaaccccagccttggctggggctgtcacctgaaaggagaaaaataataacggccggtgccctggccctgagaggaaggagggagggaggcaggctcaggactgtatcctggccatttgcagcagtctaaagcccagcccgctttacattggagaaggaaataaagccgtgcttgttggcggtggggaccatctgtgtgcactatacagagagcactgtttccccaaatgtggtaaacatacactggtggtgtgcaagatgattttaggtggtacgtggactaactttgtttttctatttttatagctatttatttatttaacatgtattgggggaatatacagctaacacatccactccatggtctcaaaaaatattatttctaaggatgaggcatttcttaaaaagggaatctgcttaaagttaatttacagtaaatattaagtaaacaacaatactcagatatggcaaaaaatcttgatagtggtagacaagtaacggtagacaagtaactggagtcaagaacatgctactacactgtgtgttagcagacgtgtgacatgtgacaagaggggccagaagatatgtaacaggagccgtacagtatggtttgagatggtcttttccatgtatacctagcttgaagtccccctctgacagccttcttccaagtgtaagagcaacctgctatttttatatccccagtgtcctgctctgccccatgacactcaacactccagattagcagcaggcctttcccttggttgaaagcactgtctctaccacgttcctggcagacatggggaaataggcactggagaattgctgggtctgtcctcaccagcctccattgatttcttcttggcattgttcacgggctttattcaacccaaattaagggaggtatttccaggaagcaagtcaagaggttataatatttctctgaatgcacaaagtcacagtagaaggacaggaaatatgtcactgtggcaatttcacatggacttgctctgatttcctgacagattcggataagatttggtgggaaatgtgtacgaaatcagactatacaagagagttcccacttctaccaggagtttatgataggctgcgtgtaaatatgtttggtccacttctttccattccctgtgatacaaaacatgattattagtcctgcttcctcctagggctcaccttgtggatttcacgaaggcaagccctggagagaagcagaaagacgatgaaggttctgggtctggtctcctgccttctgtctgggttacacctcaggagccttgtgtgtctttcctatgttggccagtcccttgaacagtttttagcaaaagcctcaagcagagacagttgatcttcaaacacctccaagaaaggaaataccacaaagtcctttgttcatacattccagtgtttaacaacttctgctctctgacattattcctcctaattctgtcctccagctttcctatgcttaataaatttaatatgcttaaattgtagttatcccatcccttgtcggtcttactttccaaattagctaaatccatttttttaaagaaaaaagtttgaactttcatttctccatcttttagataatgtccaagttatccaccagagatttcattctgtcctctgtaacagctgagattgtggcatgaaaacctttgcccttagccagtcacccaaatccatcctctgatcagtgacacacatttgcaagatagcaggttaggaaaggagcaaaattaacccatttaggcctggtgttccattattggaacgctaagcttgtgggagttatttatatcctactgctcaaggttatcgccaaggtctgatttttcacgaaaaaaaatttgcaatctctgtcataaatgggttaactgaactgcagaggacgcaatcacctgccctaacccccaagctagctgttttacaggaaactgtagctgtgtaagatttcattagtggccaatgaccatggaatagagaaggaagacgacttcatagttcctacaagcttctttcctatttagagcatccagggtcatgcttgttccttaatgatactaaattgtgtgctagcaactcattgcagcctctgctcttagctgcctacccacatagccccattcttgtatctgggtagagttttgattattcctatattcattatccattttgtggattatctatagcaatcacaaaattccaggctgccccccaccgaccttctagctagtttctgggaactctggggtgcaggatcactttgataccagcccaagtagtgcataaagaaagttttttcaaaaataaattacccactcacaaatggattccaaatccaagtatggctgagtttcacatggctagggtaacataggacatgtggcatggataatccaaaataagagataatgtaggagaaacatcatgtctagctagctttgaaattgcaccatgataggccaggcgcggtggctcacgcttgtaatcccagcatttgagaggccgaggtgggaagatcatgaggtcaagagttcgagaccagcatggccaacatagtgaaatccccgtctctactaaaaatacaaaaaaaaattagctaggcgtggtggcacgcttctgtaatcccagctactcgggaggctgagacaggagaatcacttgaacctgggaggcggaggttgcagtgagccaagatctcactactgcactccagcctgggcaacagagtaagactccgtcttaaaaaaaaaaaaaaaaggaagaaagaaattgcaccatgggtctaacttttttcagtagatctgccttcttaattatttgggctgatatgaaaataagcttgcacccctggagtatacagaaactagaagaaactggatgtagggagaagctaagctgagaccaagcattgccactgctatttcacaaaatggaaaagccacctagaaatacttgggagttgattttcaagcatactgaagtcatttctgtgtgtctttgaaatatgtcatatggttgtggatgctgtggatttgtccatgaagacctaaggggtctgcgtaatggtacctagtttgacttggggagacagatccaaggagttaccaggaaatcgatagttcccttcttcttcctaactataacctgatggctgtatcacaatgcctggtctgatcgtctgacccatgtgagtctgaaagtggtggcgcaattcatctgaggaaaatcacatctgaaacaggaaggggcacggcagcctcttcagccaaggatttatgtatctgtcacaggagggaagtgtgagctgagaaatgactcccagaagtgctagaattggaagaggcagcactgctacctatcatagtcagcagtgtattcatggggaatctatgctacctcaggaggccagcatcctggcccttcctcccttccctgagtccatcctccctcctctctcctctctggctcagcaagcacttaagaaaacagagctgagctagccaggtgcaccctgtcagtggccaagcagtaggtaaagggaaggataggagaggcttgtactgctcctggcctggcatttagaggcccaggggacaagtcccaggcccttgagccagccacagtaggcttgcagctgatgccatgtcaccatggctgaagctagtggcaacctgagtggatggggcttctctggttcctgcagcccacagagaccaacaaattcactcagttgggttctgtctagacttaattcttgctgtctttgtgaattgatttttacattctggcctgctgtgcgtatcttggctatgggatctcttgctgagcctgggacagagtcttttcttcctgccccttctcctctgcaaggctgccggaccagctcccttggcaacctcattaggctccagtggtgtccgtggggaatctaaactgggcagcagtgatccatctttagggctctcatccatccaggtggctcctaacctctccaacgcaaagggactccagctgaaaaatcaaaaccagccttctttgggagccccactcattgtttgagacaggctacgagaaagtccacacctccaggcatagctctttgtgcttcccttccttgttctttgtctccagggcaggaagcttggccaaggaggcagatcaccccccaactcaccacccataacaaagaactaatgactgttttcaccattcccctcctctggaagcaagggatgggtcatgccaggccttgaagttgagtagggaaagtgaatcccacccaggctccagacctggttcctcctcaccagcacaaagtccctgtattacgagggaagaggttagtatgaattctggataaatgcctcagtctggagaggagattgtgtctcccttgttgtaaacctagctgccaaatcagaaccactttcagcttggatagaggaatcaagctcatccctcagaaaacagatggtgaacagtgtaggctttgtttttcatactcccttttctcactccttctcccttctagcacaagctcttcatgctaccccccgccgctgcttaggactctcaactataggatgatagctcatgttccaaaactttcctgatctcctgcctcttaaccatggccttgaggccttactttctgctaatgcgaatgtgatatgatgaatccagctgaggtgtaaacagcttgtagtaactgaatgtgctccccttcccaagttgcaattttatttaaacctgggccttcaaaaggagtaagcaaagtgaggatttcaggctcagcctagggcaagtagagttgagttttggggcatggtgcctttgacctttatcccctcaaatcataccacgcaggcagccaccctgtccatctatgtgtaaggccatccctgaaaatctggttgacttaagtagagggaactgagaaaatcttgtctaggtgaagtccccagtttagcctgcagagcagtagctgaattctacctaggcctaggcctctggtccctcccctgaccagccaggcaggcacttacggaagatgtagggaagaaactggaaatcctccctcgtgcatacctgactcagttgactttttaaatatttgagaacacaagcatgaggcaattacttgtaatagcaaaaccattctcggttaaagggaggaactccaaccacttacagagtaagggttacagtccttccgaatggtctgttgaaaagctatttttggctcatttgctcttctttcttccttgagttctgttcccctctaggcccctcaggagcctctctccccacctccttcccggtgtctgtactcacacagcttacgcaggggaagtaacccctcgccaagtgattctctcatccaacacattttccgagatggtcccattgctcctttgcagaagaaaggggacaaagactgtctgggtcaacataacgacctcttcccctccacccaagcacaccggaattccaaatgctcttgtttccttcgagcacaaatggcttttgctgctgatcctctgctctgggttacccatttcctgctcagccttggcacagcaaacatgtctctggagcagctacctcagggtaatttgagaagtagctctaggccatcacatgtggaaaaggaatcaggggaagacacatgtggaataagaatctccttgagaaagatgctgggcttttgtaaatggctttaataatatagaaataccagcagcagatgtttccagaatgccagcataatttactctaaggtgaccttagaattatgattctatcctcccagtttccatgactttaacaaaatccctgacactgtgccgtctgcctcagggagtcagctactgcccatctcctggctatgtgaaagtcttgggcatacatacccctatccagcttggagcctccaataagtacctacctgcggtatctgatcagtttctgcctagtcagatgtgccctgttgctgagcctgcttgggtggggagcatgggaaaatggggcaagtgcttcatgagggagctgttctcagccgccccctctcccaactccccagctctctctccttgttctgtctcctgtttctgggctctaatcctggtcaggcccaatgccccttgcctgtgatgctgggtctgcagttttgctcgccgtcctcgctttgccttcttgcccgccacttccagcattcctcctctgctcagcttctgagctggtgtcaggtttctacctgcctggccactgagcccacctgaagatgtctggccaattccttttagcctctgccttctcaccatgccagggatgcttattcatggtgggaccacaggtggaaggtgctgcttcagcagactcaccctagggagcaactgctccccactccgccacaccaccaaaaaaaaaaaaaaaactaagcgagaaagcaggagtattgctcacatccacttggcccacagctttgtttaacccgtttctgaatccacatttttattattatgttgctatgttgcccaggctggagtacagtggctattcacaggtgcagtcatagcatacaataacatcgaactcctgggctcaagcaatcctcctgcctcagcctcccaaatagctgggactacaggcacatgccaccatgccccccttggatccacatttttaataggccttccagtaccgattgctaaagctgcaaccccattctagggtaaccggaggatgtaggcctgttgtggggagactcgatgaagctgctgagtaggtaactctgtctgcctttgtatagcattctctccctccttttctgtgccctgcaccccaactcctccagcgtcgaggctgtggctgccccctggagatgcttgggagcaccaggtgttaagcaagggctcctgctcaacactcccaattacagtgtgtgccactggagtgatctcaaggacaagtggaggattcagccagtgggaccccatgcccatcaccccaacttcaccctgagtagctctgcttttgtctgttttataaattggattttctatgtgatattctattttaaatctgccaagcatggtggctcatgcctgtaatcccagtgctttgggaggccaaagtgggagggtcacttgaagccagaagttcaagatcagtttgagcaacttggcaagaccctgtttctaaaaaaaaaaaatcactactctaggcctttctctctccatatcagaattaaccacctcctgtcctcctgtcttttacttttcttttcttttctttttttgagacagagtctcgctctgtcacccaggctggagtgcaatggtgtgatctcagcttactgcaacatctgcctcccaggttcaatcaatctcctgcctcagctcctgagtagctgggattacaggtgcctaccactacgcccggctaatttgtgtgtgtgtgtgtgtgtgtgtgtgtgtgtgtgtgtgtgtgtgtgtatttttagtagagacagggtttcaccatgttggccaggctggtcttgaactcctgacatcaggtgatacaaccgcttcggcctcccaaaatgctgggatcacaggcatgagccaccgcacctgacctgtcctgtccttttctcctcttccctctggctctgccctctgctagcagacggggtccagtaggggaggatgctaagcaaataactgtccctactacaagctggctataggctggcaatgccaatgcctttacccaattaagatggtaagcaaagcagacaggttggcactctgcttctcacatcatgtggctgcctccccacccatcattaataataatccctcgcatttgcatagcacttgacaatttctaaagcactttcacagactctatcttatttgatcctctggaaagcctgtgaaggccgccagggcaggggctgttatttacattttacagactcgggagactcttgagatcatttaatcgctggcctttctgaagagtttgctaagagaactagtcggtgtgagctgatgggctggttaaagggaacaagagttggaacaagggttataaaaggaatgaaaggggagggagatgaggcagaagggaggaagatcccaccgtgccccagatccaccagccttatttgtgaaccatttcagaagcagtatggaactttgggaagggctgacccaaggaggcagcgatttttccttctccatgatggtgacttctggggcttctgagctgaccactggccctaccttatctcatccccacgccacaaatctgatcttgtcacacagctcacttgagtctcatttcattctgaggagcagaatttcaagtgctagaattggaaaggctcatagagattatctagtccagcccctcattttccagaagtggaaatagaagcccagagatagaaaaagtcttgcccaaggtcacacggagaagaagcagagttggattgaaattcctgtctcttgacttgcagcccattgagttttccactatttacatacagctccctccatgtatgtgcatgtgtgaaggggtgtgtccaggggtgtgtgtgcaggggtgtgaagaaggccgtgggcagtgcctggaatgcctatctggtgaactgctgtggcctggaccttggacacatatgcagtggctgagagttaaagccacttatagggcctggggtatgatagggtatgagaaagacagggttcagggtttctctcccaaggggattcacccacataaactgctccaggtaattaagatcccagaagaattggcagctgcttgctgaacaaattagaatctgcctttatgggcatgttctgtgctggagatcagagggccctccctgatgtttggttcattagtcattgttccctgtcagagcaagcactcagaaaattggatgtctggcaacagcctgtatttagaaattcaatagcagagcagcaacggcaacagccgagtgtctgggacagtgctccatgcacagtaggtgcttgaaaaatgcttgttagctaactaatgaactaagtaaagaaagcctttagtcctctgtgctattcagaatgaaacagtgtcaataacagatctgattgcttttcagccaagccacatttgaactttttaatgggcaggctagcgggactgggtaaaaactcactggtcgctaggttttctgtgcacactgcactgcgtagatcacagtgcccaccacttagatgtcacactacattctgcttagatctgacagacccacttctctttctaagcttccccatgacttccttctagtcaaatccaaaagtccttttcccagttttaggagtctttggccagaacagagtaagcctggcaggggacaagatgtggtcccagggcgtgtgtgataagggggactaagcaagctgcaagaggacacacaatggagtgggctttcacgtcaacttttctttcttcaccatcttgccgcaggccaggcctgctaatttggacagatactttcatattgttcttaaccatcagggaaagattttgtttttgttttgtttcttatactaaatgttcttagtttggaatacccaagattccttgcaaaggtcagctagcatagcaggactaagagaatcttagaagcttttggcagtcactaaaggttaccactggtgtcttgtctataggccaagggagtgaactctgtgagggatttcaaatgtccttgatggacttttccatcatgctaagaaacattggaaaaagtatttatccagttcacctagctgtccagtcactccttcaaatgtaatccaccaagtaagaaagaacaaagaatgtattgagcgcagactccttttgcctttgttgggaaggaggacacacatgaatgtgtgtatgtgtaactccgtacatatgtcaggacttgagtgggtggaagggacttgaggagtgatgagggtgtacgtaaaaaaacagctgttatgctgtatgcaaaaaaggtatggaaaaatgtatggtaaatatacttatgggggcctacctgtgtttgtgaagggacagctggaagtatagcatctgggagggttggtgttcttctgtgtgtgactctatctgagtcaaatcctgtatatggaagtagtactcctggagagtcaggatgaccaaggcatatgtgaaggaggtatgtgtgcctgcctgtgtgtgcatgcatgagtgtgtgtgtatgtctgtgtgtgtgtgtctgtctgtcttgtctgtctagtgagagtgtatatgtctggactgtcctcaatcttgggcctgcctgggagaaccgtcttggcccctcttcccttttctgcactcccagacctccttagttctttgcctctgcttcttccttcttagggagatattttgtaccatgtgtccctcctttctctgtttcataagatacagagagaggtgccccctctcccaggccacctgcagtctcttccaacaaagcgggggtgactccaccagtgagaattgcagggctcaatgattgggaaacaatctccaagccaatgaaatgtctgcctaaagattgttcttggatcaatgggaatcctgtgggtcacacttggacagtttaacatcatcaagaaatgtaatatagatattcaatcctagaattttggtgaattaattaaagccttgtttttagttctattgagaaggaaaatcatttattttctttactctgaccctgtgccttcaagagaactcttattctgtgaaaataagggctgaggtaggcaattcacacatacttgtgaaatctaagcagattatctcaccagtggctataactgtaataaactaaagtgaccttggtttaaacaaacggatgtttggagctgacaattgaagtgcaaacatgaccctaattaatgacttggttaatagtaagtggttctctctttcaagatattagctaaattctcagtcttcagctataatataggtcgcaggctacttttgtattcttcatgttagaaatttaaaatttcaagctagtcagtctgtaaagcaacttgcaaagcaggagagaagtacaaactagagacagttctgatttgaagggtattttaggtaaagtattcctaattattcacagctcccatccataaatgtgtgtccaccaccaaaaccagtccccttgtatcttctcataggtaaacccataaacaaggtatatgctaatacacattaatgaacaaacatgatatctagtttcaagtgatttcctatcagtaactctctttggatctgatgtagtcaagtggccagattcggggagactgccacttctggaaaggaacctagaaatcagcctaaaatcctcttgccaaagagatggatgaaacagaggagaggatgctgggatggaatggaatgtccagctcctaggcttaatggctgcttgatgtgaggcaccccacccttgtcccaactacttatttgttatttcatcaagatgggacagggagggggtggttaagtcaactcacatgctggctttgggtggccctcccttcaagaatagctctttctttgctgcaacggatacatccagctgcagatttccgtcatcactggatgcactttgcagatgaattcagaaattatactggcctccccaattgttattactgagttgaaaaagcaccattgagaccatcttcttgcccacacaactgtactgggtgccacaggagaagggaggaggggagcataaaaagaacaccaaaagcctgcttcccacccttcagaagctttgggtcaagttagagagatgggatatacatggaaaaaatcactcaagaacaattataaaggaatacatccacaggagcaaaatagcacaaaccaaaatatcctataaaatgatgggctctggctttaggaggaattaggtggcagttgcaactgtctggaatcttggtgcagaatttcatgtgtggaaggccaaagaagaccttgttctaagtgtttcatgtgtatcacagtcattaacaagaacaagaataaaagtggttagaataggtttcacagcatgtgtgtaagtatggaaagtagtaggcacagttttctttgatgctgagcttttttttaatttaaatttaaattttttttatttttttgaaacggagtctcactgtatcacccaggctggagtgcagtggcatggtctcggctcactgcaacctctgcctcctgggctcaagcaatccgcccgcctcaacctcccaaaatgctgggattacaggtgtgagccaccgcacccagcctgagctctttattttaatggattttctcccagatatccaggtcaccctatctcagaacatagtgtgctatttccacactggctatagtgaagggttagcggctggcagtattggaaggttggccatgtcagagagggcagggcagcagtaccagtggcttcagcttcagccctggcccatggcttgagcatgtattaaatcgatcgacctgattgatttaattttggcctgggcatacctgggtcagcttagtgaaccttaccatctacctacagtctggccacggagtaggcttaaatgttaagaaagtttcccatggcttatcaccttctcaaagctggtgggcactcccacccacccacttctcttgcacttatttcaggctacacacttgggcctcaagtggagtattactacatctggactgggaaggagcaaggtgggatctgaatcccaaaggagtggtaaaggctacagacctgggtttgttcccctgttgattcccccctcacccacaaccagtggaaaaactagggccatgcttcccctcccttccagagcttgagccctgggtaggaagagcactctagaaagaatgagggcagggaagagcaaaggtcttcaatccagctcaggcttgacatcgagccctacatgtgatgcccacctggcccagcagtgtcaacaggcatgtctattgacaagtaaaggggtctagagtgctccctgcaccacacaagcatcctggccatcctcagctcacaaatccaactctggagccaggactactgcttctggggcccgaaatacctgcttgggcctcaggttggtatatcttctttcaaccatggctaggacctggaagtgtttggggaagtaccttgacttctactgccagttcttctgctagccagcaaaagtctcttcctcactgtgggcctcagtttccccatatgtaagatgaaagggtcagactagatgatcgcccttctggctctgctgtctgttctgtgagtctagcgccctccctttcttcatgaggtaaatacttttgttgggggtatggggggttgtttggaacaagggacgtttgaggccttccagtgtggaagctggtgcaaagttcccaggctgtgtttgtcgttgtgccgccttttcttcttcggaactggcttctcccgtagctcagggccaagggccgctctggttccagccttggatgggcgtggtggggcagcgggtcagacggggcagtgtccagggctatcctggcagcctgggctggcagggggaagttctgtcgcttctgctcgtgtttcccacccggccacagggccctctccctgggcggcctcaccactgactctgggaggtcgcctcccaaccacaggtgctgtggggctggcagcctgtgggaacgggcgctgctctcggggctcccgaggagcagggatctctcgcggatgatgtgaagagcccatactgatcccagggcgggatcaggttcccctcaggaatctgggaaactcgcagggaggacgtgcgtgggctggttaaactgtctggggtctggggccgttgggtcattggactgtaaatgcagggagggggcaggcagacttgccatattacaggctctggtccctgcaagggaccttggatgccttcaagtccccttgctccttttatgaaggagggtgaagggggagagacggacttccacaaagccagaagaccagcgggcagagaggcttgttgttctgtgtgatcttgtgacatggggactccctctatttcccaggccttccagggaagcattagtgagctgaaaggagcctcggcggggagaacagtggtgatgtgccacacagaaggcagcatcaaccacaacaaacaagcagagcctctcagacacacacaactcagtctctctccctctctctctttctctctctctccctccctcccccgctccctccccccttcctaaacaccgcgcgcgcgcgcacacacactctctctctctctctctctctctctctctctctctctttctctctctctctctctctcaaatacatgtgcctgaaagtatatgctgagacttaactgcacacccgtcccaagccctttaacatggctctgtggcactgactttctgtgaaggcacccggaagcccagcccacatcacctgctggtgcaacttcactttgccgaggtgttgggggagggacaaggttccttgggaggggaggggccttttctaaagcttaaaaaaaggaaagaaagaaaacaaagcaaggctgaagtcctcccacaggcaggctcgtgctccgggtgtgctttcgcaggccagaaactacagaactgggagtactgccaagtgctttatcaaaggaaacagcccgcccaacagctggagatgggctcttgccagctgtgtgtgcctctcagtctctccttctccttttctctccccttttcctatctccatccatccatctcctgcagccttgcactttgcactgggctagccctacagacagaattccttggaccacagagagtacccttgatgctgagcaagtgagcagattgctgccccagctggattggaggaggccgttcttgcaaagggatgtgttacccatgagttggtctccaggcactgagcaaggggctgctgcgttgtgggcgcttctgctgcagctagagccttaggaagatacagtccaatagtttctccttagcctcctttcgcccatggtgggaggcgggtgcctggctgcgctgtgtgtgttggcggcaacagggtgttttccagcaacctcagcaactttgccatccatattcattaattagttaatgacttggattcatttctctaagccttgggcttcccagagtgggaggagacaatgtgggagtgggggagagctctgaggaaagttgttctccccttgctggggtgtggttgagggggcttcactgccacacactaagaaagaaagggaaagggggatctacggtggcttcgccccttctcccagtcctcactcatttcaggctcccaatttgccagctaaagtggccagcatagccccaaaaggcagctctgagctgcgtttgtagaagcaaccccagggagaaagatgccagtggggctgcctagttctgtgagtggcagtgctgagttctgggagctgaaggcaacaacctcatccctgaggaggtctaggggcttcattctcttccctaaccatagcccacacctcagtagacccctggagatggcttaggcaaacctaacatctcccctgccagcctggccacacctcaagggcaggatccttgtgatgttcatctccctactcccaatgcctgtcatgtgcttggggcttaagtaatgtctggtgacccggactctggggaaactcactttaaagcttgggtcttaccaagtgggaggcagtaacttggtctgtgtgtatttcccaaggttgccatgttgagcttattcattctttagcagagtttggctgaatgagtaccagtgaaatggcagacaccagttttggttgctatgggggttaccaagagggacaaggccacaaacttagataatcttagcttctggcatctgctgggcactctgctgcccatcctccctctgttgtacacccactctttcaccgtcatggttcttcaacctcagccaagctcttggatcttctctctctcttttttttttttagactgagtcttgctctgtcgccaggctggagtgcagtggcacgatcttggctcactgcaacctccgcctcccgggttcaagcgattctcctgcctcagcctcccgagcagatgggactacaggcgtgtgccaccaggcccagctaatttttgtattgttggtagagacggggtttcaccatgttggccatcatggtctcgatctcttgacctcgtgatccgcccgcctcggcctcccaaagtgctgggattacagacgtgagccaccatgcccagcacgatctctcttactgttctttccttccctgaggcttcttctacaaatgggcatgctcatatgcttagtcacaagtggccctgaagcgtaatgagctcaggctttggagccagccagacctcaatttgaatccctagtcagccactttctctacccggtatgactttgggtaagttactttgcctctctgagcctcagatttcccctctgcaaactggaagtgatacatacaatattgacctcctgagtctggagaaagttgattgagataacatatatactgtatatgaagtgctttgagccacgttttgcacaaagcaggtgctcaatgactgttagctgctggtattcattcccattgcccagtgtatgtgtgatgatcaatcgtgtcgatcacacaccactgggctgataggactgactatgtgatcaaccatagacagatcaaagaccccaagcgggacactaagaagacacttcagtaattatgtgtgtccagccctggcagttacaaacctgggtggaatgaggtgcagaagtcaagagcctgaggcagagctgaacccattatccctgattttgtccctcccagatagggcttcccctcaggccatgggacagactagactggcccttgggcatggggctaaataaatgtcttctgggaagctccacctaccacacaacttctccagactctggcttcctggcttccctcatgtggggtcttctttttctcacctgtgaacctcacctatgctccaacacgcatgcccttgccacagtttccccagcgtgtgtgtggtcaaccttgagtatatctggaaggaccaggccaggactggaaaggaccatttttatcacagcccatttatgaccatctccctgaaagggtgcatgtgtgtgtgtgcacgcgcctgtgtgtgcgtgtgtgcgtgtggagcctgcagcattgaagtgccagttaaccttgtgacatcaagattcctcattcctagtccatatacccattgcttcaccttccctcagcagcagcttctgagctctgggtagtcaggaggatgctgacgtgggcatttccacgatttgtgatgtaggtcttcacgaatggaggtttgtggggcttgccccctccagttcccttggaagggcacttccgatggttggcaccagcagcatgtcagctgcagggagcaaatggtgtaagggaagagagtccaggtcttctttggctacgactgattccttatttcctctcctttcccagtttgggagcatttgttgctgtctgaagggccgggcagtgccaagaccacaataaacagcttgtccggtacacacaagctctttggaccctgaaatgtcagctggccaactggctcacagctagcccctgctgcgtgccgtttgcatccggctctgacaatgccactcagcacttgtagaaccatgtgtcatggcaacaagggtgggggtggggggaccccacagtgaccgggccctagctctgggaagccaagctcatgggccacacttagagcccctggtaaaaattactgccttaaggactcagctctgctggtcccagaccagcagagtagcctgttctccccctccctttacctaggtctggccccatgggcagcagaaggccagactccctatgccccatatggctgaactgccaactggtgttgaatagaaacatctcgcccatgaaaactagtggggtgtggggcatgtgcctccaggaggtgcagactgggcacaaagggcaagagaggagagggagcggcagcggggtctggtggcaagagtgccaggccaggatccaggaaacctgggctgtgctcccagcctctaccaccaactcccttggcgtccttgagcaagatcacccagagggcagggttgggggagcaggcacagggccaagaccttgcctaggagaagatgagctgcaaaattttgttcatgcattcaagaggtagggatggggtgtttaaccaggaaaactctccgctgaaaagctacctaattgcctttaaatgctttagatgtgtcttgaccagcaagggaaccaaactcaggtgcccaggggacatatcagaaaagacggggctgcttctcccaaaatgcctgtcccttgacttgcttgggaggccaacaggcagtgatccctgctgctaggaccaagaccagaggacacagttgtttcttagctatggaaagccctggaattgtcctcacttctgccccttgcagccagccaggacaacttatctgggatgtagtgtttgttcctggtcgtaggagttcatatggaaagggcatctctcagctcaccaccccaggcacccatgcatcaatatcccagtgtccagggacccacacgatggcacacacttattcccaggacctaaattcacatctctttgctgagctttctctgcctggtagcaacaaatctgccattgatctggccctgttttctcaatgggaactcatggggtgcaatggtctttgatagcacaaaacacgttgagaaaagctaccagtgtctgacacaaagtaggggctcaataaatttttgtcaaatgaatccaggttggaatcaactcacaatactttcatatgaaggacttcatttaatgggagaaagtacaggctgtgcagtaggaccagtttgggagcaggaagaagcctgtttgaaaaaaaagaaaaaaagcagcatggaggcagccaccctctttgtgcacggagggaaggtagaatatacccatggtgtgtagtggggaggatgtctgggaaaagggccaacatccactccagtctgagagcctcagacacttcccagtgcaggaagaccccatggtggtgtctaattggctttctggttgttctcttacttagcgaaacccctgtgtgacaaagctgggacagggttgagcttccagaatctctactggagttttgagtagctcctggttatttccaaccaggtgccagttgccagggagggccttgaatctgaataacattgcctgggggaataaggagggacttggccaggatcttcacaagtcatttatacctcagcatgccccttgtcccccattggtccaggggccctgggagccgtggtctggcctttgcaacttcccttgctggattcctgtgttgtctgtgccttcacagcagggtgggtgagagagaccggcccaggaggaaaaaacaaacaaaggaaaggtctctgggtctgttgacgttataagtgctattgattttccaagatttttccattgagaggacagttaactgacctcgttttgcagcccatttgggctttgacgccactctctaggccatgaactgagaattggagaggctatgactttatctcaacacatacttgatagtcaccgccctcagcaaggccaaattgggcttcccggggtgggatgtgagaggatgtgggtggttccaggcctctcagctccttctacttttccccagggacattgtgtgaccctgggcccaagcactctcagatcttgctggatctggtcatgcctggaagggggcttttcaagcaagaacggccataaaaatcgagcacagaccgaaagacgatggttggaagagctctgaactaggagctggtgacttggccttgcatcccaggtgtgccactaattagctgtgtgatttcaggcactctgttttccctctcctggtctcagttttctcgtctgttaagtgataggtagaggtcccttccagttctaaaatccagcaggcttgttaagaaaaatgcagacgttaggaatgaggagaagaatataaagaagagagaaagggacaagattgtaaaattccacgacagcacagaaggggaaaatggggagagaaagagaggtgtgctgcattgtggtgtagtgggagtggccccaagtggaggcttggagaccaagatcctgttcccaattctatcactaatgagctgtgtgaccttaggcaggtcacttccctcctctgtacctcattcaagtgagaggaatgagttagccccttaccactcaggctgctttgttgttgggaaaactagatacacacatagcaaacaattagagaacagaatcagtgctcagaggtgtgtcatggaaaagaggtacacttggagaaggggatggtgacggtggctggcgagccaaggcctaaagggcaagggagcagagtaaaagagcagaggctctggaattacacaggcctggttagagtattggctctgtccctacctgtctgtgtgaccttgggcaagtcattggctctacccaaatttcagtttcctcaccccaaaaaagcagggaattgaactagttcatcttcagagttcctttcatctctttgaatatgtaaaaaaacaaaacacaacaaaaagaagccagaggatgccaagtaagctaaaggggagaattgtgcattcagggaagaagccaactcgttggtatgggtcagctacttatgtcaggagtgaagaagaatggcattctgagagcaatagtcagctgggggggcgggtgctgaggggaagaaggagaaggggaaggaaaaagcaaggcaaggtcatctcagaggggtgattggaaaggacattaacgcatgttcagtgagagagggtttggttggagggcatgccagtgaggagccgtcgcctggcatggaggtcttacttggtcctggaatcaaatgctgagggtggtggtgaatgctacagcagactcatgatctccaagtagaaggtggggagctgaaatgctttcaaattgccaggccttcttccactggggagagtgagatcaagggcccatcactaagtctttgatactcttgcattttatacatcactgatccctgcccaggaccaagaatagcgtctgaacaggtgtggaaaccaaggccctgagaggggattcaacctgccttgggtcacatgacaattttatggcaggaccaggggcaaagttggtctttctcctgattcagagcccagtactcttgtgtggctcctgccccatccgttggatgctattaagcaaatccctcattggaatgttggcctcttagggagaaaaaatggagtgaaaaaaaaaaccccaacaatttcaagtaactaaggctccaagggccttgagaggccaaactgtggcggatggtgcctggtgagcccttcagcaacaggacccatgtttgtggcaaggacagtgagggtcgggtaagggggaagagtgtgggtcctagagtcaactggatcctcaaatcccagctctagctgtgtgaccttgggctggttacaacctctatgaggttctgcttcctcatctgtcatctgcaatttttttttttttttttttttttttttttacgtagagttgtgaacaatagataaaataatgcgtgaaaagtgcttggcacagtgcctggtatataataaactctcaataagtagtagctattattattgttattactcttaccattactggtaaaaaaaaatgtgacaatttatgatctttcttgccaacctgccacttccctcttccctcacttgcttcagagtcttcacattcacctgcctgaggcttggtcccccaagaccacatttttcacctccattacaggaccagcttccccagatggcctctccagagagttccatctcctcccaacttgcctgccaacatgggaccccagcagcagacagagggagggagacagacaggtggcaggggccaaaaaatgagaccatgcgttgccaccctgtcaccagttccctggcaagatctagcaaggtcaccttttgcttatgatttccttctttgtgaagaggagggttgaaatgcagcctggagggaatatttggatgaaagcaagggctttgcccccacaatttgggagacacactctcgccagtatttttcagagcaagagatgttccagccaaggagaatgtcatcactgtgtataggagcagagctgttaagatacacactgtactatggtgggcccgattttccagcccctaggtcaaagcccaaaaaccctcagttctgggaagggaagcccaggtttcttcaggtgagaggactcttgggtgtggccctgcagagggagctgattgtttgtgctgggaaatttagaggatgccccagactgctccttagcttctcatccctgggggaaaggtggtgagaccagagaaactcagtggcactaggccagggaggactgaaatcacattctaatgtgcaggtcctagagatgaaatagcccagcccattctccgggttgagaggtgaagggaaaaatgggtgggaagagcagacgggcagtgcctgccgaacctagaggtggggcaggcagttgtctatctggcaagatttcaggggccccaaagcagactccaccccaaacatcttccccagcgcaagtaaccaaacaatggtgtgtttttggagcacatgctgggtgttccacattgtgctcagtctctgtagaaaattgtcaagttcagtcattactccccagagtcccttcctctttaaagctttgatggagagggcccgaggtcagggctgggaaaacgggttcattcggcacagcagcaagagaaggagagagcatggcaagaagtcctcagctggtggaggaaggcttgaggggacaggatggatggtgagggggatgagggttgggtgggagatgttcttaaagcagggtggaggtgtgcaggaggccaaatgtagctaagggccaagccttgtgggagggacagaaattgggagagaagaaagggacaggcctaaagtacactggcatttttttttgtgaagagagctctaccaagtaacctgaatgagtacttcaagcacattgcagtggaggtgggaatagggataataatccctaatatttgtccagggtcttgccatgtagaaagtgcgcatgctctctctctatgttatgcatgcctgtgcacttgtgcatgcacacatgcacacattgtctctaattttcataacagtcctgccaaggtgggtagggcaggggtgattacccccacttgacagatgaaattcagatgcagagagatgcagtgatttgctcagggttacacagataattttttttttttttttttttgagacagggtctcactctatcaacccaggctggagtgcagtggtgcaatcacagctcactgcagcctcgacttcctgggctcgaggagtcctcccacctcggccgggagtagctgagactacaggtgtgcaccaccatgcctggctaatttttaaaaattcttttgtacagacggcgtttcgtcatgttgcccaggctggtctcgaactcctggcctcaagcgatcctccccccttggcttcccaaagttctgagattacaggtgtgagccaccccactcagcctacatggactattttaatggcagagatgggaccagaaatttagccttccgactcccagggcagcaaagtccagaattggcctaatgagtatctagagtaggtaactatctccatagtgttatgtcaagaatactgggaaggaattctgccccataaatctctctctctctcccaactcactaatacttaaagtttcacccctgaagattcactcgttcggattggaactgcagcccctgttataatgtgaaagggtgctgctgaaggaaagagtagggaaggaaagggagaacatcttggcacctgagaataatgtctgggagtgtccctagaggcctgggtgatggaggaggctggagtagggcgggggtgtgtttgaaggggaggaaggtagcgctggcaaagcctccttccttttgcataaggaggggaggagttctgtcagagtgtgaatgtgggcaacactgggaaggggggccagtctgcccagaagctggcctggccttggagagctctaatgggtgactgcactgggccccagtgctgagtccttggagggagtttgggggagggcttccatgtagccttggcagagggaggggaggggagggcagtggaggcagtggctgaacaaggaagcagattggcctatgaagctgaaatcctggaggggaagggtgggggttgggggaactattcagggagctggcctggagccaagggccagtcccaagcgggtgagcagaggcttgagagctctgggccccattccagctcctgaccttgagtcaccatgcgactcggcacttttccctacctcagcccagacacccatcaggtctctgttatctaggtttcccgttttacagaaaatgtaaaagttactcccatggctcctcctcctgacctaccctgcccttcctacagccctctccctccccccacccccatctagcatcctgcaagccttccgcacctcttggaagctcttgcttgctgcctttgtctcagatctgcttatccccagcgcaggctgcccctgtaccccatgggggcagacatgatctggtcctgaggacgagggcctgaagacctcacccagctcttggccaacgcctcttgactgaagaagcatggttgcaaatagctgcatctgaggagatcgagactgagactgtcagaactgagcaaccaccttagaagtcattcttgccatccattcattcatttcactcaacataatccatttgttgagcacatactatatgccagacactgttgtaggaaactttggatatagctcccagtctaaatagaggtatcattcatcaaaaaagcacctaaataaatataattttgcagcctcaaccctctcattttacaattaggggaaatgggcccagaatggttctggaacttttccaggttgtttgttctggtagtcaggggcaaactcaggccagaacccaagtttcctgactactattccagtgctctttccaccgtgctctggaagaatacggcacaagcataagagcgtagtattcatccctgtacattcatgcagccagccttacctagagtcacagtcaattgtggccaacttggcaagatttgaacatcactgataagcaatctttctctcaatgctgcatctctccagcttgttctttccctaccatcccccacgtatgactaaagttatagcattgactgaaatctttggattaaagcccctgtgatctgactgagaaaaacctgttgagccattacctacaatttacacaaacaaatttcttcgatttgtcttttagggctggcccgaaggccatttacatttgatttttgtgaaggagactgggagtctctcttaaagcgggcattgctaaggaaggcaggtcccctactgcacccctgaagctatgggccccatgaaactccaggcagcaggagggcacaggtggcataaaggaacaggcaggaggaaggtacccgaaaaggaagcaggaaggttctgaagacagactcctacttcacagtttaccctgggggccagccctgcacagaccgtgattggtgacattttgtttcaaaatatgtgtttacatttggtttttgcttatactggattatactggtcttttgtcccctccccagcctggtgtctggtagtttgtacttatttgcagttactgagtggcctgtcctgagaatggtcaagcagctgcccataaacaatctgctagtccctgaattgaaatggagatgacccatcccatcctggcattccgggggggcttactcttccagggaattaattgccttgggaatcctttagtcaattgaaagaaacaggccccaccaaaggccttccccaccatgaccctgataaggacccttttcaaattcctctgcagctgtatgaagggagttcagtgggaaggaacactagtgcaggttccagttgctgcctggagtgcagctgggcctggagccctcctcaaaacaaagcacaactccagctagaggcagcccagtgctttaaaatcacacaccagggagtttcatctgatctctgccatttgcttgctgtgtaatcccaggcaagttatttaacctctctgagcctcagtttcctcatccacaaaatgggtctaatgataaggtaatacccaactcctaacagcgttgacaagattcaaaaaattaacgttatctaatgtctttagcgcagtgcccactaagcaatcagtacatgggagctgctgatattatttggacccaatgaggctttgagatctcccagaggtaggtcaagtcctaacagctgtccatccctgccctcttgttaagttaaaattttcataatgtcaggtttgcttaaagcaaggcccacctgcggggcattccctgcactggtgattcatgagtgggaggcattccgcccacttattttaagctgttctacattttcttccccctgacatggatgtgtttacacaggggaggacggtcccagtcaaaacaagatgaaaatacactgctggctgggagccccaggctaactggtttcaggtcctctcccagctgtcaacacctcacaacagggccccgggggtggagagggggatgcccagccccactcccctgcctccctctgtcggcccagctctgcctggtgtcagggagttggctatcacctggtcaaactagagggagctccagggctgaggtttttccagaattttacaagggcaaaaaggagtggtgatgaggggcaagggcttccctcgccagctctagtgtcagtattgtttctgctgccagggctgcctagttcacaggcagagaaggccactgccagcagaaagtagcagaaaatggtcaaagaaagctcctccagcgtcctgcccttctgcctggaatttctcccactagactcattcctttgggttcgcagcaggctcttggtaaaaagaaattaccccagggaaggagaatccatcaaccccagcagccacagactcttctgggggttaatttctcagctatgccaccgtataaatgaggcagtagagctgggggaggatgcacccagggaggatgttttgatgagcaagcaaacggggtctcccaggcagggagcactgaagattaacatccccaatatgcccaaggcagccttgctgctcctcacgacatcttcataacagcttgctttcatttaccaagaacagaaggagaaaacaatctcctttgccctaaactctactcctcttaaagctgcccactcagaggcagtttggtttcttgccagcgagtcttcaatatttggccacatttgcctgtcccctgaaatcccaaggccaccagataaccaggacccattgtgaggccccaccctaggcagcaccccaccagtctatacttagccagcctgggttgcttctcccagaagcccctcccactattctgaccaagctgaggcaggtcatcacatcccttccctgagaaaaactaaacaattccccttctgagaaagattttccattttaacagggcacctcaagacttcaaacccaagggtgacattaatggtgagaatttcctttatcttagtgagtatttttagtccagatggtttttgtcctccccccactcccatcattccagctgtatggctgccactcactcagagcgtcaggcctgctagccctaaatccctctttgatattggtgccagctgagacttggccaccctgctcctgggctttatcaccctctactgctcactgtgggtgacctattcccaactgacccagcgcctttagctaaagatggaaactgaccaaagtcctagcattagtggagaaccaggagcacacacatgggtgaattatcccttttgtttaagtggttgagccttgcttccaggtcattagcggccacttactcaattaaactatgtttgggtttcccaagtatgtttgattttcacaggtcttttgtgtttgtaactgcacagtttctctcagacaatgattgtccccaaattaaagtgttaactaacagaagactaattcatgaatgtgcctatagttctccacgaggccattagcaaagtcctaacacatacataaccttttttttttttcttactaagcatgtatttactgcatttgtactgtgtgccaggcaccggtccaagccttaggtgtacagtagtaaataagataagcccctgccctcacaaggtttatattctagtctagaaagccaatcagtgctcacttgagaccttgcacggcccattttcagtcgtggtcctgtctgactgtgccttcagtcgtgctagaaagaatagaggtcttactgattactgattgtttgtactatcaaagtggttcttcgggtcaaaacgttgtgcaaattagaagttctacatacagggaaacattgctaggaccttcaggagaataatttaaatatagactccattttaacaacaacttctcaaactaccccctccccatagcagtatatgtgaaaccatgagaacaaacattgaaactggacagaaggttagaaagacgaatttgaaacagtgtgaaaagggctgttcacttggggagccattttgccagcggtgtttgggaaccagaatttctatttatcatagagtttatcacattcacgtagccctttttttcgctctccaaagagctcagctatgctacctacagggtgtccataaagtccataggtaaatatttataaagtcatcaaagacatctttaatctgtaaaaaaaaaaaataaataaaatgatttgtttatgtttccagacattagggtatccataaaacatacataccttgtgtggcattactcccatttcagggatgcggatctagcagcatagagagtttagaggtcttccatgaagtcgccagctggctagtggccaaggtggaaaagaactctggccttctgacatattttcttcccacttgaacacgttcgtttaaaatgggaactaaagtgatgtttcttggggcataactcccttcacaaatgcatcaagggagtccctctcaatttttcatatcattgctgtctgtctgagagctcagtatcagctctgtaggccaaacccatcattgcagcagcctattgttggagataaatcaccctgtgacatgacaaatgccttctgggttatctcccaatcgtgctgagtccccggtgccccaagatgtccaaggagtatctgtgaaactctcgtcccctcaactgctgagctagtaactgtctatacttggctgttcctcggtttccatatttactttagctcttctgcaactctgtcaacaaactccatggtattattagttttagcaaataacaggatgtcagaactgttgaccaggattcgttagtttgctgttagagctctatccctaggacataggggctagtgttccttttattttttaaggtgtatgagctttggcaggaagccttcttggtcaggcccaccatgctctggtgtctataggtctttaaggttgctcgtgccacagaggccccacccacagagacctgggcacttctgtctttgcttggtggtacgaagacatctgtagagtagattaaaaaaaagaagatgaaagaaagaaaagaaatcaatgccaatacttagaattttccatttatgtgctttatttttgcaatcttgctgtgggctttaaaagaaccctgtccttggtaaggtggcttcagtgcttaacattcataatgccggcaagggccggggatgttattttaggctggcactaagaatttccaggtttttgaccctaaatatctttttatttcaaccccacccccaacactgaatgtctcaaggagcaagagaagaggttaaaagggtcactctgttgctggcaggcaaccaggaagtctaggccttggggagaagcatagcttttgtttatttaagcccaaacctagcaaacaatgtaaattaaacataaaaataaaataaaataaaataaggccaaaagacagtctggatgcataccacagacaacagtaaattcccctcctactcccccttggagaggggagtcagcgagcaggggagatggccttgttgccagggaggggctcacaagcaatggaatggggtgaggatggtaggcaggggtgagttccaggcttggatcagggtggggacaggcatgtttgcagagatcctggcaagtctttatagtcagccccagcaggtttttgaggggggaatgagtcacaccccttcagctcacctgggaattgacccaggtttgaccgggcagtgacagccacaaggctggagaagagctggttcctgtagaagggaggttgggccggttcattgaccaaactgtgctgttagagaaaaaccagtcccttccccttctctatgctgggttctctctttcccacaacgatgcccacccctcccccgccgcatgtccctgacctgccaggctgagagtttccactgaccgctgtgaagtatcttaaaaggcatccgttcctcttaacagagaggcaaaaattgccaaagatttgaatataaatcacagcatgttcaggatcatctctctcatagtagatctcactcacattctggtcaaaccttcaggagtgagagggaaagaaagggcagaacagacagcaggcctagaatatgccaagcctcgtccgaatgtgtcacacgaaatgggtctcagtgcccctggcaccataggggctcttcagatagaccctttcttggctcttacctttaggccagcagttcctaaaagcaattccatggactggtgtcaaaagagctgcgtccaaaacacctgagaaatacccttctcccgccccacgcctattccactagacatgctagggctgcagcccaggacgcctgcattttccacaatctcccttaggcccactgcagcccaccatcaaggtttacctgctgtgtgtccaattgtctgctgacactgattggccactgactactctgttgaaagtaatactataatttagttcatactgaagtatttgaactgatagtgttgaatatggcaccttcccagggctttttgcattggaaaagaaggcgttctcattcctcaaagtataaatgaagaactccaggagagatcattggaatccaaaggcatgattctcatggtggcatttgtaaggaccacagtagtggtctggaaaacagctctgactgagagggattttttttttctcaccacccttcagatcacacttctcaagtcacagagggcctctatgccaggactggctctagttagaactgtcctcaagaggagcctgtgggaatcatttcttaggcgtccatatgattgattgtgcacaaatggtacttgtttttatttctccttcatttaaaagagcccattataatgcatgattgatatctttgaaaactgtgcttctggcagtgccaggacttcccgttcccagtatgcagtatgaggcttcaaattggttcccccgtgtccatctgaataccacctcaagcttcccctaagaccctgtcacctgtcacccttgcacagcacacagctagctctggatgtcagagagcgcagaggccatgacttttgacattctggcatgggctagagtgtcctgcattgctatcttgctatgtcttgtggccttactgtccctttggggtcatggggaaggtgacaacataggggaaggggggcggatgccccactctgcctggctatctgtgaattattagactgtgtgaaaggctggagagggtgtttgcacaaatgcacgtgcttccatgctactctttcttccgagaagttgtgtgtattccttgtcagtgattctcaaaccaggccaggagaccttccttaagcccttccaacactcctttgagatccctggtgctgttcccatggttggggggccctccccagggagaagctggccctgtttctccttttctttctgttctggcaatagtgtgccccctgcctcctcctgccactgcccccaccccagctaggctgccttctatccatcctggaaggtgggaggcagcggttggtgatgactggagagccagaggccctttgcaatctgcagagcccctcttcacatgtgatagagtcccacaactgagaatcaaggagctacctcaaatgagctcatggtgaatagctctgctgtgaggtaagcgagggccctaggaggctcacagtgcttacccatcacagccaaggaactaaagagcccagcattattaaccatccttttgttccctagagaacctctgccacttcaaagatcacccattctatagcgaggcccacaatggaggcaggtgctcctgccctcttcacaagcccctcgtctgctgcacccccatccccaacaagatcctcctggttgctgtcttccaagcattgccaatagcccccaagtccttcacatgctactcaaagtaaccctggcaactgccagagaaaatggcttggaatttcggctcttggaactgttccacagagcagagtggatggagagaggccttgccagtgtcccgctggcctggatagactggtggagggctggtgcagacacataaatgtggagagtggcatagtcttgctgctttctttctcagcccctgggaaggctgcaggacactgggattgccaaagggtgggctgtgacgagggagcctgtttgcctacctgaagatgcttgttggtctgtaggagagggcaaggaaccttagcacctgcctctgaaagaggtgggataagtataaggctgagaggagctggctaaaggacaaagatcgagaagttggcacggagaggtgagcccatgctaaacaaagaccaccttcttggaagaaagggactagcaactcagaaagcaaatacctgtgccttgttcccttgctttacaaagccctgcagttaaggaagggaatcagggtgagagacctttcctggcactatcagccacaatgttaaaggagtggtagatcccacagaaaccctaagtttcgtgctgctgcattatcctatctaggtgggcaccagttgaggggcagggtggggagaagaaaagcatgcctcattctgccccatgaaatgatgccccagatggtagtggcatggtccttcccaaccccaggccaccccccaacccaagcacccccaagcccgaggctttttcctgaagcaaacatttcactaaggtctaaccagtagggagacttctgaattggccacagacctagaatattctggaaggaagcacaattttggatttgtactgccaatttactttttttaatttccttgaaatgtgccttgtgctttgaataagcatacaactttgaattgaactgatttgaattgaattaaatgataatggcaactagcatgggcaggggaaaggaggacagtgactccatttaccaaggttagttttaccaaccgcctttttcaggtatatctatttcctgcttgtagatggacaatagggagggtggaaaataagaggagggcttggaaaaattatggaggtaaattttcccagctggaaggcataaggggaagggagacaagcataaatattgacacaaggttcatgaaatttaagatccactgagctaaactgcattcctggataagtcgccaataaatacttccagtcctgctgacatggcagaacaaaccaccccccagcatggtgagccaccaaagttagggtgatgaaggtgatttgacaagagcagttttttacttctctgagtgagggcaggaggggtagaatgccttgttaaaacaaggtttggttgcgcccgtcatcccttgtgtcactcagagattgtttgtgatgctcacatgggaccttggacaggaggaagctgaaaggcacaattcattgctcctgccatcattctgtgccagagtttgccccaaatcaattgctagagctgcttttccaagacagtgtccatctctccaccaagattctccttgggctccctcccactcatcatcgccttctgcatctgcatctgcattctcctccccattttcctgcccctgaaattcggagctctgggccctggccatgcagggcagttcacatgatccacagagaacaaggcactttctctttctctgtctttccttcttgcttccctccttctggactttggggattttccatgaaaccaaagtaactatgtaagtggcagtggccttcctgtctatagtctcccacactggagtggaaccagaagggaagagagaagataagcgagaagcaaggacaaattaaaccatggcatttcagcctccttattcctccagcctcttcagaaaaagggacaagtaagtaattagaactagacagtgcttcagatggagggggcccgtagtggaggagtaagtggggagggatgtttttcaaccatcccattaacactgtgttaacgctctagtgctcaatatcctttttgtatttccttttccagctcctaacccagtgtttgctttgtggcttctcccgcacctctcgcatcatgtctttttccgcttctcctgacacaggaccctgtgttttgctggcaacattgccgaacctttgggtggaacattccctgtagaaaataaggaagacttacctataaatagtttccttctggctgtgtggtacacagtgcttcaagtgtaacaaaaagggaagtgagatgttccccctcatcaccacccccaacctaccgcacccgccctgaatctgctgtccaacgccatcagggctctgagatcctgcccggggttatgctgcccagactttgcccagtctctgttctactgtcccatgggaacctgacgtaggaagggctcttgtcctagagagtccagtctggcttttgaaggggaaaagatgaatgggaaatgctgaggcacttctttcagctcaaagggaatatgctggtttccaaagcctcctgaaatgaagggaattggccctgtcctcattacgccaccctccatctagaaggtcgcccctgagaaaggtagggtcagccatgtctgttttgttactatgtccctttaagactacagctgagagccagcaaagggcctggctcctcagtgaggtgctgttgccgtgttggctctgggtccagcctacattgtgagttgtgggatgtcagaaagagaatttggcaacatttatgaatgttggggtagctgggccattgaatgcctaggccactgtttcctgtttggggcccacttccacgggacacaaggaccctgagagtctcaatattggatcagatcatggataggtacagcacaaacttccactcactgcaaggtttggcatagctattctgggtggagaaattttctggtgtgctgagggttaagcagaaaactctttgggttcctcctccttcccccacccccacccttcctacccacccttatctcccctgcccttgttgttggaaaatcttttttcttttcttttcttttttttctttagacagagtttcgctcttgttgcccaagctggagtgcaatgccacgatctcggctcactgcaacctccgcctcgcgggttcaagtgattcttctgcctcagcctcccgagtagctgggattacaggcatgcgccaccatgcccggctaattttttgtatttttaatagaaactgggtttcaccatgttggccaggctggtctcgaactcctgacctcaggtgatctgcccaccgcagcctcctgaagtgctgagattacaggcgtgagccgctgcgcctggccagaaaatctttctacagagacatttaagtccatattcttcccttagggagccagtggaccctgggatccattcattctttcctaatggaggatcataaggtctcagggtgatcacatctcactcagcagaaccagagatgtagagaggatgagagcttgtctgagtctgggctgaacctgggacctcctttccaagtctttttttttttttttaactaaatctttgatacgaacttgttttcttattgacctcattttcctaaaagctggaatagggggaaaaaggagttaattaagagttgccggtgagtggggctccaggaactcaaagtttgactgcattgtgattgtgctgccaagactccatacttgatttggaatattgtacactctcctacacgttccattctggaagccaccctgttagattaatgtctcctatttcccaaacagatagctttctttgaggattgcttggctgccttttggaatgatgtggttgagcatggccgtctcataaagctcatttggacagttggatattgttccagtcacccattgcagctctcctctgcctcacgtgtcagaaaagccaaggctcgcagaactcaaaggcagtctctggacctctctaatagtagggctgctgcttctcaccctttcttcttccttaccactctctggcacctccaaaccccctaccaacttcctcaactcactcattcaagcctctaaccattcaacaaacctattccctgccccactgatcagtgcagtaggaacagatttgatctctgggtcaggaagaccctgggctgcagttctagctctgtaatttattacctttgccgccttgggcaaggtagcctctcagacccttggtttcttcatctgtaaaatgatagtgacagtgcctaaaccttggggttggtggtgcagccagcacagtgtctgcccatagctgatgctctattaatagtaactattattgtcagtgagtctcagactcaatttgcttttataattgaagtataactaatgaacaactcagacgagatcaggtgtgttcagggtggtatggccgtagacaaattaatgatcaattcaaatgcagctttgctgggaaccttaacccttttgccttcccttcccataccacctggatttctctgcctctgtctccacataagggagtccctcttgaaggagctgtttttacttctgtcctgtgccctgttttcctggtggtgtttttcccctgccagcccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctgaagtacctctaatgctgtgcatggctgggcccatcacagggcaggtgttttcctgggatcgtttatataaatgtatacctttggtttggagtgttattgtcattcgctgttttaaagaaaagtaacaaagttgtgtttttaaaaaatagagacacgggatcctggataatgttgaatgtattttcttcaaagagtagaatgtggagactaaagagaaaagggctggcatcttgtggtcactccagtgctcactccaataccctgtctcctcctcacctcctctgtcacccacctagctgctctcccatacatgttcacccactcacctcagctcccggacaccctctcctccatacatatgcatctgtagattagcatggacctgtgcatgcattacatgcatgtcacagatctgtacatgtgccggtccacagacaagtactcccacacctgaacattcagaggaaggggcaagtggatgagtgctggggttcagggcaggtcggcaggccagctggctggtgaggggaaagctgagttgattagagagtgaatgtgcaggtgacaaagtatgtgtgcaggggagagactgagagggcagtgactgggaagagggtgaggccgtgatggtgagggcgcgtgtccagggagtatgacatgggagagcatgcaaagccatgggggcatgctggctgccacctgaagaagagcttttcaaactagcgctgttctttactgaatgccctctgcctcttgttagggcatttgtatttcttatttctctagaaatcagctccagtttggtttttatcgatctccagagccttctttggagatgccagttggtacaagaaagtgctgaactgtttacagtcccagcctaaggttcagggaggggatgtggtttaactgggccacaaagcccggtacaggactcatttgcatggcccctgacgccatgtgacgcagccggctcctcctatataaagaagcaggagccaaaatatctccgagtctgggttggactggcggccgtggagtttgtgacatacgaggtgacacccctcgagtcacttcccttcaactccagctggagcgcctgcttggctttgggttcgttctgcagccttcgccccgctcctagcctcagggccggactccagcgcagagcccagcccagcgcagcctgccagcagccacccagccgcccagccgcccagccccgcacgaaacccggccagagcttcctagcagcccgagccatgaacaccgaaatgtatcagacccccatggaggtggcggtctaccagctgcacaatttctccatctccttcttctcttctctgcttggaggggatgtggtttccgttaagctggacaacaggtaaccgctggccccagctccggcgcctcccgagccggggcgccggccggagctgggctaggagcccggtctctgagcgagctgtgtgccgccggtccctgttccccgcggtgcagcatcctgggaaggggcgggggggaggggacgcaggaaggggggggtcaccgccgctctgggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccac
